United States Patent
Buelow et al.

(10) Patent No.: US 12,016,313 B2
(45) Date of Patent: Jun. 25, 2024

(54) HUMAN ANTIBODIES FROM TRANSGENIC RODENTS WITH MULTIPLE HEAVY CHAIN IMMUNOGLOBULIN LOCI

(71) Applicant: OMNIAB OPERATIONS, INC., Emeryville, CA (US)

(72) Inventors: Roland Buelow, Palo Alto, CA (US); Marianne Bruggemann, Cambridge (GB); Biao Ma, Cambridge (GB); Michael J. Osborn, Sturmer (GB)

(73) Assignee: OMNIAB OPERATIONS, INC., Emeryville, CA (US)

( * ) Notice: Subject to any disclaimer, the term of this patent is extended or adjusted under 35 U.S.C. 154(b) by 696 days.

(21) Appl. No.: 16/478,466

(22) PCT Filed: Jan. 19, 2018

(86) PCT No.: PCT/US2018/014568
§ 371 (c)(1),
(2) Date: Jul. 16, 2019

(87) PCT Pub. No.: WO2018/136823
PCT Pub. Date: Jul. 26, 2018

(65) Prior Publication Data
US 2020/0163316 A1 May 28, 2020

Related U.S. Application Data

(60) Provisional application No. 62/448,317, filed on Jan. 19, 2017.

(51) Int. Cl.
*A01K 67/0278* (2024.01)
*C12N 15/85* (2006.01)

(52) U.S. Cl.
CPC .... *A01K 67/0278* (2013.01); *A01K 2217/052* (2013.01); *A01K 2217/075* (2013.01); *A01K 2217/15* (2013.01); *A01K 2227/105* (2013.01); *A01K 2267/01* (2013.01); *C12N 15/8509* (2013.01)

(58) Field of Classification Search
None
See application file for complete search history.

(56) References Cited

U.S. PATENT DOCUMENTS

| | | | |
|---|---|---|---|
| 4,361,659 A | 11/1982 | Friedemann et al. |
| 4,559,377 A | 12/1985 | Gleason et al. |
| 4,977,081 A | 12/1990 | Raybould et al. |
| 5,223,323 A | 6/1993 | Dickerhof et al. |
| 5,545,806 A | 8/1996 | Lonberg et al. |
| 5,545,807 A | 8/1996 | Surani et al. |
| 5,569,825 A | 10/1996 | Lonberg et al. |
| 5,574,205 A | 11/1996 | Kucherlapati et al. |
| 5,625,126 A | 4/1997 | Lonberg et al. |
| 5,721,367 A | 2/1998 | Kay et al. |
| 5,770,429 A | 6/1998 | Lonberg et al. |
| 5,800,988 A | 9/1998 | Casterman et al. |
| 5,840,526 A | 11/1998 | Casterman et al. |
| 5,874,541 A | 2/1999 | Casterman et al. |
| 5,939,598 A | 8/1999 | Kucherlapati et al. |
| 6,005,079 A | 12/1999 | Casterman et al. |
| 6,015,695 A | 1/2000 | Casterman et al. |
| 6,023,010 A | 2/2000 | Krimpenfort et al. |
| 6,075,181 A | 6/2000 | Kucherlapati et al. |
| 6,091,001 A | 7/2000 | Jakobovits et al. |
| 6,114,598 A | 9/2000 | Kucherlapati et al. |
| 6,139,835 A | 10/2000 | Kucherlapati et al. |
| 6,150,584 A | 11/2000 | Kucherlapati et al. |
| 6,162,963 A | 12/2000 | Kucherlapati et al. |
| 6,372,956 B1 | 4/2002 | Goldsmith et al. |
| 6,514,752 B1 | 2/2003 | Kucherlapati et al. |
| 6,528,313 B1 | 3/2003 | Le Mouellic et al. |
| 6,528,314 B1 | 3/2003 | Le Mouellic et al. |
| 6,586,251 B2 | 7/2003 | Economides et al. |
| 6,596,541 B2 | 7/2003 | Murphy et al. |
| 6,657,103 B1 | 12/2003 | Kucherlapati et al. |
| 6,673,986 B1 | 1/2004 | Kucherlapati et al. |
| 6,713,610 B1 | 3/2004 | Kucherlapati et al. |
| 6,765,087 B1 | 7/2004 | Casterman et al. |
| 6,833,268 B1 | 12/2004 | Green et al. |
| 7,041,870 B2 | 5/2006 | Tomizuka et al. |
| 7,041,871 B1 | 5/2006 | Lonberg et al. |
| 7,064,244 B2 | 6/2006 | Jakobovits et al. |
| 7,098,031 B2 | 8/2006 | Choulika et al. |
| 7,129,084 B2 | 10/2006 | Buelow et al. |
| 7,145,056 B2 | 12/2006 | Jakobovits et al. |
| 7,262,336 B2 | 8/2007 | Young et al. |

(Continued)

FOREIGN PATENT DOCUMENTS

| | | |
|---|---|---|
| AU | 2008/259939 B2 | 3/2014 |
| AU | 2018/223041 A1 | 9/2018 |

(Continued)

OTHER PUBLICATIONS

Vettermann et al Allelic exclusion of immunoglobulin genes: models and mechanisms Immunological Reviews 2010 vol. 237: 22-42.*
Ma et al., 2013; Human antibody expression in transgenic rats: Comparison of chimeric IgH loci with human VH, D and JH but bearing different rat C-gene regions; Journal of Immunological Methods pp. 78-86.*
Bork, 2000, Powers and Pitfalls in Sequence Analysis: The 70% Hurdle Genome Research 10:398-400.*
Chen and Zhao, "A highly sensitive selection method for directed evolution of homing endonucleases." Nucleic Acid Research, vol. 33(18), p. e154 (2005).

(Continued)

*Primary Examiner* — Maria G Leavitt
(74) *Attorney, Agent, or Firm* — Knobbe, Martens, Olson & Bear LLP

(57) ABSTRACT

The invention relates to transgenic animals useful for optimal production of functional immunoglobulins with human idiotypes.

10 Claims, 83 Drawing Sheets
Specification includes a Sequence Listing.

(56) References Cited

U.S. PATENT DOCUMENTS

| | | |
|---|---|---|
| 7,491,866 B2 | 2/2009 | Hammer et al. |
| 7,501,552 B2 | 3/2009 | Lonberg et al. |
| 7,585,668 B2 | 9/2009 | Buelow et al. |
| 7,910,798 B2 | 3/2011 | Tanamachi et al. |
| 8,137,966 B2 | 3/2012 | Teratani et al. |
| 8,502,018 B2 | 8/2013 | Murphy et al. |
| 8,652,842 B2 | 2/2014 | Platzer et al. |
| 8,685,737 B2 | 4/2014 | Serber et al. |
| 8,703,485 B2 | 4/2014 | Buelow |
| 8,907,157 B2 | 12/2014 | Buelow |
| 9,388,233 B2 | 7/2016 | Buelow |
| 9,426,970 B2 | 8/2016 | Tomizuka et al. |
| 9,475,859 B2 * | 10/2016 | Bruggemann .......... C07K 16/00 |
| 9,701,971 B2 | 7/2017 | Serber et al. |
| 9,708,635 B2 | 7/2017 | Murphy et al. |
| 10,072,069 B2 | 9/2018 | Buelow |
| 10,385,132 B2 * | 8/2019 | Bruggemann ..... C07K 16/2863 |
| 10,385,359 B2 | 8/2019 | Lee et al. |
| 10,626,418 B2 | 4/2020 | Horwitz et al. |
| 2003/0017534 A1 | 1/2003 | Buelow et al. |
| 2003/0217373 A1 | 11/2003 | Green et al. |
| 2004/0002092 A1 | 1/2004 | Arnould et al. |
| 2004/0158880 A1 | 8/2004 | Buelow et al. |
| 2004/0199934 A1 | 10/2004 | Hess et al. |
| 2005/0064474 A1 | 3/2005 | Urnov et al. |
| 2005/0153392 A1 | 7/2005 | Buelow et al. |
| 2005/0229263 A1 | 10/2005 | Buelow |
| 2006/0015957 A1 | 1/2006 | Lonberg et al. |
| 2006/0026696 A1 | 2/2006 | Buelow et al. |
| 2006/0026703 A1 | 2/2006 | Lonberg et al. |
| 2006/0085866 A1 | 4/2006 | Poueymirou et al. |
| 2006/0117398 A1 | 6/2006 | Buelow et al. |
| 2006/0153826 A1 | 7/2006 | Arnould et al. |
| 2006/0206949 A1 | 9/2006 | Arnould et al. |
| 2008/0209587 A1 | 8/2008 | Liljedahl et al. |
| 2010/0086533 A1 | 4/2010 | Montoya et al. |
| 2011/0269234 A1 | 11/2011 | Doyon |
| 2012/0090041 A1 | 4/2012 | Buelow |
| 2012/0204278 A1 | 8/2012 | Bradley et al. |
| 2014/0148361 A1 | 5/2014 | Stoddard et al. |
| 2014/0186843 A1 | 7/2014 | Zhang et al. |
| 2014/0335063 A1 | 11/2014 | Cannon et al. |
| 2014/0356907 A1 * | 12/2014 | Grosveld ............... C07K 16/00 |
| | | 435/69.6 |
| 2015/0240263 A1 | 8/2015 | Holmes et al. |
| 2017/0037429 A1 | 2/2017 | Lee et al. |
| 2017/0204430 A1 | 7/2017 | Lee et al. |
| 2018/0258411 A1 | 9/2018 | Kadiyala et al. |
| 2019/0093128 A1 | 3/2019 | Chen et al. |
| 2019/0112619 A1 | 4/2019 | Frendewey et al. |
| 2019/0144920 A1 | 5/2019 | Carpenter et al. |
| 2019/0169270 A1 | 6/2019 | Buelow |
| 2019/0225992 A1 | 7/2019 | Auerbach et al. |
| 2019/0284572 A1 | 9/2019 | Hunt et al. |
| 2019/0316149 A1 | 10/2019 | Lee et al. |
| 2019/0323032 A1 | 10/2019 | Lee et al. |

FOREIGN PATENT DOCUMENTS

| | | |
|---|---|---|
| AU | 2018/210420 A1 | 8/2019 |
| CA | 2688834 A1 | 12/2008 |
| CA | 3050715 A1 | 7/2018 |
| CN | 1199422 A | 11/1998 |
| CN | 1839144 | 9/2006 |
| CN | 101506235 | 8/2009 |
| CN | 101784664 A | 7/2010 |
| CN | 102482342 | 5/2012 |
| CN | 102850452 A | 1/2013 |
| CN | 103154255 | 6/2013 |
| CN | 103205426 | 7/2013 |
| CN | 104159444 | 11/2014 |
| CN | 104994729 A | 10/2015 |
| CN | 105274116 | 1/2016 |
| CN | 110042105 A | 7/2019 |
| CN | 110662421 A | 1/2020 |
| DE | 1571428 A | 12/1970 |
| DE | 2152880 A1 | 4/1973 |
| DE | 2336329 A1 | 2/1974 |
| DE | 2602323 A1 | 7/1977 |
| DK | 2152880 T3 | 11/2011 |
| DK | 2336329 T3 | 1/2013 |
| DK | 2602323 T3 | 4/2018 |
| DK | 2931030 T3 | 8/2020 |
| EP | 0491057 A1 | 6/1992 |
| EP | 0495423 A2 | 7/1992 |
| EP | 0583980 A1 | 2/1994 |
| EP | 0463151 B1 | 6/1996 |
| EP | 1127130 A1 | 8/2001 |
| EP | 0814159 B1 | 7/2005 |
| EP | 1589107 A1 | 10/2005 |
| EP | 1127130 B1 | 11/2006 |
| EP | 1414858 B1 | 4/2007 |
| EP | 01414858 B1 | 4/2007 |
| EP | 1854473 A1 | 11/2007 |
| EP | 0652950 B1 | 12/2007 |
| EP | 1399559 B1 | 4/2008 |
| EP | 2336329 A1 | 6/2011 |
| EP | 2152880 B1 | 8/2011 |
| EP | 2602323 A1 | 6/2013 |
| EP | 3382022 A1 | 10/2018 |
| EP | 3570668 A1 | 11/2019 |
| EP | 2931030 B1 | 4/2020 |
| EP | 3653049 A1 | 5/2020 |
| ES | 2152880 B1 | 8/2001 |
| ES | 2336329 T3 | 4/2010 |
| ES | 2602323 T3 | 2/2017 |
| FR | 2152880 A1 | 4/1973 |
| FR | 2336329 A3 | 7/1977 |
| FR | 2602323 B1 | 4/1990 |
| FR | 2931030 B1 | 4/2010 |
| GB | 1313614 A | 4/1973 |
| GB | 2152880 A | 8/1985 |
| GB | 2336329 A | 10/1999 |
| HK | 1135138 A1 | 5/2010 |
| IL | 202302 A | 7/2013 |
| IL | 220209 A | 11/2013 |
| IL | 239300 A | 1/2021 |
| JP | 2004-524841 A | 8/2004 |
| JP | 2010-535510 A | 11/2010 |
| JP | 2014-027947 A | 2/2014 |
| JP | 5823690 B2 | 11/2015 |
| JP | 2016-505257 A | 2/2016 |
| JP | 6220827 B2 | 10/2017 |
| JP | 2020-505037 A | 2/2020 |
| JP | 6705650 B2 | 6/2020 |
| JP | 6712254 B2 | 6/2020 |
| JP | 2020-125360 A | 8/2020 |
| KR | 10-2010-0037027 | 4/2010 |
| KR | 10-1661357 B1 | 9/2016 |
| KR | 10-1703299 81 | 2/2017 |
| KR | 10-1886610 B1 | 8/2018 |
| KR | 10-2019-0104400 A | 9/2019 |
| KR | 10-2096731 B1 | 4/2020 |
| KR | 10-2239125 B1 | 4/2021 |
| LT | 2602323 T | 4/2018 |
| LT | 2931030 T | 11/2020 |
| NZ | 581396 A | 7/2012 |
| NZ | 709608 A | 9/2020 |
| NZ | 749259 A | 9/2020 |
| PL | 2152880 T3 | 3/2012 |
| PL | 2336329 T3 | 4/2013 |
| PL | 2602323 T3 | 6/2018 |
| PT | 2152880 E | 12/2011 |
| PT | 2336329 E | 12/2012 |
| PT | 2602323 T | 4/2018 |
| PT | 2931030 T | 8/2020 |
| SG | 182144 A1 | 7/2012 |
| SI | 2602323 T1 | 5/2018 |
| SI | 2931030 T1 | 10/2020 |
| WO | WO-9004036 A1 | 4/1990 |
| WO | WO-9402602 A1 | 2/1994 |
| WO | WO-9633735 A1 | 10/1996 |
| WO | WO-9716537 A1 | 5/1997 |

(56) References Cited

FOREIGN PATENT DOCUMENTS

| WO | WO-9734103 A1 | 9/1997 |
|----|---------------|--------|
| WO | WO-9824893 A2 | 6/1998 |
| WO | WO-0212437 A2 | 2/2002 |
| WO | WO-0243478 A2 | 6/2002 |
| WO | WO-02066630 A1 | 8/2002 |
| WO | WO-02085944 A2 | 10/2002 |
| WO | WO-02085945 A2 | 10/2002 |
| WO | WO-03047336 A2 | 6/2003 |
| WO | WO-03078619 A1 | 9/2003 |
| WO | WO-03087341 A2 | 10/2003 |
| WO | WO-2004049794 A2 | 6/2004 |
| WO | WO-2004067736 A2 | 8/2004 |
| WO | WO-2004076618 A2 | 9/2004 |
| WO | WO-2005014650 A2 | 2/2005 |
| WO | WO-2005038001 A2 | 4/2005 |
| WO | WO-2006008548 A2 | 1/2006 |
| WO | WO-2006097784 A1 | 9/2006 |
| WO | WO-2006097853 A1 | 9/2006 |
| WO | WO-2007096779 A2 | 8/2007 |
| WO | WO-2008151081 A1 | 12/2008 |
| WO | WO-2011004192 A1 | 1/2011 |
| WO | WO-2011158009 A1 | 12/2011 |
| WO | WO-2012063048 A1 | 5/2012 |
| WO | WO 2014/093908 A2 | 6/2014 |
| WO | WO-2014093908 A2 | 6/2014 |
| WO | WO-2014141189 A1 | 9/2014 |
| WO | WO-2015179535 A1 | 11/2015 |
| WO | WO-2018136823 A1 | 7/2018 |
| WO | WO-2021034958 A2 | 2/2021 |

OTHER PUBLICATIONS

Zhang et al., "Transcription of a Productively Rearranged Ig VDJC Does Not Require the Presence of HS4 in the Igh 3¢ Regulatory Region ," The Journal of Immunology, vol. 178, pp. 6797-6306, 2007.
First Office Action for Chinese Application No. 201210301950.9, dated Nov. 20, 2013, 23 pages.
Second Office Action for Chinese Application No. 201210301950.9, dated Oct. 10, 2014, 10 pages.
Third Office Action for Chinese Application No. 201210301950.9, dated Apr. 8, 2015, 24 pages.
European Search Report for Application No. 08769934.4, dated May 3, 2010, 4 pages.
European Search Report for Application No. 11161775.9, dated Apr. 19, 2011, 3 pages.
European Search Report for Application No. 12187787.2, dated Apr. 10, 2013, 4 pages.
European Search Report for Application No. 18158882.3, dated Jun. 22, 2018, 5 pages.
Spain Search Report for Application No. 08769934.4, dated Dec. 7, 2000, 1 page.
Office Action for Japanese Patent Application No. 2020-092210, dated Jul. 6, 2021, 4 pages.
Office Action for Canadian Patent Application No. 2,895,144, dated Sep. 28, 2021 in 3 pages.
Notice of Grounds for Rejection for Korean Patent Application No. 10-2015-7018403 dated Jul. 12, 2021 in 10 pages.
Great Britain Search Report for Application No. 9908800.7, dated Jul. 6, 1999, 1 page.
European Examination Report for European Patent Application No. 18707162.6 dated Jul. 15, 2021 in 3 pages.
First Office Action for Chinese Application No. 201880011903.6, dated Apr. 22, 2021 in 24 pages.
Second Office Action for Chinese Application No. 201880011903.6, dated Jan. 13, 2022 in 21 pages.
Office Action for Japanese Application No. 2019-539830, dated Nov. 2, 2021 in 14 pages.
Andris-Widhopf, et al. Methods for the generation of chicken monoclonal antibody fragments by phage display. J Immunol Methods. Aug. 28, 2000;242(1-2):159-81.

Argast et al., I-Ppol and I-Crel homing site sequence degeneracy determined by random mutagenesis and sequential in vitro enrichment. J. Mol. Biol. 280:345-353 (1998).
Bao et al.: The Pathogenicity of SARS-COV-1 2 in hACE2 Transgenic Mice. (reprint 2020) doi: https://doi.org/10.1101/2020.02.07.939389.
Beumer, et al. Efficient gene targeting in *Drosophila* by direct embryo injection with zinc-finger nucleases. Proc Natl Acad Sci USA. Dec. 16, 2008. 105(50):19821-19826. doi: 10.1073/pnas.0810475105. Epub Dec. 8, 2008.
Beumer et al., Efficient gene targeting in *drosophila* with zinc-finger nucleases. Genetics 172(4):2391-2403 (2006).
Bibikova et al., Enhancing gene targeting with designed zinc finger nucleases. Science 300:764 (2003).
Bibikova et al., Targeted chromosomal cleavage and mutagenesis in drosophila using zinc-finger nucleases. Genetics 161(3):1169-1175 (2002).
Biery et al., Gene transfer by pronuclear injection in the bovine. Theriogenology 29(1):224-225 (1988).
Brem et al., Production of transgenic rabbits, mice and pigs by microinjection into pronuclei. Short Communication—Institute fur Teierzucht and Tierhygiene, Ludwig-Maximilians-Universitat, Munchen, (20):251-252 (1985).
Brinster, et al. Factors affecting the efficiency of introducing foreign DNA into mice by microinjecting eggs. Proc Natl Acad Sci U S A. Jul. 1985;82(13):4438-4442.
Bruggemann et al., A repertoire of monoclonal antibodies with human heavy chains from transgenic mice. PNAS 86:6709-6713 (1989).
Bruggemann et al., Human antibody production in transgenic animals. Arch. Immunol. Ther. Exp. 63:101-108 (2015).
Bruggemann et al. Human Antibody Production in Transgenic Mice : Expression from 100 kb of the Human IgH Locus.Eur. J. Immunol. 1991. 21:1323-1326.
Bruggemann et al.: Immunoglobulin heavy chain locus of the rat: Striking homology to mouse antibody genes. Proc. Natl. Acad. Sci. USA. 83:6075-6079 (1986).
Bruggemann et al., Strategies for expressing human antibody repertoires in transgenic mice. Immunology Today 17(8):391-397 (1996).
Bryda et al., Method for detection and identification of multiple chromosomal integration sites in transgenic animals created with lentivirus. Biotechniques 41(6):715-719 (2006).
Buehr et al, Capture of authentic embryonic stem cells from rat blastocysts. Cell 135:1287-1298 (2008).
Buelow et al., Expression of a humanized antibody repertoire in transgenic rabbits. Human Antibodies 15:19-23 (2006).
Capecchi et al., Gene targeting in mice: functional analysis of the mammalian genome for the twenty-first centry. Nature Reviews Genetics 6(6):507-512 (2005).
Capecchi, M. Altering the genome by homologous recombination. Science. Jun. 16, 1989;244(4910):1288-1292.
Carbery et al., Targeted genome modification in mice using zinc-finger nucleases. Genetics 186:451-459 (2010).
Charreau et al., Transgenesis in rats: technical aspects and models. Transgenic Research 5(4):223-234 (1996).
Chatterjee et al.: Dynamic Changes in Binding of Immunoglobulin Heavy Chain 3' Regulatory Region to Protein Factors during Class Switching. The Journal of Biological Chemistry. 286(33):29303-29312 (2011).
Chen et al., A highly sensitive selection method for directed evolution of homing endonucleases. Nucleic Acids Research 33(18):e154 (2005).
Chen et al., B cell development in mice that lack one or both immunoglobulin light chain genes. EMBO Journal 12(3):821-830 (1993).
Chen et al., Immunoglobulin gene rearrangement in B cell deficient mice generated by targeted deletion of the JH locus. International Immunology 5(6):647-656 (1993).
Chothia et al. Canonical structures for the hypervariable regions of immunoglobulins. J Mol Biol 196:901-917 (1987).

(56) References Cited

OTHER PUBLICATIONS

Choulika et al., Induction of Homologous Recombination in Mammalian Chromosomes by Using the I-SceI System of *Saccharomyces cerevisiae*. Molecular and Cellular Biology, 15.4 (Apr. 1995): 1968-1973.
Cibelli, et al. Cloned transgenic calves produced from nonquiescent fetal fibroblasts. Science, 280 (1998):1256-1258.
Cohen-Tannoudji et al., I-SceI-induced gene replacement at a natural locus in embryonic stem cells. Molecular and Cellular Biology 18(3):1444-1448 (1998).
Cronkhite et al., Male and female germline specific expression of an EGFP reporter gene in a unique strain of transgenic rats. Dev. Biol. 284(1):171-183 (2005).
Cui et al., Targeted integration in rat and mouse embryos with zinc-finger nucleases. Nature Biotech. 29(1):64-68 (2011).
D'Addabbo et al.: Position and sequence conservation in Amniota of polymorphic enhancer HS1.2 within the palindrome of IgH 3'Regulatory Region. BMC Evolutionary Biology. 11:71 (2011) 12 pages.
Davis et al., Transgenic mice as a source of fully human antibodies for the treatment of cancer. Cancer Metastasis Rev. 18:421-425 (1999).
Definition of "germ cell," Free Online Medical Dictionary (2010).
DeGenst, Erwin et. al., Antibody repertoire development in camelids. Developmental and Comparative Immunology, 2006 ;30(1-2):187-98.
Dimitrov et al., Therapeutic antibodies: current state and future trends—is a paradigm change coming soon? Methods in Molecular Biology 525:1-27 (2009).
Donoho et al., Analysis of Gene Targeting and Intrachromosomal Homologous Recombination Stimulated by Genomic Double-strand Breaks in Mouse Embryonic Stem Cells. Molecular and Cellular Biology, 18.7 (Jul. 1998): 4070-4078.
Dr. Aron Geurts C.V., Jun. 26, 2018.
Dr. Aron Geurts Declaration, Jun. 26, 2018.
Durai et al., Zinc finger nucleases: custom-designed molecular scissors for genome engineering of plant and mammalian cells. Nucleic Acids Research 33(18):5978-5990 (2005).
Epinat et al., A novel engineered meganuclease induces homologous recombination in yeast and mammalian cells. Nucleic Acid Research 31(11):2952-2962 (2003).
European Patent Application No. 08769934.4 Extended European Search Report dated May 18, 2010.
European Patent Application No. 11161775.9 European Search Report dated May 11, 2011.
European Patent Application No. 12187787.2 European Search Report dated May 13, 2014.
European Patent Application No. 13843056.6 Response filed Jun. 23, 2017 to Examination Report dated Dec. 15, 2016.
Excerpts of file history for U.S. Pat. No. 8,703,485 published Apr. 22, 2014.
Filipiak et al., Advances in Transgenic Rat Production. Transgenic Research, 15.6 (Sep. 2006): 673-686.
Fishwild, et al. High-avidity human IgG kappa monoclonal antibodies from a novel strain of minilocus transgenic mice. Nat Biotechnol. Jul. 1996;14(7):845-51. Nat Biotechnol. Jul. 1996;14(7):845-51.
Geurts et al., Knockout rats via embryo microinjection of zinc-finger nucleases. [with supplemental materials] Science 325:433 (2009).
Gordon et al, Genetic transformation of mouse embryos by micronijection of purified DNA. PNAS 77(12):7380-7384 (1980).
Gorman et al., Reshaping a therapeutic CD4 antibody. Proc Natl Acad Sci U S A. 88(10):4181-4185 (1991).
Green, et al. Antigen-specific human monoclonal antibodies from mice engineered with human Ig heavy and light chain YACs. Nat Genet. May 1994;7(1):13-21.
Green et al., Regulation of B cell development by variable gene complexity in mice reconstituted with human immunoglobulin yeast artificial chromosomes. J. Exp. Med. 188(3):483-495 (1998).
Hammer, et al. Production of transgenic rabbits, sheep and pigs by microinjection. Nature. Jun. 20-26, 1985;315(6021):680-683.
Hammer et al., Spontaneous inflammatory disease in transgenic rats expressing HLA-B27 and human beta-2m: an animal model of HLA-B27-associated human disorders. Cell 63(5):1099-1112 (1990).
Hamming. Tissue distribution of ACE2 protein, the functional receptor for SARS coronavirus. A first step in understanding SARS pathogenesis. J Pathol. 203: 631-637 (2004).
Harriman et al., Targeted deletion of the IgA constant region in mice leads to IgA deficiency with alterations in expression of other kg isotypes. Journal of Immunology 162(5):2521-2529 (1999).
Hochi et al., Successful production of transgenic rats. Animal Biotech. 1:175-184 (1990).
Hoffmann et al. SARS-CoV-2 Cell Entry Depends on ACE2 and TMPRSS2 and Is Blocked by a Clinically Proven Protease Inhibitor. Cell 181:271-280 (2020).
Hong et al., Derivation and characterization of embryonic stem cells lines derived from transgenic Fischer 344 and Dark Agouti rats. Stem Cells and Development 21(9):1571-1586 (2012).
IgG heavy chain 2a gene segment (Rat Genome Database ID: 13596226 [1359626]) (2005).
IgM heavy chain constant gene segment (rat Genome Database ID: 1359202 (2005).
Isalan et al., Rapid, high-throughput engineering of sequence-specific zinc finger DNA-binding proteins. Methods in Enzymology 340:593-609 (2001).
Jakobovits et al. Analysis of homozygous mutant chimeric mice: deletion of the immunoglobulin heavy-chain joining region blocks B-cell development and antibody production. PNAS 90:2551-2555 (1993).
Jakobovits et al., From XenoMouse technology to panitumumab, the first fully human antibody product from transgenic mice. Nature Biotechnology 25:1134-1143 (2007).
Janssens et al., Generation of heavy-chain-only antibodies in mice. PNAS 103(41):15130-15135 (2006).
Johnson et al., Double-strand-break-induced homologous recombination in mammalian cells. Biochem. Soc. Trans. 29:196-201 (2001).
Kabat et al. Sequences of Proteins of Immunological Interest. NIH Pub. No. 91-3242. Public Health Service, National Institutes of Health. 1:647-669 (1991).
Kindsvogel et al., A cloned cDNA probe for rat immunoglobulin epsilon heavy chain: construction, identification, and DNA sequence. DNA 1(4):335-343 (1982).
Kitamura and Rajewky, Targeted disruption of mu chain membrane exon causes loss of heavy-chain allelic exclusion. Nature 356:154-156 (1992).
Klug et al., The discovery of zinc fingers and their development for practical applications in gene regulation. Proc. Japan Acad. 81(41): Ser. B:87-102 (2005).
Launay, P. et al. Fcα receptor (CD89) mediates the development of immunoglobulin a (IgA) nephropathy (Berger's disease): Evidence for pathogenic soluble receptor-IgA complexes in patients and CD89 transgenic mice. J. Exp. Med. 191, 1999-2009 (2000).
Li et al., Germline competent embryonic stem cells derived from rat blastocysts. Cell 135(7):1299-1310 (2008).
Liang et al., Homology-directed repair is a major double-strand break repair pathway in mammalian cells. Proc. Natl. Acad. Sci. 95:5172-5177 (1998).
Liu et al., Regulation of an endogenous locus using a panel of designed zinc finger proteins targeted to accessible chromatin regions. Activation of vascular endothelial growth factor A. J. Biol. Chem. 276(14):11323-11334 (2001).
Lloyd et al., Targeted mutagenesis using zinc-finger nucleases in arabidopsis. PNAS USA 102(6):2232-2237 (2005).
Lonberg, et al. Antigen-specific human antibodies from mice comprising four distinct genetic modifications. Nature. Apr. 28, 1994;368(6474):856-9.
Lonberg et al., Human antibodies from transgenic animals. Nature Biotechnology 23(9): 1117-1125 (2005).
Luan et al.: Spike protein recognition of mammalian ACE2 predicts the host range and an optimized ACE2 for SARS-CoV-2 infection. 2020. Biochem. Biophy. Res. Comm. 526. 165e169 (2020).

(56) References Cited

OTHER PUBLICATIONS

Lutz et al., IgD can largely substitute for loss of IgM function in B cells. Nature 393:797-801 (1998).
Ma Biao et al., Human antibody expression in transgenic rats: comparison of chimeric IgH loci with human VH, D and JH hbut bearing different rat C-gene regions. J. Immunol. Methods 400:78-86 (2013).
MacPherson et al., IgA production without mu or delta chain expression in developing B cells. Nature Immunology 2(7):625-631 (2001).
Manis et al.: Mechanism and control of class-switch recombination. TRENDS in Immunology. 23(1):31-39 (2002).
Maruoka. Identification of the rat IgA Fc receptor encoded in the leukocyte receptor complex. 2004. Immunogenetics. 55:712-6.
Max, Edward E. et al., Sequences of five potential recombination sites encoded dose to an immunoglobulin K constant region gene. PNAS USA 76(7):3450-3454 (1979).
McConnel Smith et al., Generation of a nicking enzyme that stimulates site-specific gene conversion from the I-Anil LAGLIDADG homing endonuclease. PNAS 106(13):5099-5104 (2009).
McCray et al.: Lethal Infection of K18-hACE2 Mice Infected with Severe Acute Respiratory Syndrome Coronavirus. 2007. J. Virol. 81. 813-821.
Men et al., Germline transmission of a novel rat embryonic stem cell line derived from transgenic rats. Stem Cells and Develop. 21(12):2606-2612 (2012).
Mendez et al., Functional transplant of megabase human immunoglobulin loci recapitulates human antibody response in mice. Nature Genetics 15:146-156 (1997).
Ménoret et al.: In vivo analysis of human immune responses in immunodeficient rats. 2020. Transplantation. 104: 715-723.
Moehle et al., Targeted gene addition into a specified location in the human genome using designed zinc finger nucleases. PNAS 104:3055-3060 (2007).
Mundt et al., Novel control motif cluster in the IgH delta-gamma 3 interval exhibits B cell-specific enhancer function in early development. J. Immunol. 166:3315-3323 (2001).
Nguyen et al., Heavy-chain only antibodies derived from dromedary are secreted and displayed by mouse B cells. Immunology 109:93-101 (2003).
Nicholson et al., Antibody repertoires of four- and five-feature translocus mice carrying human immunoglobulin heavy chain and kappa and lambda light chain yeast artificial chromosomes. J. Immunol. 163:6898-6906 (1999).
Nitschke et al., Immunoglobulin D-deficient mice can mount normal immune responses to thymus-independent and -dependent antigens. PNAS USA 90(5):1887-1891 (1993).
Ohbayashi et al., Correction of chromosomal mutation and random integration in embryonic stem cells with helper-dependent adenoviral vectors. PNAS 102:13628-13633 (2005).
Ong et al.: Mouse strains with typical mammalian levels of complement activity. 1989. J. Immunol. Methods. 125, 147-158.
Osborn et al., High-affinity IgG antibodies develop naturally in Ig-knockout rats carrying germline human IgH/Igκ/IgλLocibearing the rat CH region. J. Immunol. 190:1481-1490 (2013).
Pabo, et al. Design and selection of novel Cys2His2 zinc finger proteins. Annu Rev Biochem. 2001;70:313-340. doi: 10.1146/annurev.biochem.70.1.313.
Pavletich et al., Zinc finger-DNA recognition: crystal structure of a Zif268-DNA complex at 2.1 A. Science 252(5007):809-817 (1991).
PCT/US2013/075157 International Search Report and Written Opinion dated Aug. 6, 2014.
PCT/US2018/014568 International Search Report and Written Opinion dated Apr. 9, 2018.
PCT/US2018/065419 International Search Report and Written Opinion dated Nov. 10, 2008.
Perez et al., Factors affecting double-strand break-induced homologous recombination in mammalian cells. BioTechniques 39(1):109-115 (2005).
Pettersson et al., A second B cell-specific enhancer 3' of the immunoglobulin heavy-chain locus. Nature 344:165-168 (1990).
Popova et al., Effect of culture conditions on viability of mouse and rat embryos developed in vitro. Genes 2:332-344 (2004).
Popova et al., Efficiency of transgenic rat production is independent of transgene-construct and overnight embryo culture. Theriogenology 61(7-8):1441-1453 (2004).
Porteus et al. Gene targeting using zinc finger nucleases. Nature Biotechnology 23(8):967-973 (Aug. 8, 2005).
Poueymirou et al., F0 generation mice fully derived from gene-targeted embryonic stem cells allowing immediate phenotypic analyses. Nature Biotechnology 25(1):91-99 (2007).
Pruzina et al., Human monoclonal antibodies to HIV-1 gp140 from mice bearing YAC-based human immunoglobulin transloci. Protein Engineering, Design and Selection 1:791-799 (2011).
Quinlan et al.: The SARS-C0V-2 receptor-binding domain elicits a potent neutralizing response without antibody-dependent enhancement. (reprint 2020) https://doi.org/10.1101/2020.04.10.036418.
Remy et al., Efficient gene targeting by homology-directed repair in rat zygotes using TALE nucleases. Genome Res. 24:1371-1383 (2014).
Ren et al., Silencing of the immunoglobulin heavy chain locus by removal of all eight constant-region genes in a 200-kb region. Genomics 84:686-695 (2004).
Rouet et al., Introduction of Double-Strand Breaks Into the Genome of Mouse Cells by Expression of a Rare-Cutting Endonuclease. Molecular and Cellular Biology, 14.12 (Dec. 1994): 8096-8106.
Saunders, T. L. and Filipiak, W.E., Advances in transgenic rat efficiency. Transgenic Res. 15, abstract 18, p. 494 (2005).
Segal et al., Endonuclease-induced, targeted homologous extrachromosomal recombination in Xenopus oocytes. PNAS USA 92:806-810 (1995).
Seidman et al., A x-immunoglobulin gene is formed by site-specific recombination without further somatic mutation. Nature 280(5721):370-375 (1979).
Sepulveda et al.: Comparative analysis of human and mouse 3' Igh regulatory regions identifies distinctive structural features. Molecular Immunology. 42:605-615 (2005).
Sheppard et al., Allelic forms of rat K chain genes: evidence for strong selection at the level of nucleotide sequence. PNAS USA 78(11):7064-7068 (1981).
Si-Hoe et al, Productions of transgenic rodents by the microinjection of cloned DNA into fertilized one-cell eggs. Molecular Biotechnol. 17:151-182 (2001).
Sire et al., Rat immunoglobulin delta heavy chain gene: nucleotide sequence derived from cloned cDNA. Gene 20(3):377-386 (1982).
Smith et al., A combinatorial approach to create artificial homing endonucleases cleaving chosen sequences. Nucleic Acids Research vol. 34(22):e149 (2006).
Steen et al., The immunoglobulin lambda locus in rat consists of two CA genes and single VA gene. Gene 55:75-84 (1987).
Stoermer et al.: Complement and viral pathogenesis. 2011. Virology. 411, 362-373.
Taylor et al., A transgenic mouse that expresses a diversity of human sequence heavy and light chain immunoglobulins. Nucleic Acids Research 20(23):6287-6295 (1992).
Tong et al., Production of p53 gene knockout rats by homologous recombination in embryonic stem cells. Nature 467(7312):211-213 (2010).
Townsend et al., High-frequency modification of plant genes using engineered zinc-finger nucleases. Nature 459(7245):442-445 (2009).
Tseng et al. Severe Acute Respiratory Syndrome Coronavirus Infection of Mice Transgenic for the Human Angiotensin-Converting Enzyme 2 Virus Receptor. 2007. J. Virol. 81. 1162-1173.
Tufan et al., Analysis of Cell-Free Fetal DNA from Maternal Plasma and Serum Using a Conventional Multiplex PCR: Factors Influencing Success. 2005. Turk. J. Med. Sci. 35:85-92.
U.S. Appl. No. 12/130,818 Office Action dated Jan. 10, 2011.
U.S. Appl. No. 12/130,818 Office Action dated Jul. 29, 2010.
U.S. Appl. No. 12/130,818 Office Action dated May 17, 2011.
U.S. Appl. No. 12/701,464 Office Action dated Dec. 27, 2011.
U.S. Appl. No. 12/701,464 Office Action dated Jun. 29, 2012.
U.S. Appl. No. 12/701,464 Office Action dated Nov. 8, 2013.

(56) References Cited

OTHER PUBLICATIONS

U.S. Appl. No. 13/192,407 Office Action dated Apr. 17, 2013.
U.S. Appl. No. 13/192,407 Office Action dated Aug. 7, 2014.
U.S. Appl. No. 13/192,407 Office Action dated Dec. 1, 2014.
U.S. Appl. No. 13/192,407 Office Action dated Jan. 6, 2014.
U.S. Appl. No. 13/192,407 Office Action dated Jul. 8, 2015.
U.S. Appl. No. 14/517,755 Office Action dated Dec. 7, 2015.
U.S. Appl. No. 14/517,755 Office Action dated Mar. 31, 2016.
U.S. Appl. No. 15/206,063 Office Action dated Sep. 18, 2017.
U.S. Appl. No. 15/332,583 Office Action dated Jan. 26, 2018.
U.S. Appl. No. 15/332,583 Office Action dated Jun. 14, 2018.
U.S. Appl. No. 15/332,583 Office Action dated Oct. 19, 2018.
U.S. Appl. No. 16/127,065 Office Action dated Jun. 23, 2020.
Van Keuren et al., Generating transgenic mice from bacterial artificial chromosomes: transgenesis efficiency, integration and expression outcomes. Transgenic Res. 18(5):769-785 (2009).
Vasquez et al., Manipulating the mammalian genome by homologous recombination. Proc Natl Acad Sci U S A. 98(15):8403-8410 (2001).
Vincent-Fabert et al., Genomic deletion of the whole IgH 3' regulatory region (hs3a, hs1,2, hs3b, and hs4) dramatically affects class switch recombination and Ig secretion to all isotypes. Blood 116:1895-1898 (2010).
Wagner et al., Microinjection of a rabbit f3-globin gene into zygotes and its subsequent expression in adult mice and their offspring. PNAS 78(10):6376-6380 (1981).
Wagner et al., The human f3-globin gene and functional viral thymidine kinase gene in developing mice. PNAS 78(8):5016-5020 (1981).
Wakayama, et al. Full-term development of mice from enucleated oocytes injected with cumulus cell nuclei. Nature, 394 (1998): 369-374.
Watson et al.: The immunoglobulin heavy chain locus: genetic variation, missing data, and implications for human disease. Genes & Immunity. 13:363-373 (2012).
Yanez et al., Therapeutic gene targeting. Gene Therapy, 5.2 (Feb. 1998): 149-159.
Yang et al. Mice Transgenic for Human Angiotensin-converting Enzyme 2 Provide a Model for SARS Coronavirus Infection. 2007. Comparative Med. 57. 450-459.
Yip et al.: Antibody-dependent infection of human macrophages by severe acute respiratory syndrome coronavirus. 2014. Virol. J. 11:82.
Zarrin et al., Antibody class switching mediated by yeast endonuclease-generated DNA breaks. Science 315:377-381 (2007).
Zhang et al., Synthetic zinc finger transcription factor action at an endogenous chromosomal site. Activation of the human erythropoietin gene. J. Biol. Chem 275:33850-33860 (2000).
Zhou et al.: Generation of fertile cloned rats by regulating oocyte activation. Science, 301:1179 (2003).
Zhu et al.: A Novel Coronavirus from Patients with Pneumonia in China, 2019.2020, N Engl J Med 2020;382:727-33.
Zou et al., Block in development at the pre-B-11 to immature B cell stage in mice without lg kappa and Ig lambda light chain. J. Immunol. 170:1354-1361 (2003).
Zou et al., Cre-IoxP-mediated gene replacement: a mouse strain producing humanized antibodies. Current Biology 4:1099-1103 (1994).
Zou et al., Expression of a dromedary heavy chain-only antibody and B cell development in the mouse. J. Immunol. 175:3769-3779 (2005).
Zou et al., Truncation of the p heavy chain alters BCE signaling and allows recruitment of the CD5+ B cells. International Immunology 13(12):1489-1499 (2001).
Office Action for Chinese Patent Application No. 201880011903.6, dated Jun. 22, 2022 (in 6 pages).
Giraldo, P. 2001 "Size Matters: Use of YACs, BACs and PACs in Transgenic Animals" Transgenic Research, vol. 10, No. 2., pp. 83-103.
Sun Jianhua et al., "Research Developments of Transgenic and Trans-chromosomal Animals for Producing Human Antibodies", Current Immunology, 2004, vol. 24, Issue 2.
Norderhaug et al., "Chimeric mouse human IgG3 antibodies with an IgG4-like hinge regioninduce complement-dediated lysis more efficiently than IgG3 with normal hinge", Eur. J. Immunol., 1991, vol. 21, No. 10, pp. 2379-2384.
Office Action for Japanese Patent Application No. 2020-092210, dated Mar. 8, 2022, 4 pages.
Office Action for Korean Patent Application No. 10-2021-7009938, dated Feb. 22, 2022, 9 pages.
Communication Pursuant to Article 94(3)EPC for European Patent Application No. 18707162.6 dated Apr. 20, 2022 in 4 pages.
Office Action for Japanese Application No. 2019-539830, date Jun. 7, 2022 in 4 pages.

* cited by examiner

Predicted BAC9 (CTD-2011A5) sequence
- [Human VH3-74 → VH3-53] is cloned as a ~184 kb HindIII - fragment into pBeloBAC11.
- The entire human sequence flanked by short stretches of vector sequence can be cut out as a single 185 kb NotI- fragment. The NotI sites are in red font and boxed.
- The vector sequence is highlighted in grey.

Primer 1053
Primer 1054    gcatctgctttatcacatgcagacacagc

AAGCTTGTTTGGTGAGAGTGAAACGTGACTGTGGAATTGATTCTTTGTTGTGCAAACCAGAAGAAATTTTGAATTTTGTCAGA
ATCAAAACGGAGTCACTTTTGTTAAAACTTTTGCAAATGGGACTGGGAAAGGCCATAGAAGCAGGGTTCTCATACACTTACAC
TTGGTAACAAGAACTACCACAAATAGAGCCTAAAAAACACAACCTTGCACAAAATCCACCACAACTTTAGGAAAAAGCTACCC
CCACAAGGATATGTCCTCATGTACTGTGAGTCCAACTTTCCACTGTTGCCACCCTTGTTATTAATCTTTGCAGCCCAGGAAAA
TTGTCTCAAAGCAACTTAGCAACTTACTTAGCCCTTCTTATTTTAACTTTAACTGCCTAAGAATTTATACCGTGAAGTAATTG
CTTCATTTAGTGTTAATATTAATGCCCTTTTGACAATCTTTGAAGCTCTTTTTTTCTGATATTTCTTCCAACATAAAGAATGG
GAGCTTTTTCACCATATAAAGAATTTTTAGGAAGATATGATGGAAAGGGAAACTCAATGTATTGTTCAGTGTTTCTGCCTAAC
ACATCAATCTCTTAAAATATTTTT[red/boxed sequence]TAACACTGGAGATAAAAGAAAAAAATGCACA
GACCTTCCACATTCCAAATCATAAAGTGGTACTGGATGTGTTTCTGATGAAGTGAACCATGGGTCATAAGTGCTAGTGCAAGT
AGCTTTGGAAAATGGAGTTCATAGCTTCTTAAAGTTTTGCTAGTTTTAATTTAAGAATGTTATTTACTATTTCTTTTTAGTAC
AAGCTTTCCAGAAGATTCTTGATGGTAATGGAAGTGTCGCATTTAAGAATTACAAATGACTCACAGAGTTACTTTGTAATTTT
TTCTGTAGGGTGTACATGTCAGTCACTTGACATAAAAGCTCATATGTCACAGATAGAAAAATGAAAATTGAGCCAATTTTAAT
AACTGCAGTGGAAATAGTTTTTGGCAATGAGTGCTTCAAGACAACCACAAAATAAATCGGCAAAATATTAAAATACAGCAGGA
ATCTGATCTCAGTTTCTCTGCCTTATAAGAACAAGGCTGTCCCACATCAAAATTATTATTCAAGCTCTAGGAAAAAATACACT
TTTGGATTCTGGAAGCTAAAAGCTCTCTCCTTAGATAGTGCTAAAGTACTTGTGAAATGCAGAGTTGTGTTCATGAAAAACAT
GACTTTATTGTGATTTTTTTTTTTTTTTTTGCCTGTTGACAACTCACCAATCTGTCTCAGATGTAAAGCCCTGCTCTATGGG
TTGAATGTGGTTGCACATGACTGGCAGAGACTGATTATTCATAACTCCAGGTGCCCTGTCTTTGGAGCAGCTACAGGAGTCAG
GCCCAGACTAGAAGAGCCCACACTGACCTTCTGCATCACTTATGCTCTCTCTGGCCACTACATCACAAACAGTGCTTATGACT
GGGCCTGAATCTGCCAGCCCAGGAAAGGGCTGGAATGGATGGGGTGCATTGGTAGTGATGGTGGGGGTCCTACTAGCCTGTGG
CAAATGGAAGCATCTCTTTTTTATCAGACTGAATAATATTGTAGTGTTTCTTATACCACATTTACTTCATCCCTTTGTGCAT
TAACACTTAGGTTGTTTTATATATTGGCTGCCATAAATAGAGCTGCAATTAATATAAGAGCACAGGTGTCTTTACAAGTTCA
TGATTTTATTTCCTTTCCCTGTATTTCCAGAGAAGCGTTTGCTGAGTCATATTGTATTTCCATTTTTGATTTATTTATGAGCT
GCTATACTGTTTTTCATAATGGTGCAACTAAAAAATGGTGTAGTCATCATGAAAAACAGTTTTAGTTTTTGACATAATCCAAA
CACAATGTTTGAATCTGGTTATCTATAGGAGTTTCTAGTAAAATTGGTGAATGTAAATTAAAAAGCAGTAAGAAAAATCTGCA
ATTCAGAAATAGTGTACCCAGATGGTCTTTCTCTCCGAAATGAAAGAGAAATAAACTATTTCTCAGGTGAGATAAACTAAGAT
ATTTTCTTCACACTTGACCAGTCATACAAGAAATATTCAAGGGAATTTTTGTATAAAAGCCAGCATATGAAAACCATCAGCTT
GGAAAAAAACACACAAAACCTATATTTCAATGGTAGAAACAATTAAAAAAGGAGAAAAGAAACAAACATTATTACTACAAAAC
AACATCAAATCATAAAACCAAACAGAAAGAGAATAAACAAAGATAGAGATATATACATATATACAAACAATCATAAAACAATA
AAGAAATAATTTGAGTAAATACTTATAAATAATAACCTTATGTAATAAAATTCCTCAATTAAAAATACAGTATAAAAATTGA
TTTTATTAAAGTCCCAACTCTATGCTGCTTACAAGAGACTCAAATCATCTGAGAATCTACACACAGACTGAAAGTGAGTGGGT
GGAAAAAAGATATGCTACAAAAATAGAAACCAACAGCACAAATAGCTCTACTTATATCAGACACAAATTTTAAGTCAAATGCT
GTAAAGGGAGACCAAAATGGACATTATATAATAAAAAATGATCAATGTAGCAAGAATACGTAACAACTGTAAATATACATATA
TACATATATGTTATATATATGTAACAAGAACACATAATTGTATATATATACATATATACACACACATATATACATATGTAC
CCACACCTGAGAACTCAAATATGTAAAGCAAATCTATTACATAGTAAGGGATAGATACTAACCTTATACAATTATAGTTGGAG
AATTTAACACGTTATTAGCATTGGATATGTTACCTAGCCAAAAATTAACAGACAAACATTGGATTTAAACTGCACTATATTC
CAAATGGACCTGAATTTACAGACCATTGCACCAAACAACTTCAGAACACATATTCTTTTTTTTTTAAAAATTAAATGGATGTG
TTTATTTATCTTTTTTATTATTATACTTTAAGTTTTAGGGTACATGTGCACAATGTGCAGGTTAGTTACATATGTATAC
ATGTGCCATGCTGGTGTGCTGCACCCATCAACTCGTCATTTAGCATTAGGTATATCTCCTAAAGCTATCCCTCCCCTCTCCC
CCACCCCACAACAGTCCCCAGAGTGTGATGTTCCCCTCCTGTGTCCATGTGTTCTCATTGTTCAATTCCCACCTGTGAGTGAG
AATATGTTTGGTTTTTTGTTCTTGCCATAGTTTACTGAGAATGATGATTTCCAGTTTCATCCATGTCCCTACAAAGGACATGA
ACTCATCATTTTTGTGGCTGCATAGTATTCCATGGTGTATATGTGCCACATTTTCTTAATCCAGTCTATCATTGTTGGACAT
GTGAGTTGGTTCCAAGTCTTTGCTATTGTGAATAGTGCCGCAATAAACATACGTGTGCATGTGTCTTTATAGCAGCATGATTT
ATAGTCCTTTGGGTATATACCCAGTAATGGGATGGCTGGGTCAAATGGTATTTCCAGTTCTAGATCCCTGAGGAATGGCCACA
CTGACTTCCACAATGGTTGAACTAGTTTACAGTCCCACCAACAGTGTCAAAGTGTTCCTATTTCTCCACATCCTCTCCAGCAC
CTGTTGTTTCCTGACTTTTTAATGATTGCCATTCTAACTGGTGTGAGATGGTATCTCATTGTGGTTTTGATTCGCATTTCTCT
GGTGGCCAGTGATGGTGAGCATTTTTTCATGCAGAACACATATTCTTTTCTTCAGCGCATGTGATACTCTTCAGAGTTGATCA
TATATTAATACAGAAAATGTATCAAAAAATTTAAATAAAATTATACCGACGTTTTATCTGACTAAGATAGAGTCAAAGATGGA
ATCAAACTAAACATCAGTAACTGGAGGAACTTCTTTTTTTTTTTTTGAGATAGACTCTTTCTCTGTATCCCAGGCTGGAGT
GCAGTGACAGAATCTCGGCTCACTACAACCTCCACCTTCCGAGTTCAAACCATTCTCCTGCCTCAGCCTCCTGATAAGCTGAA
ATTACAGGCACCTGCCACCACTCCTGGCTAATTTTGGTATGTTTAGTAGAGAGGGGGTTTCACCATGTTGGCCAGGCTGGTCT
TGAAATCCTGACCTAAAGTCATCCACCAGCCTCGGCCTCCAAAGTGCCGGGACTACAGGCATGAGCCACCACCCAGCCTGGAG
AAAATTTCAAAAAAATATAAACACAAAATTAAACAAATCACTCTTACATGGCCAATGGGTGAAAGAAGACATTAAGAAGAAA
ATAAAAAATGTATGAAACAAACAAAGAAACACAACATACCCAAATCTTATGGCGTTTAGTCAAATCACTATTATGAGGCAAGTT

FIG. 6

```
TAGAGCAATAAATGCCCACATCAAAAAGTAGAAATATCTTAATTAATCAAAATAACAATGCATGTTAGAGAACTTGAAGAACA
AGAAAAAGCTAAATTCAAAATTATTTTTAAAAACAATAAAGAGCAGATTAGATATAAATGGAATTAAGACTAAAAATACCAGA
AAATATTAAAATAGCAATAGTCTTTTTAAAAAAGATAAGCAAAATTGAAAGCCATTAGCTGGGCTAACAAAAAAAATATAAAG
AGCTAAGACATGAATAAATGAGGTAGAAACAGAAGATGTCTCAACTGATATCCCAGAATTAAAATAAATTAGGAAATACTATA
ATAAATTATGTGATAAATGTGAAAACCTAGAGGAATTGGATACATTCCPGGCCATATACTACCTAACAAGATTGAAAAAGGAA
AAAATAGAAAGCCTTAACAGACCAATAAAAAGTAATGAGAGGGACTCACTTAAAAAATCTATATCCTATTGAACATAAATAAA
AAAACCCAAATTACTAGCACAGCAAATCAAACAGCATTTAAATACTAATACTAATACTAATACAGCATGACAAAGTAGAATTC
AACCCAGGGATTCAATTATGCTTTAATATACACAAGTGAATAAACATGATATATCACGTATATACGACAAGGATGAAAACAT
ATTTTTACTTTAATAGATGCAGAATAAGTACTTTATAAAACTCAAAACCTCTTCATGAAAAAAACTCTCAATTATGTGTAGAA
AGAACAACACAATAAGACCACATGACAAGTTCATAGCTAACATCATACTTAACAGAAAAAAAGTTTAATGCTTTTCTTCTGAA
AACTGGAAAAGACAAGGAAGCCAACTCTCAGCACTTATTCAACACAGTACTGAAGGTACTAGCCAGAGCAGTTAGACAAGAGA
AAGAAATAAAGGGGATTACAATTAGAAAAAAGGTAGCCAAATTACCTCTAATTTCAGATGACATAATCATATATATACTAAAG
ACTCTTGTAAATGCTCTTAGAGCTGATGAATTTAGTAAAGTTTCAAGATACAATATCAACATAGAAATCTCAGTGGGGTTTCT
ATACACAAACAATAAACTAGGTAAAAAAAATCAAGAAATCCCATTTTCAATAACTACAAAAACTATTAAACACCTAGGAATAC
ATTTCACCAAGGAGGTGAAAATCCGTAAATGAACAAACTATGAAACACTGATATAATTAATTGAATGAGACAAACACAAAATA
AGAAGGACAATCTGTATTCATGAACTGGAATAATTTATATTGTTAGAATGACCATAATGCACATGACAATCTACATATTCAAT
GTCATCTCTATGAAAATACCAATGGCATTATTCACAGAAATATTAAAAAGCATTATTAAAATTTGTATACAATTGAAAATACC
CCAAATGACTAATGCAGTCTTGTGGATAAAAAACAGAGGTGGAGGTATTAACAACCAGATTTCAAAAAAAATTATAAAACTGT
AATAACAAAAACAGCGTAGTGCTGGCATAAAAATCCATGGAAAAAAGTAGAGAAACCAAGACATTAATCCATATATTTATAGA
TAACTTATTTGCAACAGAGGCACCAAAAATATTTATTGTGAAAAGAAAAGTATCCTCAGTAAATTGTGTAGGGAAAAACTGAA
TATCCATATGCAGATGAATGAACTTACATTCCCACATTTAACTGTATATAAAAATGAAATAAAAATAAGTTAAATACTCAAAT
GGAAGACCCAAAACTATAAAGCTGCTCTTAAAAACTTAGAAATAATGCTTCATGAAATCTGTCTGGAAAACAATTTTATAAAT
AAGACCTCAAAAGTACAGTCAACTAAATAAAACACAAACGAATTAAATTTTATCAAACTAAACAGTGTTTACACAGTAAAATA
ATCCAAATATTGAATAGATAACATAAAAGTGGTAAAATGTATTTTAAACTATTAATTAAACAGGCTATTAATATCCAGAATAT
ACCAGAAAAATAAATGTCTCAACCACAAAAATATAAATAATCTTATTTTATAACAGACAATTAACCCAAATAAGCAGACGTTT
CTCAAAGAAACACATACAAGATGCCAGAAAATATTTGCAGAAAAAATTGGFCACCATCGGTAATAATCAGGAAAGCACAAATTTA
AAGTACAATGAAATATTATCTCACCCCAGACAGAATAGCCATAFTCAAATACATAAAAATAGTGCTAATGTGGATGAAGATAA
AATGGGACATGTATACACTGTTGATGAGAATGTACACTCATACAGCCACTATGGAGAGACGTATAGAAGTTAGTAAAACCACA
AATGCAACAATCATATGATACAGAAATTTTACGACTGAACATTTGTCCCAAGGACAGGAAATTAATATATTGAAGAGGAAAT
CAATATTTTGATGAGATTTCTTCACTCCCATGTTTATTGCAGCCCTGTPCACAGTAGCCAAGTAATTGAATCAACCGAAGTGT
TCAATATAAGGTGAGTAGAGAAAGATGATGTGGAATATGTACATAATGGAATTCTACACAGCCATGAAAGATTAAATTGTGTC
ACTCATAGAAACTTGCATGTAACATATAAGACTCTATGTTAATTGAAAGAGCCAGGAACAGAAAGCTAAACACCACATGTTTT
CACTCCCATAAAATAGTCAAGAAATATCCATAAAACATAAATAATTGAAATTGGACATGAACTATAGAAACAATAATTGTCAC
CTGAATATTTATTTTCCTTCAAATAATATATAATTCAATGATAGTAAGAAGAGTCCTGATAAATAAATCATGTTGAGATAAAG
AGCTACTGAATTGTGCATTCCACACTAAATGGAAACAATGCCATAAGAFCCAGTGTTGTGTAGGATCTGTTTACCTTTTTACC
TCAAATACTACAAGTCACTCCCTTGTTCTAATCACCCCGCAAAACTGATATTTTGTTGCTTTATGTTATGTCAGTAAAAATGA
TTCCACATTGGAAGCTTCATGTGTTGCTCAGAAATCACCCTGTTGATAAAATGAGCACAACTACAGTTACAACCTTTCTGTAG
ATATTTTCTGCATATGATCCTCACTTTTTATTTGTTGTTTTTGTTCACAGTTTCTTTAAGCACTCAGAGTTATATAGCATATT
TTCAGCATATTTTAATTATTTTCCATTGTTATGGTCAGTGCTCCTGTGGGCTCAAGAGTCAGGTGTTGTGTGACTGCCAGTTG
ACTTCACTGCCACCTTTACCTACACAAAACACTGCAAGATGAACCATGATGTGTAAGAACCCATCCACAAAGTGCTTCAAATA
AAGACAAGGTGACTTGTGTATAGATTTAGTGAGACTGGGGAACAGTTCACGGTGTTATGTTACAGAGGAGCAGAAAGGTGAAT
CTCTCTCGGAGTTATTGAGGGTGTAAGAGCTGCAGTTTTGGAGGGTGGTGAAAGGCACTTTTGAGTGGGAAGCCCTAGAGCAT
GTGTGAAAGCTGAAGGAATGATCACCATGCACATGGACGCTGATGAGGCATGTGGTAAGGTCCATTCCCTCCAGATGTTCCTG
GATGGGCGGTTGTAGGATGGCTCATGTATATGAAAATGTGGGCAGGGCTGAAATAGGAACAAGGCCATCATCCCACGGGAATG
CGAGAAAGCAAAACAGAGATGGACACCCATGAAGAGAGCTCATTAGACCTGGTGAAGGAAAGATAGGAATCTCTTCCAAAGGC
TCCGCTGTTCTTGGCTAAATATGAATTGTGGTGATAGACTGAAAATAAGGAGGGGAAGGGAGATATGACTCAAGAGAGGAAAA
ACCCTAAGACAGCATAAACCAAATCTACACAGAACAATCACATGGTAGATGCCAGGGTGGGGCTGAAACAGGAGCTTCAATCT
ACTGGGTACCTAGTTGAGATCCTTTGACATTTCTTGTGAGGTAATTCTAGTGATGATGAATTTCCTCAGTTTTCCTTTGTCTG
GGAAGTATTTCTCTATCCTTCATTTCATAAGAGATGTTTTATCAATTTTAGGTTCTTGGTTGGCTGCTTTTCCCCCCAGAAA
TTTAAATCCAGTTATTTGCTGCATAACAAAGTTTCTGCCAGTAACAGATGGTGGTTCCACGGTGCTATACTTCCTTACTTATC
TATATCTCTTTATGTTTAGATACACAAATAATTACTACTATGTTTCCATGGCCAACAGTATTCACTACGGTTGTTTCTGAGTC
ACTGGGGTGTTGCTTTTCTGGCCAGAACCCTCTGTGGCCAGTGGCACTTTTGCCTGAGTTCTTGTCCTACATGTGGAAAGAA
TGAAGTATGCAGCCATGTGGAGGGTAAGCAAGACAAAGCCTAGCTTCATTAAGCATTAGAGCATCTCAGAGGAGACCCCCAGT
GAGTAGCTCCTCTCTGTAGGCAGGTAGACTGGTTGAGTGTTCAGCTCTAAGCAGAGAGGGTAGCTCCTCCCTGCAGCCGGTCG
TCCTGTGGTCTTCCCAGTTCTCAGGAGAGAGGGTAGCTCCTCCCTGCAGCTGGTCGTCCTGTCGTCTCTCCATCCTCTGTCCTGCTCCAGCTGAGGCCAGGGGTTTTAC
GGACCTCCGAGGGGAGGAAGTGCAAGCCCATTGGTCCATGGGTGCTCATGGGTGGGCCGTAGGAAGCACCACAAGTCCCGACT
CTGGTCTGAGGATCTGGGAGCCCCGGCCCAGCCTTCAGGCCCTTCCTGGGGACCCGCCCCTGTGCACAGGATCTTCCTGCCTC
CTGTTGTAGTTCATGGTCCCTGGGGCTCCGCCCTGACTTTGCTCCAAGATCAGAGCAGGCACCAGCAGCAGGAAGAAGCCAGG
AAGTGGGAGCGAGGCACTTCGGAGCATGCAAGAGCACAGGGCTTTTCCTGGGGACCCCAAGAGTGCAGGGGCGCCTGAGGCCGC
AGCCCCGGTTTGCGGAGCAGGGCTTCTGCCGGCTTCATGGAGCGAGAGGCCCGTGTCTTCAGCCGCAGTTTGGGAGGCTGCA
GCCACAGCCGGGGAGGCAGGGCTCCTTCCTGTTCCTCGACCTCCAAGAGCACAGAGTCCGAGCCCACTGCCCTGGTTTGCGCA
GCTGGAGCCGCACCTGAGAGATGAGAGCTGCTGCCTGCTCCTGGCTCCCACCGGCTCCGTGGAGCATCAGCCCCTCCACCCCT
CCTTGCAGCCTGGGCAGGGGCTCCTGATCCTCTCTGGGCCCTGGCCGGCGTCCAGGGCAGGAGTGACATCTCCACAAGCTCCC
TGCATTGCCCCGGTGCTCAGGGAGGCCCGGGCAGAGCTGAFGACGACCCCGGCCCGTAGTCGGGAGTGGCGGCCTCCATGGTC
ACCCTGACATGCGGCTGAACCCTGGGACGCGGCCCAAGCAGCCTGCACAGAACCTCCCAAGGCCCAGGAACCCGCACCCTA
```

FIG. 6 (Cont. 1)

```
GGCGGGGTGGGCACAGCGGCTGCTCCGCTGCCCGGGTTTTCAAGGAGGCGCCACTTCCACTTCCCTCCCTGGAACCCCGAAGT
TTGACATGGGGGCTCCTTTCTGCCTTGCTCCGCAGCTCCCCTTCCCCGGAGTGGAGCCCCTGTTTCCCTGGCGTTCCCTCC
CACAGCTGCAGTGTTCTCCAGTCGGTGTCATCACCTTCCAGCTCTGCTGCCCTGCTCTGCAGACTAAGGCTCTGATTCCATAAG
AGAGGGGAGCTGCTTCCCAGTAGAACCTTGCTGGGGAGCTCTGTTCCCATCTCAGTTCCTGAGGGGTTAAACCAGTGCATTTA
GGATACTGGTTTTGGTGGTTTGCCCCTGTTGAGTAATTTCTTAGTTCTCTAGTGGGTGTAAGAGACTTGGCTCTGGAAGCATT
TCAGAAGTGTGGGCTCTGATACACCCAGACAGACACTTTGGGAAGGGAAGATTTTTGTGACTATTCTCATTATAAGGGAAAG
GCATTCAAAAGAATAGAAAAACTCTCCAGTATGTGGTTCCTGAGAATTTCTCACTAAAAACATGCTTATCACACTCGACTCAA
AACAGTTCAATGTATATTAGTGTATTTTATCTTGTACTAGCCTTTATTGCATTTGGTGAACTCTGCCCCAGTTCAGCTCATAC
TCTAGCTTTGATTCTCCCTACAAAAACTTGTCTCTCTAGATTTCAGATTTGTTGATTGTCTTAAAATTTCAATGATCTGAA
GTATTAAAGAAAATTTGCAAAAGTCCATTTTCTCTGATTAACAGTTATTGTTGATTTTATTCTTGTTGTAAAAAAAAGAAATT
CTCATCTATGTACATTTCAAACCTGAATAACAAAATTTTTATTAACACCAAAAATAATAAAAGAATCCAAATATTTATCAGCT
GCCTAATAGAAAACAAATCATGGTAACATTGTTCGCTGGAATATTACCCATCATTCATAATAAGGGAATGTCTGATACACAA
AATAAGAAGATAAAATTATCAAGTATTTAAATTGAGTAAAATAAGCCAAACAAATAAGAGTATGTATGATTCTATTTTTAAAA
ATTCTGGAAAATGAAAACTGATCTAAAGTAATATAAAGAAGATTAGTAGTTTCCTGGGAATATGTTGGCAGAAGGGAAGGAGA
AAGGATAAGGAAATAGAAAATAGGAAGTAGAAGGACAGAAAAGGTTGAGGGAATTTCACTTGTCCACCTTCCTTATAATGGT
AATAGTTATGCCATGATTATCAGTTTTACACTTTAAATATGTAAAGTTTATAATCTGTCAATCAAATCTTATAAAATGTATTA
TGAGGAAACAAGTTGAAAATTAGACAATGTAGGAGTGACAGAAAGATAGATATGAGTATGTTGAATGTCAGAGATACCTGAAA
GTTTATCTACCTGAACCCTAGTTCTCTCCATAGTTTAAGGTAAACAGGAGAGTGCAGGAAAATCATCCATATTCTGATTAGGC
AGTGGCTTCTGCAAACCACACTAGGCCTGGCCGGCTGTGTCCTGGAGTTGGCTAAGGGAGGAGTCAGGGCCAGTGGTGAGAAG
TGCAGGCCCAGATACCAGAACTCACTCATCCCAGACATGAGCTCTTAGATACACAGAGAGCCCATCCATGTGTGGATTTATCT
TACATCTGTAAGTAGAGAACATTGACTCTTACAGAACATAATTTACACACATAGGTAAATCTGAAATAAGGTGATCAGTGTGA
AGATTTTATCACAGCACAGTTTCATAATAAGCACAATTTCTCAAATCCCATTGTTGTCACCCATCTTCCTCAGGACACTTTCA
TCTGCCCTGGGTCCTGCTCTTTCTTCAGGTGTCTCACCCCAGAGCTTGATATATAGTAGGAGACATGCAAATAGGGCCCTCAC
TCTGCTGAAGAAAACCAGCCCTGCAGCTCTGGGAGAGGAGCCCCAGCCCTGGGATTCCCAGCTGTTTCTGCTTGCTGATCAGG
ACTGCACACAGAGAACTCACCATGGAGTTTGGGCTGAGCTGGGTTTTCCTTGTTGCTATTTTAAAAGGTGATTCATGGAGAAC
TGCAGATATGCAGTGTGAATGGACATGAGTCAGATAAGCAGTGGATGTGTGTGGCAGTTTCTGACCAGGGTGTCTCTGTGTTT
GCAGGTGTCCAGTGTGAGGTGCAGCTGGTGGAGTCCGGGGGAGGCTTAGTTCAGCCTGGGGGGTCCCTGAGACTCTCCTGTGC
AGCCTCTGGATTCACCTTCAGTAGCTACTGGATGCACTGGGTCCGCCAAGCTCCAGGGAAGGGGCTGGTGTGGGTCTCACGTA
TTAATAGTGATGGGAGTAGCACAAGCTACGCGGACTCCGTGAAGGGCCGATTCACCATCTCCAGAGACAACGCCAAGAACACG
CTGTATCTGCAAATGAACAGTCTGAGAGCCGAGGACACGGCTGTGTATTACTGTGCAAGAGACACAGTGAGGGGAAGTCAATG
TGAGCCCAGACACAAACCTCGCTGCAGGGGCATCTGAGACCACGAGGGGGTGTCCTGGGCCCTGTGAACTGGGCTGCTCTCCG
TGGCAGCGGCTGGTGGTGCTAAAGGCTGATTTTCTCTCAGCATCTGGGGCTGATTCATCAAGTTTCCTCAGAGACCTTTCAGA
TTACAATTCTGTACTTACGTTTAATGTCTCTGAATGTGACACTTTCCTTCCCTGGTGTGTCTTTGTTTTTGTGACAAGAGGAC
ACATTCTCACCTCCACAGAAGCCCGAGTGTCACTTTGGGGACAGAAATGACCCTGCCCTGGTCACCAGAATCAGAGTCCCGAG
GAAGCCCAGGAGGACCTGGGAAGTGTTTTTCAATCAGACTCAGGGCAGGCGTCTCCGTGGGAATCTCTGATTGGAACAGGCTT
TGGGATTCAGATTGGGACCAAGAGGGAGGCTCACCCAGGGCCAGGGTCCTTAGAATCCTGACAGTTTTCACAGTAACCCCATC
GTCCTTTAAAACTGAACATCTAACTCAGAACTGACCCATTTGGTCCTTTCTCTGTAATCCATTTTCCTTTTCTCTAGGCTTCA
TTCTTACACTTCCCTTTTCACCTTCATTCTGAAAATGCAGGGTGTCTTCCTGTGGTCTAAACCACTGCAGATGCATTA
CCTGGAACTCAGGTGTGGCTCTGGCTATGGCTCCTGTGGACCTGGCAGGCTGAGGGATCTTTCTCATTCCCTGGTGCCTGCAT
GCCCCTGCTGTCTTCTATGCGTGGATGCATTTGGGAAATGCAAGTGGACACTCATAGTCGTTTCCTCAAATGGGATACTGTTG
TAGAGCTGATCTTGTGCTTCTCACCCTGTCACAGAGCCCCCACTCTCACTTGTGGATTTTTGGGAGAGCTGAGGATGGACACT
TTATTGGGCTGTGAGCTCTGCATGATGGCAATCGTGAGGTCTGGGTGGGCACAGCCAGAGCCAATGGAGCTGGCCAAAAGGAA
AGACAGGACGGAATTCCTGGGAAGTCCTACAGCTGCTGTCTACCATAGAGTTCCATTGTCTTCTCCTCTGCTAGGATTAAACC
AGACCGACCAAGTTCATCTAGGACAATCTTCCTGACCTAGAGAAGTGATGACAGGCTTTAATAACACCTGTATTATACATCAG
AGCAACACCTAGATTAGTGTTTGATTGAATAATTGAGACTATGTCCTAGTCAAGGTGACACACAAAATCAATTATTACCATGA
TTAATATTTTATATTGATTAATATTTTAATACTAATATTAATCAATGCAATATTGATTTAATATTAATTAATATTTTATATTT
GACAATAGAATCAGACTCATGTTATAAATAATTTTGCAAATATATGTATATTATTATTGGTCTTCTGAGCATAAATCTCCATT
AGCCGATTAAGTGTGCATGCATTGGTCGAAGGAGGGCATCCACCCTTTGAGGGAAAATGCATGGAGGGTAAATGAGGCTGGG
AAGCTGATGGCATATGATGGAAGCCTGTCCCTGAGTGAAGGAGAGGAGGCAGGATTGGGTGGAACTTTCCTACATTTCTG
TGCTGTGCAAAGAAACTCCAGATTATCACTGAGTCTCCTGCAAGTCAAAGTTGCCCCTCAGGAAACCCCCATCACTCCCAGCA
ATGACTCTGCCCCAGATGAGTGCAAGGCTCACTCTATTCCTGAGAAAGGAGCACAGGATATGGGATTTAGCATGAGCCACGTC
ATGGACGTCAGAGAGCAGGAGCTGGGTGCATGATCCAAGTGCACTGTTCTGCCTGTAGGTGGAGAGAGGAAGGTGCATTCCCA
GAGCTAACACACTGTGGATTTTTATACAGAATACACGTTTTCACCTGATTATTGGAAGGCATATGAAAAAATGTGCAGTCCA
CAAACAATTGTAAATTCCAAATTTACCACAATTGCATTATTTCTTCATTCTGCATGATGTCCTGGAACAGAGTTACATTTTTC
ATGGGTATTGTTTCATGGATTGAGGACATGAATTTCACACCTGCCTTTTAGCCATGTGCAGAGACCTTGAGTAGAGCATGTC
TGGACCTCATCTACACTATCTCTCATGCCCCAAGGGAAAGAGTGGAGACTTGACTGACTGCAAACTTTGGGGTGGGAGCTGCT
CCTGCACACCTCAGAGGCTGCAGAGACCCCAAGTGCAGTTTTATTGAGTTGGGGTGTCTTTCTATGTGGGGAATTATGGGCT
GCCCCACTCCTGGTGATTGCTGGTCAGCTCTAAAGACGGGTTCAGAATGAGGTCACCTGGTAACCTTTCTCACTGCAGCTCCA
TTATGTAAATTACCACTACCAGATTCCAGGTAATAATGCAAGCTCTATTTTGCGACCTCATTTTCTTATCTTTTTTGTTCAT
AAGTTTGGTTATAGAAAATGTTACCACCTAGTTTCCTGATTCAAATCCTATAATTTGCTGAACTACTCAGGATGTTTTTAAT
GTGCCCAGTATTTGGAAATATAAATGAACAGCCATGTGTGGTTCACTGAGTGGACATAGTTAAGTACATTAGTAAAAA
CATGATTGCTGAATTGTATAGTGAAACTACAATTAGATTTGCAGAAATTGCCTCCAGTAATGTCTGAAGGGAGAGCCACCCA
GCCAATCCCGTCTCTGGGCTTGGAGGAAGCTCACTACACAGGCCAGGTCACATGGGTGATATCCAAGGTGCAGCTCCCAGCGT
TACTGTGCTATTTTCCAGGAACCAGACATACAACTTGGCATCTCAGAAGAAGATCTCCAAGATTTCCTTTACCTGGACTTCAT
GGGCAGCACAGGACCAGCAGGAGATGCTCAGAACTCACCCAAGGCAGAACCCCAGGGAAGAGCAGGTGCGGAGAGGAACCAGC
CAGGGAACCCTCTGACCACCATCTAGGGTTGCCTTCTTTTCCTTCACAGCATGGAGCCCTCAGGAGACCACCCACTAGGTTGTC
```

FIG. 6 (Cont. 2)

```
TGTAACTCACGTCCTTCTTGTCTTGAAGCAAAACAGACATAAATATGAATTTGCAGTTAGCCCCTTGAACCTGGGTCAATTTT
TTCTGAGAATGCCAACTTAATCGTCAACATCATGGGCATTATATCAAATCGAGATGGATATTTAGTCACCAGGAAGACAGTT
TGTCTCATGGTAGAAGTGCTTATTCAATTAAAAATTACATTTTAATGAAAAGGTCTCTAAGTGAGGACTGTTCAAATAATAAA
GTATTAGTGAAGTATCAGAAAAATAAATGGCACCATTATCTTGTGTATCCAGTTAATCTATAAAGCATATCAATATTCATGTT
GTAAGTGGCCTAGGACAAGTTATGGCAGTATTTAGGCTATAAGGAGACATTGCTTTCCTTCTTAGATAGGAATGTCCTTTTTT
ATCATACTTTAAGTTCTGGGGTACATGTGCAGAATGTGCATGTTTGTTACATAGGTATACAAGTGCCATGGTGGTTTGCTGCA
CTCATCAACCCGTCATCGACATTAGGTATTACTCCTAATGCTATCCCTCCCCTAGCCCCCACCCCCAACAGGCCCCAGTGT
GTGATGTTCCCCTCCCTGTGTCCATGTGTTCTCATTCTTCAACTCCCACTTATGAGTGAGAACATGCAGTGTTTGGTTTTCTG
TTCCTGTGTTAGTTTGCTGAGAATGATGGTTTCCAGCTTCATCAATGTCCCTGCAAAGGACATGAACAGGAAATTCCTTCTAA
ATGAACTGTGTTTTGACAAATATTATCCAGTGACTCTTCCTACATGGGGTTTCTACATGATCTATTTTTCTTTTCCAAAAACA
AATCACTCAAGTTTCTCATCTCCTGAGTGAGAAAATTTTCCCCAAACACAATCTCAGTCTAGGTAGACACCTTCATGAATGA
GCCTTCATTCTCAGACAGGCACACACTGTCCCCATGTGGATGCTTCTCTCAGACAGGCACACATATCCCCACATGGTTGGGAT
CATCTGCTGGGACTTTGCCCCATGGGATCTCTATTATCACTGGGGCAAGTTAGCACCTCGATCCTCATCCACACTGTGGCCT
TTGATGTCTGTGACCTGCCACACCCTGTCTGTCCCTCAGTGTCTAGAATGGTGAAGTAGTCCACCCCAGGGATGGAGGAACAT
CCCAGATTTTCCTGTGAAGGAGACAGAATGCCAATCACAGAGCATTCTCTCACATCCCTCCTGGGTCATATTCTGGGCA
GGGTCTCTGAAGTCACCCCTGGATCAGTGTCCTAAGATGTCTCCCTCTATTTCCTTGGGAAGAACCCATAGAAAGACAAATAA
GTTTTTCTATTAGGGCATCGTAGAACTTGTGCTTTCTTGTGTGACAAATATAGGTATTTTGACTATTTTAAAAATTAGATATA
ATATTAAGTCTACCAAATATGTAAATATATAAGCTTTATAATGTATCCCTAGAGGGATGTCTCCTGGAATTGAGAATTGAATA
TATATATATATATATATATATATATTCCAAGATAAATCTTGGTGAACATTATAAAATTGACTCTAATATTTATGTTCAAGA
TGATCATTTCAAAAAAGTTTTAACAACAGAGACCAGATGTATCTTTCCACCAGAAATAACTGTAAAACACAGTGAAATTTTTT
AAACATGATTTTAAGGTATTTTACATCAAATAACAAGGACAGTGATTGCTGAGGTGGGGAAAATATACAAAAGGAGCCCTCTG
ATGAACGCATGCTTTGCTACTTTTTAAAGAGAGTTTCCAGGCCACAGTGCTGAAGAGGAACCAGGTAGATTTGAAGTTGAGGA
AAAGGAGCTGAGATCCCAGACAGGCCAAGAAGTGTGGAGATCACAGACTAGACAGTGGATAGCAGAACACTGTTCAGAGAGTG
AGCCCCGTAGATGGCCGGAGAGAGACCCAGCCTTGGTAGAGTGTGGATCAGTGTATGGGAACCCTGGAAAGTTGTACATGAGA
ACACACCTTACTCTAGGGGGCTTGCCTTAAAATCTAAAATTACCCTAAAATTTAAACATAATCAGTTACAAATTTTAAAACAT
AAAGAAAGACACCATGTTAAAGAAAGATAAAGGAAAGGTGGATTTGCAATATTAAAATATAAAAAGTGTATTTCTGAACAAAT
GATAATACTGATGAGGGGGGACAAGTTTATTCCATCACGGCAAATGATTTAAGAGAAGAACATTCCAAATGCTTATGGCCCTA
ATGAGGAAGCTTCAATCACGAATATAAATAGAGTTATCTCATTACCAGTGTGATGGTGTGAGAAACTTCAAGATTTCCAAAGA
GACAACCTAATCTGGTAAAAATTATAGAAACCCAACCTGTACTATCAAGGAAAATTATTCTGAGAACACACAGTAAATGAAAT
CCATTGACTGACATAAAGTCCTCCTGTTGACTGAAGGGTTATGACCCCCCACAAGGCATATGTTGGAATCTCAACTCCATCGT
GACGGTGGCAGGAGGTGGGGCCTTTGGTCTCCTTTGAAAGGTGTTGAGGCTCCGTTTCATGAATGGAATCAGCGTCCTGATAC
AATACCCCAGAGAGCTCCCTCTTTCCTTCCACCAGGTGTGGTCACAGTAGGAAGGTGGCAATCTATAAATAAAGAATTGGGAC
ATCACCAGATACCAATCTTTAAGTCATCTTTATCTTGAACTTCCCAGCCTTGAAAATTGGGACAAATGCATTTATGTTATTTC
TGAGCCACCCAGTCCATGATATCCTCTTATAGCAACTCAAACAGTCTTAGCAAGTGCAGTGAGGATCACAATACTTGAGAGAA
GAGCATTACCTCTTCTTTACATCTCAGGATCACAGAATCTTGACCTTGGGCTGAACTGACAAGAAGGTGGTGCTTCCCTCTCC
CCCAGATCTCAGTTGAGGTCATGATGTCAGATCTTTATGGTGGAGACTAAATTCCTGCCTGTGATTTGATGGATGCCTTTCTC
CTCCCAGCCTCACTCACAAGACATAGTTTCCATGTCAGGTGTTATAGACCAAGAACAGGTGGACCCCGATTATTCTCACCCCA
GCTCACTTGTAGGGCAGAGGTTCTGGGAGCTTCCTGGGAGAGGAACAGTGAGATCATACAAGTCCATCACTTCCATGCAGTTT
TCTGTACTTAAAGCAGGAGTGTCCTTCTGAGCTGCTTGAACCCTTTCTTCTGCACCAAGGTAGAGACTTCCATGTTTTTCTAG
TGATACAGTCAGGGCATAAAAACAGTGATAGAAAGCTCTCTCTAAAGGGCGTGACCAGATTTGCAGTAGAATGAGAATAGTTT
CAACCCTAAAGTTCATCTAAAATGTTAGTGGTTTTCATGGTAAGTAATTAATAGAAACCTGACAGCTCCATGACAGCAATATA
GAAATCAATAGTCCACTCATTTTAACAGAGAGAATTAGAAAACCTATAATTTAAGAATAACCAGCTGGGCACTGTGGCTCTGC
CTGCAGTTGAATTTACTTGGGAGTTTGAGGTGAGAGGATCACTTGAGCCCAGGATTTCAAGCGCAGCCTGGAAACATAGCTAG
ACTTAATTTCTTGAAAAAAATCAGTGCTATTTTGGGGTCAGAACAATCCTCAAAAATGGTCCCCGGAAAGAAGCCCAAATTTA
ATTGCACCAGATTGTTGAACGATTTATGCTACAAAACAGTGTCACATGTCAGAAATGAGCACAGTGTAACATCTACATGGTTT
GTTAAGAGACACAAATGGTCAAGTAGAACAATCAGGTAATTAGGCTGTCGAAGGCAACACTGCCAAATGACAGCATTTCCGTG
GAAACTGCGTGTACATCCAGGACTGCACCTGTGAACGATGACATCATACCCTTCACAGTGTCGAGGAAAGAGACATCACTCAA
ACAGACAAGCCAAGGGACTTCAGAAAATATAAGGGGAAATACAGTGTGCAAATATGTAAAAAATGCAATAAGATGATTACTCC
TAAATGAATATCAAGACACAATCACATAATATGAAATTAAATTTTCCTGAATGATAGGATTACTACCAATCACCCCCCAGGAC
ACCCTCATCTACTCTGTGCACAGCCTTCTCGTCAGGCGTCCCAGCCCAGACCTTGCTATGTAGCAGAAGACATGCAAATAAGA
CCCCCCTTTTTGCTGATGAAAAGCAGCCCAGCCCTGACCCTGCAGCCTCTGGGAGAGGAGCTCCAGCCTTGGGATTCCCAGCTG
TCTCCACTCGGTGATCGGCACTGAATACAGGAGACTCACCATGGAGTTTGGGCTGAGCTGGGTTTTCCTTGTTGCTATTTTAA
AAGGTGATTCATGGGGAACTAGAGATACTGAGTGTGAGTGGACATGAGTGAGAGAAACAGTGGACGTGTGTGGCACTTTCTGA
CCAGGGTGTCTCTGTGTTTGCAGGTGTCCAGTGTGAGGTGCAGCTGGTGGAGTCCGGGGGAGGCTTGGTCCAGCCTGGGGGGT
CCCTGAAACTCTCCTGTGCAGCCTCTGGGTTCACCTTCAGTGGCTCTGCTATGCACTGGGTCCGCCAGGCTTCCGGGAAAGGG
CTGGAGTGGGTTGGCCGTATTAGAAGCAAAGCTAACAGTTACGCGACAGCATATGCTGCGTCGGTGAAAGGCAGGTTCACCAT
CTCCAGAGATGATTCAAAGAACACGGCGTATCTGCAAATGAACAGCCTGAAAACCGAGGACACGGCCGTGTATTACTGTACTA
GACACACAGTGAGGGGAGGTCAGTGTGAGCCCGGACACAAACCTCCCTGCAGGGGCGCGGGGCTACCAGGGGGCGCTCGGG
ACTCACTGAGGGCGGGACAGGTCCCAGGAACAGGTGCAGCGGTAGGTTTCTTTCTCCTCAGCTGGAGAAGTCAGGTTTGTGT
TTTCAGAACTCTGGAGTCTTACAGGTTGCTACATTTTCATACAGTTATTAGTATGTATTTATTATCATTGGTATTTAAGTTTT
AATAATTTTAAACCTTTTATGTAGTGTTATTTTTAAAACTGTTTACTTTCATTTGCAGTTATTCTTCCAGAGTTTCATTAAC
ATCTATTGCTATGAGCAACTACATAGCTATGAGAGCATAAATTTACACCTGTAGACGTAGGTCTAAATGCCACAAACCTGTGC
ATAAATGTATAGTGACTTATATTTAACATTATAATAAGATAATTTTTAAAATATATCCTAAACGATCAAACTTACTGATGAAC
TAAATATAAATTATCAGAGTAATGCATAATTGATTTCAATAATTTTATATTGTTTATATTAATTAATATCTATTTCTTTACTG
AAACATAATATATTGGTCATTTCAAAATAGCTACGATACATTTCAAATGGCCTTGATGCTAATAATGAAAAGATTTTGAGGTG
ATTAATATGCTAATTAGTTATATTTAATTATTCCATATTGTATTAATATATCAAAACATTGCTTTGTACCTCATAAATAGATA
```

FIG. 6 (Cont. 3)

```
CAGTCGTAATTTGTCAATTTTCAAGACAGTTATTTAATCCATCCTGGGTCATAATCTTTTTTTCCCCTGTCCATGGCTGATTG
GATTGTCCTGATAAACCCATCCATACGCCTGCCTCCCGCAGGCTTCTGAGACGGGCTCCATGAAGGCCAGAAGCAGGCACCCT
GTGAGAGTCCACACGACCTGGAGCCTCCCTCTCCTTGGATTAGGCCATCTCCTCGGGATCGCAGGGCTCTTCATTATCCTCAC
CCCCTTGTTGTACCAAACAAGCAACATCACACTTTAATTCATCACGCTTTGCTTTAATTTTCCCCCCAAAAATCAAGGTAATA
ATTTTAGCAATAAACATCACAACCTACTATGAGTAAGTCCTTTCCAACGTACTAAGGTTTCTTCTGAGGACTTTACATGTATT
ACACAGTTTAAATTTCTTTATGAAATGAGATACCAATATCTCTATATTAGAGATTGTTTTTCTAAGTCGTTTCTGACAATTAA
TTTGTCCAAGGGCCTGTAAGGATTCTGTTAGAAATCCAGGATAAAATTTGAAATTTCAGCAGTAATATCTGGAAAAACATTGA
GACTATATTTAACTTCGTACACGTGCTCTCAAATATCCTTATTTCCCTAAAGGTTGTTCTCAGTTATTATTTTACACATGATA
TCTATAATTAATACTAATAACACAGGTTAAAATATTATCTCAATTATTTAACGACTTTTGATAATAACAAAATACATATTCCA
CATATTTTTGACCAGTTTGTTTCTCTATGAAACACGTGTTTATTAACTTATTATTATCAGATGTCACCCTTATCTTTCTGAT
TTCTGGGATTTAATTCTAGCAGGTATCGTTTAGTATATTTTATTAATTCATATTATATTGTTCACATTTTCAGTATGATTTTA
TTATTTGCATTGTTTATTGAATTTGAAACTTTCTTACATAATTTTTTTAATTTTTTATTTTCATGAGATGTAATTTCAATATA
AGTAATAATGCATAGATCTGCAATGTACCATTACAGGATTTCTGGCAAATGTAAACACACTTGTCCCCAACAGCCAAGGTTGG
ATGTAGAGGAGGCCCATTCCCCCAGCACAAGCGACCTTCTCTGTGCTTCAGTCAGCTCCCACATTTAACACAATGTTTTGAT
TTCTGCCACTGTAGATTCACTGTTCATGTTTTGATTTTCATATAAATGGATTCAAACATTATAGACCCCTTTTCTGGTAAGGG
GCTACTTTTGTTATTTTTGACGTTTATTTATGCTATTTCATATGTAAAATTGCATCTGTATATTGTCATTTATTCACTTAACA
GACTGCCTCTGATATAAAATCTCAAAGTTTTGATATATATGGATAAAGAGAGAGGGAGAGAGAGAGAGGGAGAAATTTTATAC
TTGAGTCAGTGCATTTAACAATAAACGACAGTAAGCTGATCCATTTCCCTGTCAATGCACTTTTAATTTGTTTCTGGTTTATT
AACATCATAAGCAAAGCTGCTGCACATATTTTTTGTTTTTCTATTTACCTTTTCTCATTTTTATTGAGAAAGTATGTGGAAAT
ATCCATTTCTTCATCATAAAAGTAAACTTCATTTGTTCAGCTTTATGGAACTATAATTGACAATAAAATTGTATATATTTGAG
GTGCACCACTTGATATTTTGGTATAAATTGTGAAATTTTCACTATGACCAAGGAGTTAGCATGTCTGTTACCCTACATTTGCC
ATTTTCTTCCTTTAATTTATATGTGTGTGTCCAATGAGAGCACCTGAGATCTATCCCTTTACCAGAGATCAAGTTTGCAATAC
AGTGTTGATAGCTATAGTCCCATTGCTTTACATTAGACCTCCAGAACCCATTCAACCTGCACAACTGAAACTTTATGCCCTTG
ACAAGAATCATTCTATTTCCACTCCTCCCAGCCCTGGGAACCACTTTTCTACTCTCTGCTTCAAGAATTTGAATATTTTAGA
TTCCCCATATAAATGAGATAATGCAGCATTTGTCTTTCTGTGTCTGGCTTATTCCACTTAGCATAATGTTCTCCAGGCCCATC
CATGTTGTTGGAAATGTTATAATTTCCTTATTTTTAGAGGTCACATAATATTCCATTGTATGTGTATACATTTGCTTTTATACA
CCCATTTACCTACGGTCACTAACTTTAAAAAAATTCTAGGCCATTATGAATAATCTTGTAATAAACATATTTTTTACTTACTG
ATTTTATTTCCTTTGAATACGCAGCCAGAAGTGGGATCACCAGATCACGTAATAGTTTTACTTTCAATTTATAAAATAACTTT
TACTACCACTCCACTGAATAATTCTCTTTTCACCAGCTAACTGTCAGCATTTTGTTATCTTTTGTGTCTGTGATAATAGTCAT
GGTAATGAACGTGAGGTGATATCTCATTGTGGTTTTGATTTGGATTCCCCTGATGATTAGCAATGTGGAACACCTTTCCATGT
CCTGCTGGCCATGCATATGTCTTCCCTTGAATACAATGTCTATGTACAGTTTTGCCCTCTTAAAAATCAGGGGTTTTTTTGC
TATTGTATGGGTTCTTTACACATTTAGATAGATCCCTTTGTCAGATATATAGCTTCAAGTAATTTATTTGTCTATGATTTTGG
TGTCGAATCCAAATAAATCATTTTCCAGATCAACTCTGGAAAGCTTCTTTTTTCCCTGTTTTCTTCTATGAGTTTACAATTTT
AGATATCATATTATATCCAAGCCTTGAGTACATTTTTAGGTGATTTTTGTATATGAGATGAGATGAGGTCTCATTTTTTTCTG
CATATGGATGCTCAGTTTTTACACCATTTGTTAAAAAGGCAATCTTTTCCTTATTGTGTGTCCTTGGAACAAAAAATCTGGGA
GATACACAAAAGAGGAAAATCTTAGACCAATATTCCTGATGATAGACCTAAAAATCTTCAAGAAAATACTAGGAAATTGAATA
TAGCAGCACATTAAAAAGTTATTACATTATGATCCAGTAGATTTTACTCCTTTCATGCAAGGCTAGTTCAACATACACAAATC
AATAAAGGTGCTCACCACATAAGCAGAATCAAAAGCAAAAACTATATAATTATCTCAATAGATCCAGAGAAACTTTCAATAA
GATTCAACATTCTTCATGATAAAAACCTTCAACAGACTAGACATCAAAGAAACTTAGCTTAAAATGATAAGAGCCATGTATGA
CAAACCCACAACTGACACCATACTGAATCAACAAAAGCTCAAATCATTCCCCTTCATAACTGGAACAAAACAAGAATACCCAC
TCTCACCACTCCTATTCAACATAGTAGTGGATGTTCTAGCCAGAGAAATCAAACAAGAGAAAGAAATAAAAGGCATCCCCACA
AGTAAATAAGAATTCAAACTATCTATTTTTGCTGTTGATAGGATCCTATGCATAGAAAATTCTATAGACTCTGCCAAAAGAAT
CCTAGAATTGATAAACAACTTTAGTAATGTTTCAGGATACAGAATAAAATACGAAAATCAGTAGCTTTTTTATACACCAACG
ACATCCAGGCATAGAGAAAAATAAATGACACGATCCCACTTACAACATCTACAAAAAAAGAAATACCTAGGAATACAGCTAAC
CAAGGAGGTGAAAGATCTCTACAAGAAGAACTACAACCTCTCCAGCACATGTTGTTTCCTGACTTTTTAATGATCGCCATTCT
AGCTGGTGTGAGATGGTATCTCATTGTGGTTTTGATTTGCATTTCTCTGATGGCGAGTGATGATGAGCAGTTTTTCATGTGTC
TGTTGACTGCATAAATGTCTTCTTTCGAGAAGTGTCTGTTCATATCCTTCACCCACTTTTTGATGGGGTTGTTTGTTTTTTTC
TTGTAAATTTGTTTGAGTTCATTGTAGATTCTGGACATTAGCCCTTTGCAGATGAGTAGATTGCAAACATTTTCTCCCATTC
GTTAGGTTGCTTGTTCACTCTGTTGGTAGTTTCTTTTGCTGTGCAGAAGCTCTTTAGTTTAATTAGATCCCATTTGTCAATTT
TGGCTTGTGTTGCCATTGCTTTTGGTGTTTAGACATGAAGTCCTTGCCCATGCTTATGTCCTGAATGTATTGCCTAGATTT
TCTTCTAGGGTTTCTATGGTTTTAGGTCTAACATTTAAGTTTTTAATCCATCTTGAATTAATTTTTCTATAAGGTGTAAGGAA
GAGATCCAGTTTCAGCTTTCTACATATGGCTAGCCAGTTTTCCCAGCACCATTTATTAAATAGGGAATCCTTTCCCCATTTCT
TGTTTTTGTCAGGTTTGTCAAAGATCAGATAGTTGTAGATATGTGGCATTATTTCTGAGGGCTCTGTTCTGTTCCATTGGTCT
ATATCTCTGGTTTGGTACCAGTACCATGCTGTTTTGGTTACTGTAGCCTTGGAAACAACAGGTAACAACAGGTGCTGGAGAGG
ATGTGGAGAATAGGAACACTTTTACACTGTTGGTGGGACTGTAAACTAGTTCAAACATTGTGGAAGTCAGTATGGCAATTTC
TCAGGGATCTAGAACTAGAAATACCATTTGACCCAGCCATTCCATTACTGGGTATATACCAAAAGGATTATAAACCATGCTGC
TATAAAACACATGCACACGTATGTTATTGTGGCACTATTCACAATAGCAAAGACTTGGAACCAACTCAGATGTCCAACAAT
GATAGACTGGATTAAGAAAATGTGGCACATATACACCATGGAATACTATGCAGCCATAAAGATGATGAGTTCACGTCCTTTG
TAGGGACATGGATGAAGCTGGAAACCATCATTCTCAGCAAACTATCGCAAGGACAAAAAACCAAACACCGCATATTCTCACTC
ATAGGTGAGAATTGAACAATGAGAACACATGACACAGGAAGGGGAACATCACACACCGGGCCTGTTGTGGGGTGGGGGGAG
GAGGGAGGGATAGCATTAGGAGATACACGTAATGCTAAATGATGAGTTAATGGGTGCAGCAGACCAACATGGCACATGTATAC
ATATGTAACACACCTGCACATTGTGCACATGTACCCTAAAACTTAAAGTATAATTAAAAAAAACAATTACAACGAAAATCCTT
AATGTCTCTTGAGTAGGTAGAGAACATATATTTTATCTAAGTAACTTGCTCTAAACTGCAAACCAAAATAAGATGATTCAATA
AAGTATTTTGTAAACTAGTCTTTAGCAAAAAAAAAAAAAGAACTACAAAACACTGCAGAAAGAAATCAGAAAGTAAACAAATA
AATTGAAAAAAAAATTCCATGCTCATGGAATGGGAGAAATAATATTGCAAAAATGGCAATATTATCCTTCAATATTTATCGAT
TCAATGTTATTATCAAATACCAGTTTTATTCTTCTAGAAAATATAAGAAAAGTATTCTAAAATTTGTATGTAACCAAAAAGA
```

FIG. 6 (Cont. 4)

```
ACAAAAACAGCCAAAGTAATCCTCAGCCAAAAGAACAATGCCAGGGACATCACACTATTTGACTTCAAACTCTACTATAAAGC
CACAGTAACAAAAACTGTTTGGTACTTGTACAAGAATAAACACATAGACAAATGAAATAGAATAGAAAACTCAGAAATAAAGC
TGCACACCCACAACCATCTGTTTTTTGACAACCCTGAAAAAAATAAACAAGCAATGGGGAAAAGACAACCTAGTCAATAAATG
GTGCTGGGATAACTTGCTAGCCATATGCAGAAGATGGGAACTTGACTCGTGACTATCACCATATGAAAAAGAAAATTAACTCA
AAATGGATTATAGCTTTAACTAAGACTTCAAACTACAAAAAGCTAGGAAGACAACCTAGGAATACTCTTCTCTGCATTGGCCT
TGGCAAAGAATTACTGGCTCTGAGACCAGGCATTTTTTGTAACAGTGATTTATTTTCTGGGGTACATATCATGGAGTGGGATT
GCTGATTGAACGATAGATCTATTTTAGTTGCTTGATAAGCCTTTACAAPTTTTTTCACATAGGTTGCACTAATTTACATTACC
AACAACAGTGTATAAATGCATTTTCTCTGAATTCTCATCCATATCTATAATTTTTTGACTTCATAATAATAGGCACTTTGACT
GATGTAAAGTTGTGTCTCACTGTTGTTTAATATTAATTTATCTAATGATTAATGTTGTTCAGCTTTTTATTTCCATATGCTT
TTTGGCCATTTGAATATCTTCTTCACAAAATGTCTGTTGATGTCTTTTGCCCACATTTTAATGGTGTAATTTATTTATTTGTT
GTTGTTGCTGAGTTGTCTGTGTTCTTGTTAGATTCTAGATGTTAGTTATTTATTGCACAGTAATGTAATAAATCTAAAAGTCA
GGAAACAACAGGTGCTGGAGAGGATGTGGAGAAATAGGAACACTTTTACACTGTTGGTGGGACTGTAAACTAGTTCAACCATT
GTGGAAGTCAGTGTGGCGATTCCTCAGGGATCTAGAACTAGAAATATCATTTGACCCAGCAATCCCATTACTGAGTATATACC
ATCCCATGACTGGGTATATACCCAAAGGATTATAAATCATGCTGCTATAAAGACACATGCACACGTATGTTTATTGTAGCACT
ATTCACAATAGCAAAGACTTGGAACCAACCCAAGTGTCCAACAATGAATAGACTGGATTAAGAAAATGTGGCACATATACCCC
ATGGAATACTATGCAGCCATAAAGATGATGAGTTCACGTCCTTTGTAGGGACATGGATGAAGCTGGAACCATCACTCTCAG
CAAACTATCGCAAGGACAAAAACCAAACACCGCATGTTCTCACTCATAGGTGGGAATTGAACAATGAGAGCACATGGACACA
GGAAGGGGAACATCACACACTGGGCCTGTTGTGGGGTTGGAGGGGCGGTGGGAGGGATAGCATTAGGAGAAATACCTAATG
TTAAATGATGAGTTAATGGGTGCAGCACACCAACATGGCACACATATACATATGCAACAAACCTGCACATTGTGCACACATAC
CCTAAAACTTAAAGTGTAATAAAAAAAATAAATTAAAAAAATCAATTGCAAAAAAACTGTTGAAACTATGAAAATATGAGGT
AATTAAACAACACAATTTTGACCAATCATTGGCTCACCAATAAAATTAAGATATTAATTTTAAAAATACAAAGAAAAATGAA
GCCACAACATACCAAACCCTCTGAGATACAGGAAGAGCAGTACTAAGAGCTTATAGTTCTAAATGTCTATGAAAAAATAGAAA
GATTATAAACTAGCAATCTATTGATTTACTTCAAGGAACTAGATATTTTAGAACAAACCAACCCCAGAGCTAGAAGAAGAAAA
TAAATAAAGATCATGGCAGATTTCAAAAATATTGAAACAAAAAAGCAAAATATAAGGAATCAACAAAACAAAATGTGGTTATT
TTAAAACATGAACACAATTGATAGAGCACTAACTAGGTCAACAAAAAAAAAAAACAGAAGATTCAAGTTAGCACAAGCAGAAA
TGATAAAGGTGGTATTATAACTGACCCAATGGAAATACAAAAGATTATCAAGACATACTGAATATGTCTATGCTCACAAACTA
GAAAATCTAGAGGAAATCAATAAATTTCTGGAAATATTCAACTACCCCCCAAAATTGAACCAGGAAGGAAAAGAAATCCTAAA
TAGACCAATGCGAGTAATAAGACTGAATCAGAAACTGAAAATCTCCCAACCCCAAAAGCCCAGAACCAGATAAAATTCAAGGTC
TAATTTTACCAGATGTACCATTCTTACTGGAACTATTCCAAAGGATTAAAGAGAAGAGATTCTTTCCCACCTTTGTCTAAAAT
ACTCGTATCACCTAATACCAAAATCAGGCAAGGATACAACTACAACAACAAAAGCTACAGGGAAATATCCCTAATGAACATA
GATACAAAATAGTAAACAGAATACTAGCTAGCTGAAACCAACAGCACAATAAAAGATAATACATCATGACCAATGGGTTTTA
TTCCAGGGATGCAAAGCTTGTCTAAAATAAACACATCAATAAATATGATTCAACATATAACATAATTAAAAACAGAAAACATA
AGACCATCTCAATGAATGCAAAAAAGTCATTCAATAAAATTCAATATCCCTTCATGAAAAATTCCTCAACAAGCTTAGCATCA
AAGAAACCTACCTCAAAACTATAAAAGCCACATACAACAACCAACAAAAAACTCTTAAATAAATCAATAGAACAGGGATCTTC
TTAAATTTAGTAAAAACCTATGCAACTGATTTATTCAATATGCTGGACTTGGTAGTGAAGAAATGAATGACTTTAACTAAAAA
AAAAAGCCACATATAACAAAACAACATTATATGGAATGAGAAAAAGTTGCAAAAATATTCCTGAAGAACGTGAGCAAGAATGC
ACACTTTCACCACTCCTACTGGACGTATTACTGAAAGTCCTAGCCAGAATAATCAGAAAGGAAAAAAGAAAATGTATGTTTCAA
GTTCCAAGCTAAGGAATCCAGGAGTGGCAGACCCAGAGACTTGTTTTTTAATCTATGAATAACATCCAAACCCCTGACCGATC
CCTTGGAACACAGGATTTAGGGGTGATTGAGGCTCTTTCTTTTGGGTTAAATGAAAGTTGCTAGGTGGAGGGTGTTAAGTAAA
AATTACTACATAAGCTGCATAGTTTTGTCAAATGGTTGTAGTTTTCTTGTCCAGCCTGCTGTTCCTGAACCACCCTATATGAA
AGCCCTCAATAAACTATATGTCTTGTTCACTGGTTTGGCCTGTTGTACACGATGCCAGTCCTATTGGAGTCCATATTGGTCTG
GCGTGACATCCAGTCAACCTGGTAAAAGGTCCAAAAAAAATCTCATGAGCACCCAGACAATGGAATCTAAAAGAGGGAGACCC
CTGCAGAAACCTTGGGCAGGCTGTTAATTTCTACGTGGGGCCCAACAGCCGTTATCCATGATGGATGGGGCCCAGTGCCTGAG
TATGGGATACCGCCACAATGCCAAAAGTTCTGGAAGAACCTCTTCAGTGGGTGCATCTTACAAAGTGAAAGTCAGATGTCCA
GGCTGTTGCATTATCAGGTGAGTGGTTCTTCCTGACTGCACTCTGAGAAGCCACTGAGACAGTGCTCACTGTGTATGCTACAG
TGTGTCAGTCACAAGAAGAGCTACTCCTAGAAAACATGCCAGACTAGCTCAGACTAATCAGAGACCTTTCTGTCCTGCCTGT
GGAAGCAGAATGGCAAATTGGGGACCGCCGCTTGTGGAGCAGCACATTGAAGGATTTCTGGCCATCACATGAATTAGTTACG
GCTGTGATGACTAAACTGTCATGGGACCCTAAGACCTAGTTCCCATAAAGAGTTCTAGGGGGAGGAGGATGAAGTTTGGGGTA
AGCCCATGGGGGTTCCTGTCCTCTCTACACATCTGGTGGCTCACCACCAAGGTAAAAATGGGCCAACTGCACCAGCAGAGGCGA
GCCCCAGAGACATTTCCCACCTGAAATAAGGAAACACACCACAATGTGGGATTCCACCACTGCGGAATTGCTGACACTTAGAA
ATGGGTTCAGACAGAAGAAGAGAGAGTTGATCACAGGGTGGCTTCTTCATCTGTGAGGCATGCGGGAGGAGGGCATTATACTC
CCTGAACTCAAGATTAGTAAAGTGACATCCATCACAAACCATCTGGGCCTGAGGCAGCACCTCGATGGTGTCAGTCATGGAGA
TTGGACCATCCCTCTCCTTAGCTGGGTGGTTGCAGACTGCAAGGGACCCTGGTGAAACGAGGGAGATGTCCGCTTTATTAGTG
TGTTCTCGTATTGCTAGAAAGAAATACCTGAAACTGAGTAATTCACATAGAAAATAGGTTTAATTTACTCATGATTCTGCTGG
CTGTATGGGAAGCATGATGAAAAATCTGTTCAGCTTCTGGAGAGGCCTCAGGAAATTTACAATGATAGTGAAAGGCAAAAGGG
GAGCAGCCACTTTATATGGTGGGAGCAGGAGCAAAGAAAGAGTGAGGGTGGAGGTCCCACACACTGTTAAACAACCAAATCTC
ATGAGAACTCATTTACTATCATAGCAAGGGGACCGTGCTAACCATTATTCATAAATCCGGACCCACGATACAACCACCGGGCC
CCGCCTCAAACATTAGGGAAGCAAAATCACATACAGTTGTTATGACAGGTGGGACATCCTGAAAACCTCTCTAGGCATGTCCC
ACACGGCCCTGGAGCTGTCTCAGGGGAGCAGTCTCCTCCAGTGTTTAGACGCACAGGCACGGATAATAGGGCTAAGTCTGGCC
AGATGTGTGATATTCAACACATTGCACAACTGCTCTGTTCTGTATTTATCTTCTCTACAAATGTAACATTGATGGTTG
CATTAAATATATTCTGCAAATATGTAAAAATAAAATAAGATGATGATTGCTAAATGATTATCAAGGCACAATCACATAATCCG
AAGTTACAATTTCCTGAGAGATAGGATTACTGCCCATGCTTACCAGGACACTCACATCTGCTCTGGGCACTGCCTTCTCCTCA
GGCGTCCCACCCCAGAGCTTGCTATATAGTAGGAGACATGCAAATAGGGTCCTCCCTCTGCTGATGAAAACCAGCCCAGCCCT
GACCCTGCAGCTCTGAGAGCGGAGCCCCAGCCCCAGAATTCCCAGGTGTTTTCATTTGGTGATCAGCACTGAACACAGAGGAC
TCACCATGGAGTTTGGGCTGAGCTGGGTTTTCCTTGTTGTTATTTTACAAGGTGATTTATGGAGAACTAGAGATGTTAAGTGT
GAGTGGACGTGAGTGAGAGAAACAGTGGATTTGTGTGACAGTTTCTGACCAGGGTGTCTCTGTGTTTGCAGGTGTCCAGTGTG
```

FIG. 6 (Cont. 5)

```
AGGTGCAGCTGGTGGAGTCTGGGGGAGGCTTGGTCCAGCCTGGAGGGTCCCTGAGACTCTCCTGTGCAGCCTCTGGATTCACC
TTCAGTGACCACTACATGGACTGGGTCCGCCAGGCTCCAGGGAAGGGGCTGGAGTGGGTTGGCCGTACTAGAAACAAAGCTAA
CAGTTACACCACAGAATACGCCGCGTCTGTGAAAGGCAGATTCACCATCTCAAGAGATGATTCAAAGAACTCACTGTATCTGC
AAATGAACAGCCTGAAAACCGAGGACACGGCCGTGTATTACTGTGCTAGAGACACAGCGAGGGGAGGTCAGTGTGAGCCCGGA
CACAAACCTCCCTGCAGGGGCGCGTGGGGCCAACAGGGGGCGGTCGGGAACCACTGAGGACGGGACAGGTCCCAGGAGCAGGT
GCAGGGGGCGGTTTCCTGTCAGCTGCAGGAGGCGGGTTTGTTTTTGCAGGACTCTGGAGCCTTATGAGGTTGCACTATTTTAT
TATGGTTATTTATCATGTGTTTTTTATTGATATTTGTGTTTTAGTAATTTTACATTTATATGTAGGGGTATTTTTTAAAAAT
ACATAACTTCAAGAAATAATTCTTCCTAGTAATTTACACCTATTCCTCTAAAGTTTTATTAACACCTGTTGATATCAGCAACT
ACATAGCTATGCAACATTAATTTACATCTATAAACATATGTGTGAATACATGAAACTATGCATACATGTGTAGTCATTTATAT
TTAACATTATAATAAAATAATAAATTAAATAAAATAATTGAATTAAATTAAAAGAATTAAACTTAATGATGAACTAAATATAA
ATTAGAGTAATCCATAATTGATTTCAATCCTTCTCTATGGTTTACATAAATCGATGTCTACTTGTAAGCTTAAGTATAGTGAA
TTGGTCATTTTAAAATAGCCAAGAACAAATTTCAAATGTTCTTGTCACCAAAAAATGATAAGGATTTGAAGATTTGAGGTGAT
ATATATGTCAATTAGCTCGATTCAATTATTCCACATTGCATTCATAAATCATAACATAGCTTTGTACCCCATCAGTATATGGG
GTACAACCAAAATTTCTCAATTTCCAATGAAATTTTAATTATATATTTTTAATTTGATGCCTCTCTTTGGATCAGGCCACCT
CCTCAGGATTACAGTGCTGTTCAGTTTTCTCAACATGCTGTTGTACCAGATAAGCACAAAACATTTAATTTCATTATGCTTTG
CTTTAGTTTTTCAAAACAACATAAAGGTAATAATTTTCCCAACAAACATATTACAGCCTATTCTATACTTTTTTATTTTTTGT
TTTTATGAGATAAAATTTACATGTAAGAAAAAATTTATAGATCTGAAATGTGTCACTAGAGAGTTTCTGGCAAATGTGAATAC
CCTTGTCCCGAACACCTAAGGTAGACTAAAGAGCAAGTCCATACCCACAACATGCGTCTTTCTCTGTGCCTGCGGTCAACCCC
TACATGGGGAAGTGTTTTGATTTCTGACACCATAGATCCATTTTTTTCTGTTTTGAGCTTTATATAAATGGAATCAAACATTA
TAGACCTTTTTTTGGTAAGGGACTACTTTGCTATTTTTTAGGTTAATTCATGCTATTTAATGTATGAAATTAGATCATCATAG
TGTCATTTACTCAATTAATGGGCTGACTCTGATATGAAACCTCAAAGTATTCATGTATATATGGAGAGAGAGAGGGAGGAA
GGACAGAGATTTTATATCTGAGACAGTCCATTGAGTAAATATATGACAATATATTGATCTATTTGTTGTCGATGGATTTTACA
TTTGTTTCCAGTATATGAATATTATAAGCAAAGCTGTTACAAATACATTAGTGTAAGTTTCTCTATCTATGTTGTCTCAATTT
TGTTGAGAAAATATGAAGTATGTTTTTCTCTATTGTAAGAGGAAGTTTAATTTTTTTCAGTTTTATTGAGGTAAAAATAAAAT
ATTTTTTAAAATGTATAGGTTTAAGGTGCCCCACTTGACGTTTTGATGTGTATTAGTCCATTCTCACACTGCTATAAAAAAT
GCCTGAGACTGAGTAATTTGAAAAAAAAATATGTTTAATTGGCTCACGGTTCTGCAGGCTGTACAGGAAGTGCAGTGGCTTCTC
CTTCTGGGGAGAGTCAGGAAAGTTAGGATCATGGCAGAAGACAAAGGGGAGCAGGTGTGTCACATGGCCAGAGCGGAAGCCAC
AGGAAGCGGACCGGGGTGTGGGGGACTGCACACTGTTAGACAACTAGATCTTGTGAGAACTCAGGCACTGTAGTGAGAACAG
CACCAGGAGTCGGTGCTGAACCACTCATGAAAGACCCACCCCACGACCCAGTCATCTCCCACCAGGTCCCACCCCAGGACTGA
GGATTATAATATAACATGAGATTTGGTCCAAGACACAGATCCAAACCATATCATATGCACATTGTGAAATGCTCATCATGGTT
AAGGTAATTTGTATATTCATCTTCTCACTATTTTTTGTTTGATTTTGAGACAGAGTTTTGCTCTTGTCGTCCAGGCTGGAGT
TCAATGTCACCATCTCAGCTCACTGCAACCTCCAACCCCTGGATTCAAGGGATTCTCCTGCCTCAGCTTCCCGAGTAGCTGGG
ATTACAGGAGCTCAACACCACACCCCGCTATTTTTTTTTTTTTGGTACTTTTAGTAAAGACAGAGTTTCGCCACGTTGGCC
AGGCTGGCCTCGAACAGCTGACCTCAAGAGATCTGTCCGCCTCGGCCTCCCAAAGTGCTGGGATTACAGATGCAAGCCACAGC
GCCCAGCCAATTTTATTATTTTAAAAATGTACTGCATGTGAGTGTGTGCGTGTGTGTGTTTCATGAGAACACCTAAGATCT
ACCCTTTTAGCAAAAATCACTTTTACAGTACAGTATTAAATACAGGAAAATTGGCGTAGGTTAGATCTCCAGAACTCATTCAC
CCTGCACAGCTGAAACTCTGTACCCTCTGACCAACTTCACCCAATTTCCCTCTCCTCCCAGGTCCTGGGACCCACTATTCTAC
TCTCTGCTTTCAAGAGCTTGAATATTTCAGATCCCACACGTAAATGAGATCATGCAGCATTTGTCTTTCTGCATCTGGCTTAT
TCCACTCAGCGTCATGTCCTCCAGGCCCATCCATGTTGCAAAAGCCAGAACTTCCTTCTTTTTCAAAGCTAAATAAAATTCAGT
TTTATGTGTACACATTTTCTTTAAACATTCTTTAATCTATGGTCATTAAACTCTTTCACAAATCTACACTATTATAAATAATC
TGGCAGTGAACATGTGTTTAACATAATAATTTTATTTCATTTGAATATATAACAAGAAGTGGGATCACCAGATCGTACGATAA
CTTTATTTTTCAATTTATTGAGTAACAAGTCCTACCACACCATATCATGATTTCCTTTCCCAACATTCTTGTGAACACTTGTT
ATATTTTGTCTTGCTGATAATAGTCATTTTAAGTGGTTTGAGGCAATATTTCATCGTGCTTTAGATTTGAATTTCTCTGAAAA
TTAGTAATGTTGGGAACCTTTTTAGGCTCTGTTTTCATGAGTGGGTTTCTGAAAAAAGTCTATCCAGGTTTTTCCCTTT
TATCAGGTCGTTTGTAATTTGCACATAGTTTTTTTTCCTGTGCTTTTGGTATTAAATTCAAATAAATCATTTCTGAATCAATG
ACAGGAAGTTTTTCCATGCTGTCTATGAGTTTGTGGTTTCAGGTTTTGCTCATTTTTAGTTGATTTTGTACATGGTGTGAGA
GAAGGTCTAATTTTATTTCTTCTGCATATGGATGTCCAGTTATACATCATTTATTGAGGAGACTGTCTTTCTTCACTGTGTCT
TTTTGGCATACAAAATCAGGAAGAGACATAATTAAAAAAGAAAATATTAGATGAATATTCGTGATGAACATAGACCTAAAAGT
TCTCAACAAAATATTAGCAAATAGAATCCAGAAGCACTTTAAAATGTAACACATCATGATCAAGTGGGCTTTACCCTGGGATG
CAAAGTTCATTCAACATCCACAAATCAATAACTGTGATTCATTGTGTAAGCAGAATAAAAGCAAAAACCATATGTTATCTCAA
TAGATGCTGAGAAAGCTTTTGATATGCTCCAACACTCACTCATAATAAAAACCCTCAGCAAACTAGGCATCAAAAAACATACC
TCAAAATAATAAGAGCCATCTATGACCAACCCACAGTCAACATTATACTGAGTGAGCAAAAGCTCAAACCCCATGAGAATTGG
AACAAGACAAGGATGCCCTCTCACCACTCCTATTGAACATAGCACTGAAAATCCTAGTCAGGGCAACCAGGCAATAGCGAAAA
TAAAACGCAGCCGATATGGTTTGTACTAGTGCCCCATTCAAATTTCATGTCAAATTGTAATTCCCAGGGTTGGGGCTGGGGTC
TGGTGAAGGGTGATTCTATCATGAGGATGGGTCTCCGTCTCTTGTGCTGCTCTCGTGATGGTCCTCAGGAGATCTGGTTTCAA
AGTATGTGTCATCTCCCTCCTCTCTCTTCCTCCTGCTCCTGCCCTGTAAGACATGATGCTTCCCTTTCTGTCATGATTGTCAT
GTTCCTGAGGCCCCCCCAAGAGCCATAATTCCTGTACAGCCTGCAGAACCATAAGACAATTAAAAACCTTTATACATTACACA
GTCTCAGGTGTTTCTTTAGAGTGTGCGAATGGACTAATACAGAATCAAAATAGGAAAAGAAGTCAATGTATCTGTCCAAATTG
ATGATATAATTCTATACCTAGAAAATTCTAAAGACTCTGCCAAAATAATTCTAGAATAGATAAACAACTTTGGTAAAGTGTCG
GGATACAAAATCAATGTACAAAATCACTAGCATTTGTGTACCCCAACTACATCCAAGCTGAGAGTGAATCAAGAACACAAT
TCTATCCCACTTACAATATCCACAAAGAAAAGGAAATGCCTGGGAACACAGATAACAAATAAGATGGAAGATCCCTGCAAGAT
GAATGACAAAACACAGCAGAAATAAGTCATAAATGACACAAAAAATGGGAAAACATTTCATGCTCATGATTGGAATAATCAAT
ATTGTAAAATTGTCATACTGCCAATAGAAATTTACAGATTCAATACTATTCACATAAAACTATCACCATCATTCTTCACAGA
ATTAGAAAAAAAGTATATATATTCTAAAAGTTATATGGAACCAAAAGCCCCTGAGTAGCCAAAGCAATTCTAAGCAGAAAG
AACCATGACAGAGGCAACATGATACCTGACTTTAAACTACACCATAAAGTCACAGTAACCAAAACAGCTTGGAAGTGGTACAT
GAGCAGACATGCAGAAAAATGGAACAAGAGAGAAAACAGAAATAAACCTGCACACATAAACCATCTGATATTTGATAAGGCTG
```

FIG. 6 (Cont. 6)

```
ACGAAAACAAGCAATGGGGATAAAACTCTGTATTCACTAAACGGTGCTGGGATAACTGGAFTCTGTCAGATATACAGAATGCA
AAAGTGAAGGAGGCTGGGCAGCTTCGACTTAGATTTCAGAGGATATGTAGAGGGCCCTGCAGGCCCAGCAGGAGGCCGGCTGC
AGCAGTGCAGCCACCACAGACAGCCTCTACTAGGACAGTGCCAAAGATGGGGAAAGAGAGGGTTGGAGCCCCAATTCACAATC
CCCACTAGGGCATTTTACACTAAAGCTGTGGGAATGTGGCCACGACCCTCAAGGTCCCTGAATGGTAGAACCAAAGGCAGCTT
GCACTCTCAGCCTGGAAAAACTTCTGGTACTCGACTCTAACCTATGAAFGCAGGCCAATAAGCTGTGCTCAGCTATAAGGATG
AAAAGCCTGAGGTTTCTGGGACTCCTTCAACCCAGGGTGCCCTGGTTGAAGTACATCAAGTGAAGCGAGATTATTTTGTAGCT
TTAAGATTTAATATCTGCCCAGACAGGCTTTAGGTGTGTGGGGGGCCTATTGGCCATTCCTTTGGACATTTTTTTCCTTTTGT
ATTAACAATATTTAACCAATATCTGTGGCAGTCTTGCATGTTGGAAGTAAATAACTCTTTAAAACATTTTGCCAGCTCATAGC
TGGAGGGAAATTGCCTTAAGACTCGGATAAGACTTTGGAATTTTTCAGTTGGAGGTTGACCAAGTTAAGACTTTTGGAAACTAT
TAAAAAAAAAAGATCATTTTGCAACCTCTGAAGGACGTAAGATCAGGGGGCACAAGAGTGAAATGATATAGTTTAGATGATGG
TCCCCTCCAAATCTCATGGCGAAATGTGCTCCACAATATTTGAGGTGGGGCCGACTGGGAGATTTTGGGACATGGGGAAAAAT
CCTTCAGGAATGGCTCAATAACCACCCTATGGCAGTAGGTGAATTATTCCTGTATTAACTACTGGGAGATCTGATTATTAAAA
GGAGTCTGATGACCCTCCTCCCCTCTCACGTCCACCCCTCACCATATGACACCGCCTGCTTCCCCTTTGCCTTCCACCATAAC
TGTAAGCTTCCTGAGGCCCTCACAAGAAGCAGATGCTGGTGCCATGCTCCTCACACAGCCTGCCGAACTCTAAGCCAAATGAG
CCTCTTTTATTTGTAAATTACTTGGCCTCAGGCATTAATTTAGAGCAATGCAAAATAGACTAAAACACACTGCCCAAAGCAAT
ATACAGAGTCAATGCAGTTTCCATCAAATAACCAATATAATTAAGTACATTTTTTTTAAATGTCCTAAAATTTATATGGAAGC
AAAAAAGAGCCTTTTGATTCCATATAATAGCAAAGCCGTCCTAAGACAAGGAAACAAAGCTGAAAGCCCCACATTCCCTGAC
TTCAAATTATACTACACAGTTATAGGAAGAAAGACAGCACGGTACTGGTACCAAAACAAAACAAAAAATATTAGACCAGGTGT
GCCTGTAATCCCAGCACTTTAGGTGGCAGAAGCTGGTGGATCACCTGAGGTCAGGAGCTCAAGACCAGCCTGACCAACATGGT
GAACCCCTGTCTCTAGTAAAAATATGAAAAACTAGCCAGGCCTAGTGGCCCATACCTGTAATCTCAGCTACATCGGAAGCTGA
GGCAGGAGAATCACTTAAACCCGGGAGGTGGAGGTTTCAGTGAGCTGACATCTTGCCATTGCACTCCAGCCTGGGTGACAAGA
GCAAAACTCCATCTCAAAAAAAAAATTAATGTAACAGAATAGAGAGCCCAGAAAGAAAGCCAAATATCTACAACCAACTATTC
TTTGACAAAACTGACAAAAATATACACTGGAGAAATAGTCCTCTATTCAGTAAGTCGTGCTGGGAAAATTGGATGGCCACTCA
TAGAAGAATAAAACCAGGCTTCTATCTCACCACAGACAAAAGTAACTGAATATGGATTCAATAATTAAATGTATAAACTGAA
ACTATAAAAATACTTGAAGAAAATGTAGGGAGAATTCTCGGGACATTGGCCTAGGCAGATAAAATATGACTAAGACTTCAAAA
GCAAATGCAACGAAAACAAAAATAGATGAAGAGGACTTAGTTGAACATCTTCTGCAGAGAAAAAGAAATAATCAACAT
GGTGAACAAACAGCCTACACAATGGTAGAAGGTATCACTTCATCTCAGTTAAGAAGGCTCTTATCAAAAAAGAAAAAAAACAG
CCAGGCGTGGTGGCTCATGCCTGTAATCCCAGCACTTTGCGAGGCCGAGGCAGGTGGATCACTTGAGATCAGGAGTTTAAGAC
CAACTTGTCCAACATGGCAAAACCCTATCCCTCCTAAAAATGCAAAAATTAGCTGGGCGTGTTGGCCAGCACCTGTAGCCCCA
GCTACTCGGTAGGTTAAGGCAAGATAATCGATTGAACCTGGGAGTTGGAGGTTGCAGTGAGGTGAGATCACGCCACTACACTC
CAGCCTGGGTGACAGGAGTGAAACTCTGTCTCAAAAAGAAGGAAGGAAGGAAGGAAGGAAGGAAGGAAGGAAGGAAGGAAGGA
AGGGAGGGAGGGAGGGAGGGAGGGAGGGAGGGAGGAAGGGAAAGAAAGAAAGAAAGAACGAAAGAAAGAAAGAAAGAAAGAA
AGAAATTAAGAAAGAAAAAATTAAGAAAGAAAAGAAAGAAAGAAAAGAAGGAAAGAGAGAAAAAAGAAAGAGAGAGAGAA
AAAAGGAAGGAAGGATGGAAGGACAGAAGGAGGGATAGAAGGAAGAAAAGGAAAGGAGAAAGAAAGAAAAAGAGAAAGAGAT
AAAAAGAAATAAAGAGAGAAAGAAAGAAAACTAACAAATGCTGGTAAGGTTGGGGAGAAGGTAAACTAGTACAGTCAGTCACT
ATGGAGAGCAGCGTGGAGGTACCTCAAAAAACTACAAATACAACTACCAAACGACCCAGCAATTCCACTACTGCAAATGTATC
CAAACGCATGAAAATAATTATATCAGAGATTTCTTACTCCCAGTGTATATGGCAGGACCTTTCACAATGGCCAAGATATGAAA
TCAAACCAGGTGTCAGAGAGCAGATGAATGGTTAAAGATTATGTGGTGCATATACATGATGAGATGCTCATCATCCACAGGAA
AGGAAATCCTGTTGTTTTTGGCAATGAAGACGGAACTGGAGGACATTATGTGAAATGAAATAAACCAGGAACTTCAAGTAATA
CACCTTGTTTTCTCACTCATACGTGGAAGGAAAAAGAAAATTTGTCTCATAGAAATAAATAGTAGAACAGAGGATACTAGAGT
CTGGGAAGTGCAGGGGAAGAGATAGGCAGAGATTTGTGAAGGAATACATTAGAGTTAGGTGGGAGGAATAGATTATAATGTTC
TTTACCACTGTGGGATAAATGTATTTAACAATTATATGTAGTTTCAAACAGTTAGAAGAAGGATATTGAGTGTTCCCAACAAA
AAGAAAATGTTTCAGATGACGGATATATTAATTATCCTTATCTGTCCCCTACACACTGTTTCACAACATCGCTATGTACCTCA
TGAATATTTACAATCATTATTTGTCTATTAAAATTATATTAGAAAACACAAAATTCACTGGAAGTAACATAAATGGAGGCTCT
GGGATAGACCTGGAGATAACGGAGGGTCTGGGATACATTACAGGCCTAGCACTCAATGGTCAGAGGAGCTCCCATTAGCTTTT
TGTATTTGTAGCACTGAGTAAATCTAACATTTCTCAGAGCTTCCCTTTGCAATAGAGACGTGAGGCCTAGGGAGATCTTGCAG
ATAGTCAGATATGCAGAGGGAAGAAGCAGGGGTAGAGGGTTGCTGGCCCATTCAACAATAGTTGGAATGATAATTACGCATGT
AGAGAAGCCAACATTGATTTAAATAAGTTGCATCACTGAAAGCCATGAAAAAAAATCCAAAGGAAATCTTTAAATAAAATTGA
GAGTGAAACTGTTTTGGGTGAAGAAATGTTCACTGAAGTTGGTGTGCCAGTAAAGCTGTTAAGAACTACAGTAACCACTGGA
TTGGATTCAGCTTTGTCTGAATTCAGTGTGATTATTACTGGCTCAGGCAGGGTCAGAAATCAACATGGATAGGTGGTAGCAA
CACGAAAAAGCCAGGGACCAGAAAGATTCACAGCCGAATTTTTTCAGATGTATAAAGAAGTGTTGCTACCAATCCTAGTGTAA
CTATTTCCCAAAAATGAGGATAAAGGTCTCCTCCCTAAATTATTCCATGAAGCCAGCATTATTCTGATAACAAAACCTGGCAG
AGACTTAATAAAAAAACATGACTTTAGACCAATATACCTGATGCAAAAATGCTCAATGAAATACTCACAAACTGAATACAGCA
GCACATCAAAAAGCCTAACCTACCAACACTTTGTTCCTGGGATGCAAGGTTGGTTCAACATATGCAAATCAGGAAATGTGATT
CATCACATAAACAGAACGAAAAACAAAAACCATGTTAACCGGCAGGGCACGGTGACTCATGCCTGTAATCCCAGCACTTTGGG
AGGCTGAGGCGGGCGGATCATAAGGTCAGGAGCTCGAGACCATCCTGGTTAACATGGTGAAACCCCGTCTCTACTAAAAATAC
AAAAAAATTAGCTGGGCATGGTGGCGGGCTCCTGTAGTCCCAGCTACTCGGGAGGTTGAGGCAGGAGAATGGCGTGAGTCCAG
GAGGTGGAGCTTGCAGTGAGCCGAGATCACGCCACTGCAGTTCAGCCTGGGCGACAGAGTGAGACTCTGTCTCAAAAAAAAAA
AAAAAAAAGAAAGAAAACGTTAACCATAGACACAGAAAGGTTTTGAAAAAACTTTAAGATTCTTTCATGTTAAAAACCATCA
ACCAGCATGAAGGAATACACCACAAAATATAAGGGCCATCTATGACAAACTCACAGCCAACATTATACTGACTGAGCAAAAC
CTGGAAGCATTTTCCCCTGAAAACTAGAACAAGAAAAGGACACCCATTCTAACCACTCCTGTTCATCATTGTCATGGAAGTCC
CAGCCAGAGCATGCAGGCAAGAGAAAGAAATAAAAAGCATCAAGTCAGGAAGAGAGGGTGTCAAACTATCCCTGCAGATGAAA
TGATCACATTCCTGAGTCTGTAGTTTGGTGACTGACATTAATTTAAAATATTGTCAGTCATCATTGTTTAAATATTTCTTCTT
AGCCTTTCTCTATTTTTTTCTATTTCCCATTATGTGCATGTTATACCTCTGTCACTGTCTCACCATTCTTGGGTAAGCTGTTC
TTCTTTTGTATATATGTGTGTGTGTGTATATATATATATGTGTATATATGTGTGTATATATGTATATATATATGTATATATATGT
GTGTATATATGTATATATGTGTATATATGTATATATGTGTATATATGTGTGTGTGTGTGTCTGTGTGTGTGTATATTTGTATT
```

```
TGTGTGTTTACTGTTCTAACAATATATTTTTTGTTTTTGCTTTTCAGTTTGGGAAATTTCTATTGAGATAGTTTTAAGTTCAG
ATTTTTGTCCGCAGCTATGCCCCATCTACATATAAGTCCATTGAAAGCATTACTTAATTCTGTTACAAAATTCTTGATATCTA
CTTTTTTTTCCTTTTTTGGAATTTGCTTCATTCTACTTGCATGACACAGCTGTTCCAGCATGCTGTCTGCTTAATTCATTACA
GACCTTAGCATATTAATCACAGTGGTCTTAAATTCTTTGTTTGGTAATTCCAAACTAAATGGCATGGCTGAATCTCATTTTGA
TGCTTGTTTTGTCTTGTCACACTATGATATATTTCTTTTAGTATATATCATGATTTTTATAGGGAGAAATTATGTATCAGGTG
AAAGAAACTGCTGTAAAGAGGCCTTTAGTGATATCATTGTAAGTTGTGGAGAGAAACCTGTTTCATAATCCTCTGGCCATGGC
TTCATCTAGGAAGCTTAAGGCCTTTGAAAATAAATCCTTACATGAACGTGAAAAGATAAGCCACAGATATGGAGAATTTCCTC
ACAAATCAAATATTTGGAAAAGGACTTTTATCAGGAATAATAAAAATTACCTTACAGTTGAATGACAAAACCACATGATCTAA
TTTTAAAATAGACAAAGACCTGTATAGAAAGAAGCCTCATCTAAAAATAAATATAAAAAGTGATCAGCATGATTTTTAGGTAT
ATGTATGTTTAATATTCAAAAAATACTATATCCTGTTAGAATGGGTAAAATACACATTTTAGACAGTACCAAATGGTGATGAG
GAAGTTGAAAAACAGGAACATTCACTCCTTGTGGGTGGGAAGGGGATGCTGAAGAGGCACATACACAACTACAGTTAGTACTT
TATTGTATATTTCAGAATAGCTAGAAGATAAGATTTAGAATGTTCTTAACACAAAGAAGTAATCAGTGATGGAGGTGAGGGAT
ATCCCAGGTATCTGGATTTGATCATTGCAGATAACATGCTTTTATCAAAATATCATGCGTATCCCTTAAAGGTTTTGAACTGT
TATGTATCTATATAAATTAAACATTTTTAAAAAAACGGTGCAGGGGAATCCAGCTAATTGCAGATTCCCATTAGATGGGATGT
GCTGCATAATCTGTAAACTAATCAGAGTCTGTGGGTTTGTAAAAGCATTAGAAATCAACTGGACTACTTGTTTCTAAAGATA
AGTCTCGCAAGTTTAATTATTTTCTTAATGGGTGGCGATTTTGAACATAGAAGAAATGTTAACAGTTGTTTCTCAAGTTTTCT
TCTAGTTTCAGAAGAAAAGGTTTGCAGGGAGGAATCTGGGACCATCTTTCAAGTCTCAACTTCAATGTGATTATCTCAGTAAA
TATTTTCTGATACCCCTGAGCAGGGTAAGTCTCATATATGTCCTAGAAACTGCAAGTAGAATTCTAGGCACCCCAACTGACTG
AAGGGAACTTTTCTCTTCAACGAGGAGTTCCATGGACACTAGAAAACCTAGTTTAGGCCGTGTCAGAAATGGAGGATCAGAAA
TCCCTCATTATACCCTCCTCCCTTTGGAATTCAAGCACAAGTAACCAGCATTTTCCTTAAAACAGATTTAAGGCTCAGAAAAC
AGATTCCGTGTAGCAGTAAAACACCAAATTCTAACCTGACTCAAGAATAGCATCACATGACAGAGAAAAGGCCTTGGAAGGAA
TCAAAGTCTTTTACCCTAAAATATATGTCTTTGACATATTTTAAATCACCCTGCACAGTTATCTTTTTGCAAGAGAAATTTA
CATTCTGTAGAGAATCGCTTCCCTTTGAAGGTGTTTGTGTTATACTGAGGTATCGGGGAAATTCAGCCAGATACTGGGAGAA
ATTCACCCCGATATTTCACGTAGATTCTTTTCTATTTTCCTTAAGTGTCAGCCGGTCTGAGAAATAAAGGGACAAAGTACAA
AAGAGAGAAATTTTAAAGCTGGGTGTCTGGGGGAGACATCACAGTTCGGCAGGTTCTGTGATGCCCCTGAGCCGCAAAACCA
GCAGGTTTTTATTAGTGATTTTCAAAAGGGGAGGGAGTGTACGAATAGGGTGTGGGTCACAGAGATCACTGCTTCACAAGGTA
ATAGAATATCACAAGGCCAATGGAGGCAGGGCGAGATCACAGGACCACAGGACCAGGGCGAGATTAAAATTGCTAATGAAGTT
TCAGGCACGCATTGTCATCGATAACATCTTATCAGGAGACAGGGTTTGAGAGCAGACAACCGGTCTGACCAAAATTTATTAGG
CGGGAATTTCCTCGTCCTAATAAGCCTGGGAGCGCTACGGGAGACTGGGGCTTATTTCATCCCCCCGCTGCGACCGTAAAGGA
CAGCCGCCCCCGAAGCGGCCATTTTAGAGGCGTTTAGAGCGTTTCTGTCTTCTCTCCCAGTTTCTACGAGTTCCTCCAGTGC
CTGTAACACAGAGCTGTTAGTGGCTTTGCCCCTGCCTGTTAATTCTTTGGTCATGTAATGGTGGTGAGGGAGCTGGGTCTGGA
TGCATTTCAGCCACAGCTGCTGTTCCACTTCCCCACACAGAACCATCTCGGGAGGAAGAGGTTGGAGATTTTTCTGATGTGTC
CTCAATCCTGGCAGAAAAGGTTTCAATAGCAATAGGATTCCCTCAGTTGTATGTCCTCTGATAATTTAAACAATAACTTCTTT
ATTATACTCAACTCTAAACGGTCTAAAGAGTATGTCTAAGTTAACCCTGCATTCGCTTATATGACATTTGCTCTACCCCAGAT
AAGGTCATATTCTCTTTCTGTTTGTTCCTGCAAGTCACTGACTTTCACAAGATGTAAGGTCCCTTGTTTGTCCTATAACATCA
ATAATCTGATGTTTTAAAGAAAATATGCTAATTTGCAGCTCAGTAAGTTTAGTTGTAAAAATAATACATTTTTTTCTGAGATG
CCTACATCTCCATGCTGAGTTGGAGCTTTATTTGTAACACTCAGAAACTGGAAATAACAAAAATATTAAGGAGCTTTATAAAT
AGTACGGGCACACTCATTAACTGGAATTCTGTTCCTCATTACAAGGAACATATTCTTTATACACAACCAAACTACTGACTCAC
AAGTAATTGTGCTGAGCAAGAAGCCACACAAATGAAATGGAAACTGTAAGGTTTCACTTTAACCAAATTTTGAAAAATAGACC
TGAAGTAGCAAACATGAGAGACTGACTCAGTGTAGTGAGCGGAAAATGACTGGGAGGCAGGAATTAGAGGAAACTAGGGAAAC
CTTGAAGTGTAATTCATTGTTATCTTGATTGTTATTTTGGATGCACAGGTAAGCACATGTGAAACTGCATTTTTTCCTTTGGA
GACATGGTCTTGCTTTGTCATCCAGGCTGGAGCTCAGTGGTGAGATCATAGCTCTCTGCAGCCTCAGACCCTGCGTCTCCACC
AATCTTCCTCCCTCTGCCATACGTAGCTGGGACTACTGGTATGTAAGACAATACTTGGCTTCAGTGCTTATTAAAATGCACAC
TTTAATTAAGCAGTATTTGTTATACAGCAATCATGCCTCAATAAGAGTATTGCAAATAAGTGGATAGATAATTTGTTCAATAA
AGATTGATGGAAAGATAGATGCTAACATGAGAAAATGCATGACACCCAAGAAAATAACACTGTAGGAAACATGCTTTTCTTTA
CAATTGTTAGGTAATCACAACAGAGCATACACATCACACCATGTTCTCGTTACAGAGAAAAGGTTCTGCAAACCTCACTAGCT
GCAACCCCTGTGTGCTGGGCTTGGTTCAGGGAGAAGTCAGGTCCAGTGGTGAGAAGCACAGGCCCAGATAACCAAGCTCACTC
TGACCGAATGTGAGCCCTGGGTACATTGTACAACCCATCTGTGCTTCTGCTGGTAATTTTTCATCTGTAACATGGAAATGACA
TTGATACTATATACACATGTTTCCTCTGCATATGTAAAAATAAAAGGTGATTGGTGCTAACTTTAAATATACACAGTTTATGTA
CATTGATTGCACCTCAATACAACAGTTTTAAATAGATATTACAACATTATAAGTTTTATAGGTTTAATATTTTATCACAGAAC
AAACTTTCAATAAGAAACCACAATTTCCAAATGCTATCAATATCACAAATCTCCCCAGGACACTCTCACATGCTCTGAGCCC
CACTCTCTCCTCAGGCGTCCCATCCCAGAGCTTGGCATGTAGTAGGAGACATGCAAATAGAGCCCTCCCTCGGCTTATGAAAA
CCAGCCCAGCCCTGACCCTGCAGCACTGGAAGAGGAGCCCCAGCCCTGGGATTTTCAGGTGTTTCATTTGGTGATCAGGACT
GAACACAGAGGACTCACCATGGAGTCATGGCTGAGCTGGGTTTTTCTTGCCGCTATTTTAAAAGGTAATTCATTGAGAACTAT
TGAAATTGAGTGTGAGTGGATAAGAGTGAGAGAAACAGTGGATTTGTGTGGCAGTTTCTGACCAGGGTTTCTTTTTGTTTGCA
GGTGTCCAGTGTGAGGTGCAGCTGGTGGAGTCCGGGGGAGGCTTGGTCCAGCCTGGGGGGTCCCTGAGACTCTCCTGTGCAGC
CTCTGGATTCACCTTCAGTGACTACTACATGAGCTGGGTCCGCCAGGCTCCCGGGAAGGGGCTGGAGTGGGTAGGTTTCATTA
GAAACAAAGCTAATGGTGGGACAACAGAATAGACCACGTCTGTGAAAGGCAGATTCACAATCTCAAGAGATGATTCCAAAGC
ATCACCTATCTGCAAATGAACAGCCTGAGAGCCGAGGACACGGCCGTGTATTACTGTGCGAGAGACACAGTGAGGGAAGTCA
GTGTGAGCCCGGACACAAACCTCCCTGCAGGGGTCCCCAGGACCACCAGGGGGCGCCAGGGACACTGTGCACGGGCTGTCTC
CAGGGCAGGTGCAGGTGCTGCTGAGGGCTGGCTTCCTGTGATGGTCTGGGGCTGCCTCATTGTCAAATTTCCCCAGGGAACTT
CTCCAGATTTACAATCCTGTACTAACATTTCATGTCTCTAAATGCAAAACTTTTTGTTCTTTCTGTATTTTTGTTTTTGTAA
CAGGAGGACACATTCTCGCCTCCACAGAAGCCACAGTGTCACTTTGGGGGCAGATGATCCTTCTGTAGTCAGCAGGATGAAAG
TGCAGAGGAATCTCAGTGGAACCTGGGAAGTCTTTTCCAGTTAGACTCAGGGCAGAGACCTCCATGGGAATCTCTGATTAGAA
CAGGCTTTGAGTTCTGATAGGAGCCAAGAGAGGAGGCTCACCCAGGGTCAGAGTCCTTAAAACCTGACGGTTTTCACAGCTATC
TCACCTCGTCTTGAAAAACTGTGCACATCTGACTCACACTAATTCAGTTGACCTTATTTCTGCTAATCTATTTTCCTTCTCTG
```

FIG. 6 (Cont. 8)

```
CAGACTTGATTCTCACAGTTCCCTTTCTTCTTCTCTTGCCTGAAAACAGAGGATGTGTTTTCTGTAGTCAAAATCCCAGAGAT
CAGGTCTGCAGGACCTGGGTAGGCTGAGGGGACTTTCTCACTCACCATAGCCTGGTGACACTCCTGCTGTATTTTGTATGTGG
AGGTGTTTGGAAAACGAAGTGAACATTAGTCATGAAGGGAATAATACTAGTTTTCTCCAAAGGGATGTGGATGTAGAGCTGAT
CTTGTGCTTCTCACACTGTCACAGAATTTATGCTCTCCCCTGTGACTTTAGGAGAGCTGAGGATGGACACTCCATTGTGCTGT
GAGCTCTGGTAATAGTAATTATAGGGTCTCGCTAGGCAGCCTAAGGTCAATACTGCTGGCCTTCGGGAAAGGCAGGCTGGGAT
TCCTAGGAAAACCTGCATCTGCCATCCAGCATGGAGTCCCATCGTCTTCTGTTATGCTCTGATTGAATCAGGCACACCTAGGT
TATCTAGAACACTCTTCGTGACTTGGGAAAAATTAGTGGCAGGCTCTACTAAGACCTGCATTATGCCATGGGAGCAACACCTA
GGCTAGTGTGTGATTGAGTAGGTGAGACTATGGTCTAGTCAAGGTGACAGGGAAAATTGTTGCCATTATTATGTTTTATTTTA
TATTTGGCAATATAGTCATGCTCATATTACAAATATCTTTCTACATTTTTTGTGTCAGAAGCTTTTGAACAAGAGCAACTTCA
TCTTGAATAGAGGCTAGGAAAAATAAGACTGAGACCTGCTGGGCTACATTCCCAGTAAGTTAAGGCGTTCTTAGTCACAGGGA
TGAGATAGGAGGTCTGCACACGATCCAGGTTATAAAGACCTTGCTGGTAAAGGTTACAGTAAAGAAGCTGGCCACAGCCCACC
AAAACCAGGATGGCAAAAAAGTGATCTCTGTTCGTCCTCACTGCTCATTATAATGCCTTAACATGCTGAAAGCCACTCCCCTC
AGCGCCATGACGGTTTACACATGCCATGGCAACATCAGGAAGGTTCCCTAGATGGTGTACAAAGGAGGGGAGGACACCTCAGC
TTCGGGAATTGCCCAGGGACTCATGAATAATCCATCCGTTGTGAGAAATACATTCATCCCTTTGAGAGAAAATGCACAGGGGG
TGGAATGAGGCTGGGAAGCCGATGGCACATGGTGGAAGCCTGTCCCTGAGTGAAAGACGAGGGGGAAGCTGGATTGGGTGGAAG
GTCCCTATATTTCTGTGCTGTGCAAGGGAGGGGCAAAATATAATTGAGTCTCTTGTAAGTCAGTGTTTCCTCTCAGGGGATCC
CCATGACTCCCAGAAATAATGGCTCTGCTTAGGAATCCCTGCAGAGTCACTCCTTTCATTAGAGTAGACCACAGGACATGGGC
CTCAGCACACGCCATGCCACAGATGTCAGAAAGCAGCTGCTGGGAACCTGACCCACCTGCATTTTGCTGCCTGTAGGAGGAGG
AGGACGTGCATTCTCAGGGCCAACACACTGTTTTTGGATTTTTATAGAGAACACCTGCTTTTACTTTATTTTTTGGAAAAATA
TATGAACAAATGTGCACCTGCAAACAATTGTAATTTTCACATTTATTTTAATTGCATTTGTTTATAATTGTGCATGAGGTCCT
GGTGCAGAGTTGAGTTTTTCATGGGAATTGTTCCAAGAATCAAGAACATCCATTTTCCACTTTCACTGGTTTTTCCCCATGTG
CAGAGACCTTGAGTAGAGCACATCTGGCCCTTATCCACACTATCTCTTGTGTCCCGGGAAAGACAGGGATTTGCCTGACTGC
AGAATCTAGGGTAGGAGTCTGCACACGTCTGAGCCTGCAGAGAAGCCCAGTGAAGTTTAATGAAGTCAGAGAGCTTTCCCGTG
TGGGGAACCTCTAGCTTCCTCACTCTCAGAGATTGCTGGTCAGCTGTAATTGAGGGGTTAAGAATTAGAGCACCTGGGAGCCT
GTCTCATCACAGCTCCATTCTGTAACTTACCACCATCAGACTGCAGGTAATAACTCAATCTTGATTTTTCTGACCCCATCTTA
TTCATTTGTAAGTTTGGTTATACAAAATGTTACATTTTAGTTTCTGATTCAAACCTCAGAATTTTGTGAATTCATCAGGAATA
ATTAAAAATGTGTCCAGTTTTTGGGAAATGTAAATTAATGTCCATACTGTTTATGTGTGTGCGTGTGTGTGGGGGGATA
TGTCAGTCACTTACACCCCAGTAAAAATGATTCCTTAATTATATAGTCGAACTGCAATTAGATTTGCTGAAAATTGTCTACAG
TAATTTCTGTGAAGCTGACCTTGCCACCTTGCTGTGAGGATGCTCAGTGCACAGGTGAGGTCTCACAGGAGAGATCCAAGGTT
CAGCCCCCAGGACTGGCTGAGCTCCTGGCTTGGAGCCAGACATAGGACTGGGCATCTCAGAAGCAGATCCCCTGGCCCTCCTT
TATCTGGGCTGTATGGGCAGCAGAGGACAAGCAGAAGAAACTCAGAATTCAGCCAAGACAGAGCCCCATTTAGGAGCAGGTGC
ATCAAGGAACCAGCCAGAGAACCTCTGACTACAATCTAGGGTTGTCTTCTTTTGCTTCACAGCATCCAGTCCTAAGGAGACCA
CCCACTATATCATCTGTAACTCAGAACTTTCTTGTTACAAAGGAAAACACAAATGAATATAACTCTGCAGTTAACTTCTTGAA
CCTGGATTGATGAGTTTCCACGGCCTTATGAGCACAGAGACCACATCCAGTGCAGGTGCAGAGCAAGGCTGCAACAGTCAGCC
TGCTGCTCCCTCAGGAGTCTTCCAATTCCCTTGTCCAAAGCATCCGCTCATTCATGGGCTGAGAAAAGGGAAGTCATTCATGC
AGTCTACTCTCTCCACAGAACTGACGGGGCACAAGGACAACATCGATTTTTCATGGAACATGCCTCTAGGAATGCAGCTGTGT
GCACACACACTGCTAAGCACACACTTCTTTACATAATTACTTGTAACTGTATTTTCTTATTTATTCTCTCCAATTTTTTTACA
CAAATTCATCACTTTTCCCCATAATCAAAGAGGATTTTGATCAGAATGCTTGTGGGGAGCCCCTTGCCCCCCAGATGCCCACC
ATCATTATTCTTGAAGGGAGGAGGAACGGCAGCTCTCTTGATTTCTACTCTAATCCTCTAGGACTAAAACCAGAAGGTTGCAT
GTCCGGTGCGGGAGCATCGAAGAAGATCCTGTCTGTAGAAGCAGGAGCGTCAAGACTTGACTGAGAGCCATGGTGCTGAAATG
AGATAGATTCCCTGATGGAGAGCACACGTGGACCCCCACACCTGAGGGCTCACTGCTCCTCACCACAGATGCACTCCCCTACT
GAGTCCTGAGACCTGAGTGCACCCCATAGAGTAGGGCTCAGATGAGGGGATGCAAATCTCCACCAGCTCCACCCTCCCCTGGG
TTCAAAAGACGAGGACAGGGCCTCGCTCAGTGAATCCTGCTCTCCACCATGGACATACTTTGTTCCACGCTCCTGCTACTGAC
TGTCCCGTCCTGTGAGTGCTGTGGTCAGGTAGTACTTCAGAAGCAAAAAATCTATTCTCTCCTTTGTGGGCTTCATCTTCTTA
TGTCTTCTCCACAGGGGTCTTATCCCAGGTCACCTTGAGGGAGTCTGGTCCTGCGCTGGTGAAACCCACACAGACCCTCACAC
TGACCTGCACCTTCTCTGGGTTCTCACTCAGCACTAGTGGAATGTGTGTGAGCTGGATCCGTCAGCCCCAGGGAAGGCCCTG
GAGTGGCTTGCACTCATTGATTGGGATGATGATAAATACTACAGCACATCTCTGAAGACCAGGCTCACCATCTCCAAGGACAC
CTCCAAAAACCAGGTGGTCCTTACAATGCAACAACATGGACCCTGTGGACACAGCCACGTATTATTGTGCACGGATACCACAGA
GACACAGCCCAGGCGCTTCCTGTACAAGAACCCAGGTGTTTTTCAGTGGTGCTCCCTCCCCACTTCTGCAGAACAGGATAGT
GTGGCTGAGATGCCATTTCCTGCCCAGGGCGTGCGTTTCCCATCCCCATCTGACTCAGAGCCTTGTTTTCCTCCTTTTTCTTT
ACTAATAAATGGCATGTCCCCTGTTAGTGGTTCATGCAAGCAGAAGCTGTATCCTGTTTGACAAAGATTCAGCATGAAAGGTC
CTGCTACCTAAAAAAAAATAGACAGATGAGATTTAATTAACCTAAATAATTTTTTTCACAACAACAGAGTGAATACGCAATTT
ACAGAATGACAGAAAACTTTTGCACACTTTGCCTGTGACAGGGAACTAATATGAAGAATTTGCAAGGAACTCAAACAACTCTA
CAACAACAACAGCAACAAGAACCAAATAACTCCGTTAAAATGAGCAAAGGACATGAGTAGACATTTTCAAAAGAACACATAGA
AATGGATAATAAATATATAAACAATACTCAACATCACTAACCATCAGGGAAATGCAAATTAAAACCACAATAAGATATCATCT
TCCACCAGTCACAATGACTATTACTAAAAACTCAAATAATATCAGATGTTGCTGAGGATGGGAAATGAAGGCAACTCTTAGAC
ATTGTTGATGAGGATGTAGATGAGTACAACCTCTGTGGAAAATGGTATGGAGATTTCCCAGAAAACTAGAAATAGAACTGTCA
TTTGGTCCAGCAATCCCACTACTGGGTAACTACCCAAAGGAAAATAAACTATTATTTCAAAAAGATACCCACCTTCTATGCTT
ACCATAAAACTACTCTCAATAGCACATATGTCAAACTGAGTGTCTGCCAACCGATGATTTATAAAAGAATATAGCATGTATG
CACAATTCAATACTAGTCAGCCACAATAAGGAATGTGTCTTTTGCAGCAAGATGCATAGAAGTGGGGGACAATATAA
TTAGTGAACTAACCTCACAAACAGAATGTCACATGTCACACATTATTACTTGTAAGTGGGAGGTAAACAGCGTGTACACAAGGA
TTTGTAGAGAAATTACACACATTGGAGACTTACAAGGATGGGCGGGCAGAAGGTGGGAGCATGATGAGTCATTACATAACA
GGCACAATATAAAATAATTAAGAATTGACCAATGATCTTAAAATTAAAATGTAGAATATGATCAATAAATGAACTTGATATTA
GTTGACCTCATTAAATTTAAAAACTTTTTCTACTCAAATGACTGTAAGAAAATGAATGCCCGGTTACAGATGAGAAACTGTTT
GCGAGTCAAATAACCACCAATGTAACTATAATAAGAAACTTCAGAACTCAACTGTGAATAAAAAAGAAACAACTGATGGATAA
ATTAGGCAAGGGTTTCTACAGACATTTCGTCAAAGAAGATGTGCAGATGACACTGAAGCATATAAACAGGATCTCAACAGGAT
```

FIG. 6 (Cont. 9)

```
TTTCCGTTAGAGAAATTCAAATCAAGCCCGCAAAGAGACACCACTGTACACTTTTTAAAATGGCTGAAATTAAGAAGAAATAC
AGATAACATCAATGCTGGTGAGCATACCAGGTTGCTAGAGGCTAAAACATTGCTAACAGGAATGCAAAATGAAACAGATACTC
AGGAAAATAATTTTTAGTTTTCTCTAAAATCAAACATACCCTTAACACCTGAATATTTGCATCAGAGAAAAACAATCTTACAT
TCACGCATAACTTCTATTCAAATATTCAAGATATCGTGTGTATGTGTGTTAGAAAGTAAAAATAACATAAATGTCTCAAAATT
TGAATAGGTGAAGAACTAGGAAGCATCTATAAATTGAATACCACCAGCAATAAAAAAATAACAAGTGACCGATACATAAACTA
TTACAGGTGAACTCCAGACATTGTGCTAAGTGAGAGAAGCCAGTCTCAAAGATCAAAGGGACACAGCTGTAAGCACCACGGTC
ATCCTCAGGTGTCAGTGGTTTGGGCTGGACTTTCTGTGTCTCTTTCCTGACCAGACCCAGATATTGAGCTCCACCACTTGCAG
ATGGAAAATCCTATTTTCAACCATGCAGTGAGGTTTGAACTGCTTCACAGACTGAACGAAACAAACACGGGCTCCTTTGAACA
GCGTCCGGCATTTGTTCCAACCACAAGAGAACGTCCCTCAGCTCTCCCACCTCCTCGGTTCTCTCCTGCAAGCCAGCAGCCCT
GCAGTTTAGCCTGCATCTCCCGTGCATCCACCCATCTCCCTCCAAGCACCTTCCCCCACACCCTCCACTGTTTCTGAGAGCAC
AGGCAGGCTTTGAACTTTTCCGCATTCTGTTGTTATTGAAGTTAGGATGTTTAGGACCAACTTAAGGATCATATTTTATGACT
GAATTCCAGTGCCCCTTCTCTCCTGGGACAGAGTGCATAACCAAGTTCTGCAGGTGGAGACGAAGTTGAGCTTTTTTCTTCC
TCAGCCTAGGAGATGAGCGCTAATTGGAGGGTTGGCAGAAGCTTCCCACCATCCCAGCACTTTGGTTCTGGTGGGCGGAATC
GGTGCCATAGGGCAGAGCTAGAAACCGCGGACTGAATGTTCCCAGTGGCACTGGACCCAGGGCAGAGCCTCCATCCACGAGTG
GGGCTCTATGGAAGAAGTGAGTCTCTGGCTCTCAGTAGCTCTCGTCAGCACTGAACCTCAGCATCATGTGCTGTGTGCAGGG
TCAGAGGGCCAACGTACTGGCCCCTGGGAAAGCGTTTCCTCTGTGGGAGTTGGTAGAAGGTGTCCTGTCTTCTTGGCTGCAT
CTGTCCGCAGTGGAGTTTACATCATGCTGAGCTGGGATGTGGAAGGAAGGAAGAGCATCTTAGATCAAATATGATGACTGGCC
TTACTGAGTTTTCTAGATTTTCCTGAATAAATGTTTCTTCACTCACTGTGTGCTGTTAGAGTCTTTCCAAACCTGTAATTTCC
CAAAATAATTTTCACTGGTCTCATGAGGGCATGGATTCATTGAGCCCCTCATGCTGTCAAAGAGAAATAGAACTGTTTTTTTT
TTTCACTTCATAGCGAACATCCATGGGTTATCAAATAATGGGCTGGCTTTTCTTCCAACACTTTACAGACACCATCAATTTTC
TTCTTGCTTATAAGGTTTTAACCAGAAGAATGCTGTCATGGTCTTTTCTGTTCTTTTGGAAGGAATGCCCCCTCTACTCACCT
CCACTTGTCTGCCTGTATTTCTATTTGTCTTTGGTTTTCAACAATTTTAATAAGATTTACCTAAATGTGTGTGGGGGGAGCAT
GGGGTGTTATTCTGCTGTTCTGTGTTCTCTGAGATGCATGGATTCACCATTTACTCTGTCTCCATTTTTGTGAAAACAATTAG
AAAAAAAGTCAGTATGAGCCCAGAAACAAGCCTCCCTGAAGTGGGCACAGGACCACCTGGGGCGCTCAGGACCCACTGAACA
CAAGAGCCAGCCCCAGGGCAGGTGCAGATGCGGGTTAAGTTCTGGTTTCCTGTCAACCCTGTGGCTTCCTCTCCATAAAACAG
TTTCCTTTGTGGCATATCTCTGGATTCCTTATCCTGTTCTTCCTGTGAAGTCTCTGAAGAAGAAACATTTGTCGTAACAAGAG
AAAAACTTTCTCACATGCACCAAAGGCAGAGTCACCTACAGTCACTTACTCCTGTTTCTCAATGTCAATAAGTTACCAATGCT
TCTGAAGTTAATCAGCTAAATCTATAAAAGGTGCGGTGTTTAACTCAGCATTACAGCCCAGCTCAACAGAACTCCAAAGGTCA
GCCAGCAGCAGCCAGGAAAAAGTGCATGCTGGGCATTGGGCAGAGGGAGTTACCATCCAGTGCAAGAGAAGAAAGCCCCGT
GGTGGTCATTGTCAGGACTCCAATCCCACAGTTCCAATTGTAGGTGATGCCAGGCAAAGGAAGAGAGACCCCACCAATGGTTA
GTGTGGATGTCGAGTTTGATGTTTCCACACTCACACTCCAGGTGAATATGAAAAGATTTATTAGCTCTATTTCTGAGGTGTCT
GCTGAGAGCAGCACAGTCCTCTCAAGAAATTACAGATTGGAATTTCCTCAGTAGAGCAGGAAAGGAGGCTGGCTCAGGGCTTT
ATAATGATTTGGTGGTGGGGTCGGCGGGGGGGGGGGCGTTTCTACTCAGGAGAAGGAGCTTGTGTGATTTAAACCTCACAC
TGACATCACATGAGGGAGCTTCCATGATTTCTTACTAGATTTCCCATGTGTGGGGACAAGGATGAGGGAGAATAAACCTTAA
TTCATCAGCATCAAGGCACCAAAAATAGGACCTGACACTTTATTCTCCCTAGCAGCTTAAGAAAATGAGTGAAAAAGAGAGAT
AAGAGTCCACCCATGTGCTGAAAAGCATAGCTCTTGGTAAAGACGAGAAAAAGGCACTCCTACGAAGAAGGGGTTGGGCAGAA
GCTTTATGCTGAAGGGTTTGGCTAAAGAGACATAATCAACAGGTTACAGGGGGGCTACTGATGTTCATGGAGGTGGTCCTCA
CACATGCATACTGAACAAACATGTCTGTAACGTATGACCCCTGTTCACTTACCAGTGGAGACTTAGCATTTAAATTCATTCCA
GTCAGGCCCTATGTGCAAACAGCAGAAGCAGAGACACAAAGGTACTCAGGGTGCAGCCTCTGTGAACGGCCAGAGCCAGGCCA
TGGTCAGCGGTCTCGGATTAGGAGAAAGTTCCTGATATCACTGTAGTGTTCAATCAAAGCTGGGGTTATGGTTTGTGGAACAG
GGGTCAGTTCATCAGGGGGTGGGCTGCAATTGTCTTCATAGTGCTTGTCTCAGTGCCGGTGCTTACTGAGCCACTAGAGAAAA
AGGTTTAATTGAGCTTCTTTAAAATCAACATTTTGAATTATTTATCAGACGTTTCAAATATGTCATGTTGTTTAGATTCTATT
GCTGGAGAGTTAAGGTGATATTTGGGGTTTTGTAACTCTGTTTTTTCATACTTCCTGAATTGCTTATCTGTTTGCTTTTCATT
AGCTAAACTATCGCTTCTTCTTATTTTTAATTCATTCTGATTTTGATGAATATTTAATTCCCTTTAGAATGTGAATATAATG
TACATTGTGTGGGTATTTTGATTTTGGTTCTTGGTTTACTTAGTGGCAAAGACTCTGTAAGAGTTCCTTGTCTATAGATAGCC
ATTATTTAGTGGCTTTCTGAAATGGTGGTTTTAGTACCAAAGTACTGGACTTGTGAGTAGGCTCACTGCCCCCTGCAGGTCCT
AGATAGTGGAGGCCTCAGGAACTGTTTCTCATTTGGAATGCCTTTGTTCAGCAGATTTTGTGTTGGGTTGTTAAGTTCACCC
TCCACATTAGTAGATGTCCTTACAGATTAGAGCTGACTCTGGTAGAAGCAGTTGAGTGCATGCTTGATATCTGTGCACAGGGA
GAAGCTCTCTGTTGCCTCAGGCGATGGACTGGTCTATGAAATGCACAGTGACCTGAGTTCCCTGCTCAGCCCCTGAGAGGTGG
ACCAAGCTGGACACACATGAGCCACCGAGCCTGGCAAGCAAAAGCGCCAGCCTTGATGGAAATGGCGAGCTGAGCGGCATCTA
CTCAGTGTGGTTTCTTTTGTTATTAAGAGCTTTAGTGTGGTGGCTGTTTCAAATTCCCGTTGTAGTAGTAATATACTGGGTAT
GTGAGCAGGCCCGTGGTCTTTTGCGGGGTTGGAATCACCGAAGTAATGAGAAGCTAATCTCATTTTCAACTGCTGTACACTGG
TGGTATTGAGTTTGTATGAGGTCATGCAGTTTGAACGTCAGGCCAGTAGGTGGTGCTCGCAGGTAAGAGCCGGCTATGGTGGC
AGCAGAAGGGTTTATGCTTTACTGGTGATTAAAGTGGGAAACTTGGCGTGTTCCAGATCTTAGAGAAAAGATTTTTAGTTATT
TCTCATTCAACCTGATACTACCTGAAAGTCTCTCGAATGTAACTTTTATTTTGTCGAGATGGGTTCTTTCTATACCCATTTTT
TATGTTTTTTTTGTGAAAGGATGTTGTTTCATCAAATGCGTTTTCAGCATCAATTGAAAAAGTTATATGTGGATTAAAGATC
AAAATGTAAAACCTAACACTATAAAACCTCTGGATAATAACATAGGAAACAGAATTTAGGAGGTAAGAACTGACAAAGGTTTT
ATAATGAAAATGCTAGAAGTAGTTGCAACAAAATTGAAAATTGACAAATGGGACCTAAGTAAATTAAAGAACTTCTGTACAGC
AAAAGACACTATCGACAGAGTAAACAGGCAACCTACAGAATGGGAAATAAAATATTTGCAGCCTATACATCTGACAAAGGTCC
GACACTTAGTATATACATGGAAATTTAACAAACATACAGAAGAAATAAAAAGTGACCAAAGGACATCAAAAAACACTTCAAAAAA
GACCTACATGTGGCCAACAAGCATAGGAAAAAATGCTGAATATCACTATCATTAGAGAAATACATATCAAAACCTCAATGAGG
TACCGTCTCACATCAGTCAGGATGGCTAATCTTAAAAAAAAAATAACAGATTTTTAAGGTTACAGAAAAAAGGGGAAATTTAT
ACACTTTTGGCGGGAATATAAATGAGTTCAACCATTGTGGAAAGCAGTGTGGTGATCCCTCCAATAACCTAAAACAGAAGTTT
CATTTGACCCAACAATCCTACAACTGGACATATACCTAAAGGAATATAAACATGTAGGTTCACTGCAGCACTATCCACAATAG
CATAGACATGGAATTTACCTAAATCCCCATCACTGGCAGAATGATAGAGAAAATGTGGTACATACAACCATGGAATACTATG
CAGCTAAGGAAAGAATGAAACTATGTCCTTTGTAGGAACATGATGGAACTGGCAGTCAATACTCTTAGAAAACTAATTCAGGA
```

FIG. 6 (Cont. 10)

```
ACAGAAAACCAGATATTATATATTCTCCCTTATTTGTTGGAGATAAATAAAAGCAAATATTCTTCCAGGGCCTGAGTCTTCCT
TATTCAACAAGTCATTCTAAATTAAGTGTTCAGCAAGTTGCTGATACTCATCTAAATATTCTATTTCATCTGGGCCACTTACA
TCACTCAAAAAGCAATGAGAGCTATATTTCTAAGGGGGGTTCTAGGATAATAAATACCTGAATAGTGAGAATATGAAGGATAT
GGAAACTGGGCCACTTATATCACTCAAAAAGGAATGAGAGCTATATTTATAAGGGGGGTTCTAGGATAATAAATACCTGAATA
GTGAGAATATGAAGGATATGGAAACTGGGCCACTTATATCACTCAAAAAGCAATGAAAGCTATATTTACAAGGGGGGTTCTAG
GATAATAAATATCTGAATAGTGAGAATATGAAGGATATGGATGGTTTTTTTTTAACTCAATGGGCACATAACTGTGGGAGATA
CTATATTCCTATGAAGAAGGTATTCAGACTTCAGAGATAAGTAATGTTCCTACATTGTGCTTGTGACTTGGAAGCAGTGGAT
TGAAGAGTGTGATAAGTGCCCAGACCAAGCAGAACAGAAATCAGCATGTAAAGATGATGATCTATGGATATGATCTAAAACCA
TGTAAATACTTCAAATAATTCTATTTAATGCAGTTTGAAATAAAACACAAACTTATTCAAAATACAAATTACTTGGTAATTAT
TTTGGGAGCTATGAGTTCACCAAGAAACTCAAATTCCTATTTCTATTTCAACCCCTGATTCCTACTGTCAATGGGAGGGAAGT
CTCAGAACCAATCACACATCAGACGGCAAATCTGTCAACCAAGAGTCTTCCACTGAAGGACCTGGGAGGTCAGGACCCTCAG
GAAAGTGCTGGGGACCCTGTCTTGGGAGTGCCCAGCAGATCTCAGAACTCTCCATGGGTCCTGCTGGACACTCATGTAGGGTA
ACGAGTGGCCACCTTTTCAGTGTTACCAGTGAGCTCTGAGTGTTCCTAATGGGACCAGGATGGGTCTAGGTGCCTGCTCAATG
TCAGAGACAGCAATGGTCCCACAAAAAACCCAGGTAATCTTTAGGCCAATAAAATGTGGGTTCACAGTCAGGAGTGCATCCTG
GGGTTGGGGTTTGTTCTGCAGCGGGAAGAGCGCTGTGCACAGAAGCTTAGAAATGGGGCAAGAGATGCTTTTCCTCAGGCAG
GATTTAGGGCTTGGTCTCTCAGCATCCCACACTTGTACAGCTGATGTGGCATCTGTGTTTTCTTTCTCATCCTAGATCAGGCT
TTGAGCTGTGAAATACCCTGCCTCATGCATATGCAAATAACCTGAGGTCTTCTGAGATAAATATAGATATATTGGTGCCCTGA
GAGCATCACATAACAACCACATTCCTCCTCTGAAGAAGCCCTGGGAGCACAGCTCATCACCATGGACTGGACCTGGAGGTTC
CTCTTTGTGGTGGCAGCAGCTACAGGTAAGGGGCTTCCTAGTCCTAAGGCTGAGGAAGGGATCCTGGTTTAGTTAAAGAGGAT
TTTATTCACCCCTGTGTCCTCTCCACAGGTGTCCAGTCCCAGGTGCAGCTGGTGCAGTCTGGGGCTGAGGTGAAGAAGCCTGG
GTCCTCGGTGAAGGTCTCCTGCAAGGCTTCTGGAGGCACCTTCAGCAGCTATGCTATCAGCTGGGTGCGACAGGCCCCTGGAC
AAGGGCTTGAGTGGATGGGAGGGATCATCCCTATCTTTGGTACAGCAAACTACGCACAGAAGTTCCAGGGCAGAGTCACGATT
ACCGCGGACAAATCCACGAGCACAGCCTACATGGAGCTGAGCAGCCTGAGATCTGAGGACACGGCCGTGTATTACTGTGCGAG
AGACACAGTGTGAAAACCCACATCCTGAGAGTGTCAGAAACCCTGAGGGAGAAGGCAGCTGTGCCGGGCTGAGGAGATGACAG
GGGTTATTAGGTTTAAGGCTGTTTACAAAATGGGTTATATATTTGAGAAAAAAAGAACAGTAGAAACAAGTACATACTCTAAT
TTTAAGATAAATATTCCATTCAAGAGTCGTAATATAAGCCAAATTCACAGAGTGGAAAAGGCCACACTCTATAACGTTGATAC
AAACATTCCATGAAGGTGCTACTGTGAACAAGTTTTCAAATTGGATGAATACATGATTTGGAGCAAGGTTATTTGATCATGTG
GTGAGACTAAGAATGATTCTTAAAAAGTGCCAAAAGTTTCCTTCAAATGTTTCTGTCACTCCTTATCATAAAGTTTATTTTAC
AGCAGTTTTAGGATTACAAAGAAATTGCACAGGAGGCGTGAGAATTCCCATGACTCCCTGCCCTACACAGGCACAGCCTCCTC
CACTACGACCATCCTGCACCGCAGTCACAAATCAGTTACAATGGAGGAATCTCCAAGGACGCTTGGTTCTTTCTTTTTCTGGT
GATCTCCTAATATAACAAGCCTAAGTATCTCAAGATTCCACGGTTTTTTCAGTGTTTTCTAGAACTGATATTAGTCAGAGGGA
AAGTGGGTAAGGCTATTACTATTTGAACTCTTTCTTCCAAAATCCACAAAATATATATTAATTTAGAGCTTATCTTACTTCTG
GTTTACAATGCTCCTTCCCAGAGAGTAAGATTTTTAAGCTTTTAGAGGCCAGTTCATGTCTCTAAAAGACCAGAAAGTTCTGG
GGAATCCCATAATGAACATCCTTTCATTGGAATTGGAGACCCTGGCAATGAGAGATTCCATGTATAATGCCCTAGAGTTGGAT
TAGGTGCACTGTGAGCTCTTGGGTGGTGAGTCTGAGTAAGGTGGTTTGTGCAGCAAATGCAAACACATTCATGGGACCCAGGT
AGGAACAAAAGCTTCCCTCTGCAAAGGGAGTGTGCACCTGAAGCAGCCCTCACAGAGGTGGGCACTGCTTGCCCTTGATGAGT
GCACATTAGCCAGAGGCATGATCATGATTGGTCTTGCAGATAAAGAGCACCACTGAGGTCATAGGTTATGAAAATGTTTGTCA
TCCTCCAGCTGAGCAAGTCCATCTGCTTGTTTGTGGGTGTCAACTCCATAGAGGGTGCACTTTGGGAGATGACAAGATGCGCA
CAAACCTGCTCTCACTAATTATCCACTACCACACACTCAAGACCAACCTGTGCTCCGGAAAGGAATACGTGCCTGTGGAAATA
GACAGAGCTTAAGTATTTTGTAACCTGGTGAACATACTGCCCAAAGCCACACGTTTCAGGAAGATTAGCTCAGAAATGTTCAC
CAATTGACTGAAGGGCAGTGGCGGGTGAGGTGATGGGACAGCCTCAGGGCTGCACATGAGGAGGGCTCCCTCCCCCATGCAGG
CTTTTCCTCCAGGAGCTGCATCAGGACCTCAAGGAAGATCAGGGAGAATTCTGAGAACACCCTTCTGTGGAGCTGCCTAGAGA
AGAAGAATAAATATGAAAAAATACAACTCTGAGTAATGCATGGATATTTGTTCATGAAAACTCTCTCTGAAAGCTTGTGAAGG
TCTCGAAATACCCCTGATTAGCTGAAGACAAACATTTAAACCCTCCTTCCACAGGGAGTTCAAGCAGGCTGGATGTGTCCTTC
TATGGATGATCTTCCCCAACCCCTTCCTCTTCCCAGCTCATCCCTGGCTCTCTGTGTAAACAGTTCTCATCAGTGGAATGTGG
TTGATGAAGTGACGTCTTCAATTTCCTCATCTTCTTGGTGGTCATGTTATTTTTTTTCATCTGAGGGTTAAAAACTCACCTGC
ATGCAGCACATGACAGGCTAAAATCTCTTGTGGACAAAACGGTAACAAAGGCACCCACCAGGGTTGAGCATCCGTGTTGCTGA
CAACGACCACCAGGGGTCAACGTCCTCTTCACAATCCTGTGTCAGAGCATCACTGGAATGATTTCATTAGCAACTTCCCAGGA
GAATCAGCTTAAAAAATACTTGTCCCATTTTCCATGCAGATATAACCCATCCCTTTTCCTGAAGAAACAGACTCAATACTAA
ATACACTGAATGTTGTTTTGCTGGTTTTGTAAGTTTGTGACTTTATCACTTTCTAATTTCTGAGTTAGGTGGACCACTCTAC
ATATTTCTCTCATGGGTGTGACCAGCCTTCTGGATGTCAAATATAACTGACTTTGTTCGTGTAAATGTCAACACAAGCTCTTC
ATGGTTTCGGTGCTCACTGACTACTCTAAACTTACACAATGTGTTTCTTATTAGCTTTGTTTTCTGGTATCTCTACGTGGCT
TATTCATCACGCCCATTTTATGTTACTTGTACAGGTAATTGATTGTTATTTTAAAATTTACTATTGCTTACTTTAATTAAAT
AAGTAGGCAATAGCTTAGAATAGAAAATAAGGTAAAGTAAAAGTACATGCAGTAATATTTAATATAAGTAAGCAGGCAGCTGA
AAGCAAGGGAAATCTACTCTGCTGTGTAAAAGGGTATGGAGACCTCACAGTATGATGATCTTCTGCAGTTTAATCCATACTGC
TACATAAGTGACAACGTCCACTCTGTTTATATCAGAGCTTCCCCTAATATGTACAATGAAGACTGAGCCCAGGTACCTCCAAC
CAGAATGGCCAGCACCTTTTACCAAGTGCCTGAACTGACAGCAATAGAGATCACGTTTGTCTAAAAAAAAACTCACACTGTAA
GGATACCCACCAGTCATATGGAGACAATTAGAAAAAATTAAAGCCCAAGCCTGATAGGTAGTAATTTGTACTTAGAAGAATTA
ACTTTTATCTCCACATGTTTTTTTTTAATCATAGAGAAACTACTAGTGGTAGTTCCACTGTCCAAGTTACTGAATATCTTAT
TCCTAGAATGAGACACTGACAATGTGTTCTGACACAGAGTAGCTGTAGTTAAGGGACAGGAGATGTGATCACGGGAA
CACGAGTCTGCGATCCAGCAGTTCTTGCTCCTTCACATTTGCCCAGAAACAAAGACCCCAGCAGAACAATGGAAGCATTGACT
TAGGCTCTCCACAGTCTGATGTGAGATAAACAGCAGGTAGTTTATGCCTCTGTTTTATAGCAGGAAATTTAATCTCTAAAGAAG
GGCCATTTTGGAGATAATACTATTCTCCAGGATGCTTAAATGCCCCCAAACAGAGAGCACTGCAGAGCCCCGTGGCCAGGAGC
TACAACACCTGGGTCTGGAAACCACTGGACAGAAATATGAGATTCTCTTACCACATGTATGATGGAACCTTGAAGAATGTTTC
CTTCCTTCTCCATAATCACAGCCTGCGATGAACTGGAGGTCCCAGTACATAAAAAAACATGTGTCTGCATTGGATACAGAATT
AGTCCCATAAAATAATTGTGCTACTGTGGTGCTCACACTGTTGGACCAGCTGACCAAGAAAGTGTTGTAAGAGCTGCAGTGTC
```

FIG. 6 (Cont. 11)

```
TACTGATTCCTACCATATTTGGGGCTACATTCACATCTATCAAGGGAAAGAGAGATAAGAAAATCTCTCTAGGCCGGGCGCGG
TGGCTCACGCCTGTAATCCCAGCACTTTGCGGGGCCAAGGTGGGCGGATCACGAGGTCAGGAGATCCGGACCATCCTGGCCAA
CATGGTGAAACCTCCATCTCTCCTAAAAATACAAAAAATTAGCTGGGCGTGGTGGTGGGCGCCTGTAGTCCCAGCTACTCGGG
AGGCTGAGGCAGGAGAATGGCATGAACCTGGGAGGCGGTAGCTTGCAGTGAGCCGAGATTGTGCCACTTCAACTCCAGCCTGGG
GGACAGAGCTAGACTCCATAAAAGAAAGAAGAAAGAAAGAAAGAGAGAGAGAGAGAAAGAAAAATAAAGAAAGAAAGAA
AGAAAGAAGAAAGAAAGAAAGAGAAAGAAAGAAAGAAAGAAAGAAAGAAAGAAAGAAAGAAAGAAAGAAAGAAAGAAAGAAAG
AAAGGAAGAAAGAAAGAGAAAGAAAGAAAGAAAAAGGAAATCTGGCCTAGTCTATTGATTTATTTTCATTTCTTCAAAATGAG
GTAAAAAAATCGCATCAACTAAAATGCGGACGATGATGAAGTGATCAAAGACAACAGCCACTCAGTGTTTCAGGTGTGTTTTA
ACCCAAAGTCACACAACATGTGAGAAGCTGAACTCCGGAGCCAGGGGCATCTCTGAGGAGAATGTGGAAGGTGGGCGGGAGGA
AACAGTGATTCATGTCTAGGGAAATTTCAGGGCTGCCTGCTCTAGGGGAAAGGAAAGCCTGAGCCTCTCCCACAGTGTGCTCT
GTTAAAAATTTTGGCTGACTTATTGTATTCTTCGACACAAATATTTTTGTTTCGTCCTCTTTTAAATTTTTTTATCTCTATTA
AAATTCTCACTTTGTTCTTGCATGCTGCCACTAGCTTATTAAACATGTTTCTAATATTTACTTCAAATTTTCTGCCAGGACAT
CCATATGTTTTTTTATTCATTGATGCCAGATTCTGGACCTCTATGTTGTCTGTCTGTTTGGACCATGTTCCCGTGTTTCTTCA
TTTTCCTTGACGGTCTTTCTTGCTATCCGTTCATCATAACAAACAGCTCTTTGCTCATCATAACAAAGAGCCACACTCTTCCA
AGCCTAGGCTCATAGAGACAACCCTCACCAATCACTCATCAGTGATTGCGGATCTCTCAAAACTTCATAATGACTTCATAAT
ATTCCAACTTCTGTCTCTGTTCTTAGTGGCCCCCAGGTTTAGAGAACGTTGGGTTGTGCCAGGACTCCCAAATAGGAGAGCTA
GAAACTATATACTCAAGTAGCCTCTTGAACAGTGTACCATTAGACACAGTTTTATTATTGAGGTATGATTCATCAAAATAATG
TTAGTTCAAGCGCCTCTCAACCAGTCATCTAACATTGAAATGTTATAATTTCTTATTTGGATCTCTCTGGAGTTTATCTTTTG
AATATTTAGGTAAAATTACAAACTAGTATAAAGCTATTTGGCAAAATTATCTGCTGCAGAAGTTTCATCTTCTGTGTATCTCT
TTTTGCACTTAAATATGTTTTTATTAGTCATGTATCCAGAATATAGAAATATGTCTTAAAGTTCCTTCATTTTTTTAAGGTTA
TGGGGTTTTCAGAAGAGGTGAGAACCTTCTTTATTTATAAAATACCTGATTCCACATTGCTGGATAGTTTCTTCTTTAATTTG
TCTCCTCCTCTCACATTATACTATATTAAGCAAGGAGAAATCAAAACACACCATCCACACTTTGCTTAGAAATCCCCAAAGCT
AAATTTTAAGTATCACTTACTAATTCTAAATTTTTACCCATTGTAACTTAATTAACATGAAATCTATAACAAGGTTACACATACT
TTCCCGTTCTAATACCATGTTCGTGACAGAAACAAAGCAGGTGTCTTCTCTGCAATGTGGTCATCTGAGGTCTGAGATGAGGG
GTCACACAGGTATTTTATAATATTTAAGGGTTTGGACAACAGTAGTGATAACAATTCTGAACAGCACTGGCTCCTAATTGAAA
GGTTATAGGTAAATTTAATGCTGCAATTTTATATTAACACCTTGTCCGAATGAAGCTCAGAGGAAGATGCCACATCCCAGGTC
ACACAGTGAGGAGGAATGGAGCTGTGCTCTGCTCTCCACACCACCTACAAATCCCAGGCCCCAGCCCAGGTTCCACTGGCGCA
CGGCACCTAGAGCACAGTTCCCAGGGGATGATCTCAGGGCACCTGCTTCCTCGGGCAGGGCGCTGCCTTCTCTCAGTTGTGCA
CTTGCTCCTCCTGCAGGTTCTGTAGTGAGCACTTGCATTGCCGTGATTTATACATGTTCTCTCCCCTAATATGGAAAAATAT
TTATTAAATTTTCAACTCATTTTCTCTGATGCACACTGCATTAGCAGAAAGGAATAAATCACATTCCTTATCCTCCCATAAAG
CCAAAGATTCCCGAAGACAGAGCTGATGTGATGTACTCATAGGTGGATCTCTGCCCCTCAAGGGAGGCCTTGGTCTTCAAGTT
TCAGTAATTCTAGGAAGCGAAGGACACCTACATCTCCTGCTCCCTGCTCTGTAGCTCACCTGAGAACAGCTTTCTCATTGGAA
TGTCTTGTGTTTAAGGAATAAGAGTCCATGTTTCAGGTTCGGGAGCCCAGGTGCACCTACTGGATGCAGCCCAGGATTGGAGA
CACTTTCCAGAAGACAACATCACCTGAGACATGACCAGTCCCACTGTTTCACTTTCACAATTTCAACTTCCTCAGAAGAAAAT
TAAAATTGCTGAGACTTGTTCATAAGTGTTGTGCCATGTCCTTACTCTGTTTTCTTGCCTGTTCATTTATGTCATACCAGGTG
TCTGTTATATGTAATAAGATCAAAATTCTGCCTCCAGTAACACATCAATGGAGACCTTTGATTGTACTTTTGGTTTATGCACT
GACACATAGATTATGATGTTCATCACATTCATTTTTATGTCAAAGGAAATCTGCATAATCTGAATGCCAATACTTTTTGGAAT
CTGCTAAGTAACTGAAATTGAAAAAAAAATACCCACTCAAGAACCTGGATAGACAGCCATGTCCAGAATGGCAGTTGACACTT
GTTTAACTGGAAGAGAATCTACAGAAGCCACAAGTTGTGAGGGCACTTACATGTAAGCACTATAGTTGTCTTAAAGACAGA
TGTGGACTCAGTAAATGTGACTGTTCCAGAGGGTCTTATATTTCTATGTTTTATGGACTTTCTCACCAGAAACCTCCAGATTC
TAAAAAATACTATCCAAATACGTTTCTTATTTGTCAGATTGGAGAAGATTAATTACTGAAAAATATTACGGGAGACTTTTTCA
AAAGCTTCTACATGGAAGGACTTTTCGAGAACCTTGTCCTATGTAAAGGAAGACAAATCTCCCATTCCAGATTTCTCTCCCAT
TCTTCCATTATTATAGAAATGAGCAAAGTTAGCCAATAGGGGTAAGATGTAAGTAAATAGTCCAGGGACACTGAAACCACAAA
AGGGAGTAATGGCCAAAGTAGCTTTTCCCCTGGAGATTCCTGGTCAAAGTCACAGCCCAGAAGAGGAAGCCGATCGCATCTCT
AGGTTTCCATTGTCAAAACAGGCAGTGCTTGCCTGCACTGCACAATCCATTCTAACCAGTGTGATAGCTCTGGATTAAAGATG
GAAGTGTGGCAATGCACAGACTCTATGTGAGAAGAACACTGGAAAACTAAAGGACAAAGGCAGAGAGTAGGACAAGGACGACA
AAGCAATCTGAAGCCTCTGACATCACCATTTTTAAGATCAAGGTCTTGGAAACTCCCTCATTGACCTTTAGATCTCTAGGAGA
AAAAAGTCAGATACCTGGGCCTAGTGTCAGTGTAGGAGGAATTTTCTATAGGCTAGGCATTAGGAAGAAGGGAAATTCTTCC
TTATTAGGAAGTTATTGTTATAGTGTTATAGTGTTATTGGAATAGTGGATATGGAGTGGGCTTTCATCTCGATCAATCTGCAC
CTGCTGGTATTTTCCAATGCTACATTCACCTGCAAGAGCCCAATGAAGAAAGAAGGCACTCCCAAATCTTTTGCAAGTTTTTG
TATTCACTGTGGGTCCACTGCTTAAGTGCATCTGGAGCTTCAGAGAAGGGGCTCTGTCCTGTGTCATAGAACCCTTGCTTTGA
GTCTCACGGCAGAGTTCAATCTGTTTAGTAAAGTTGATCAATTATTTCAAGAGATGGTGTCACCAGCATATGGTGTCACTGAG
GGAGTATTCTACACTAGCACACAGCCATTTCACGCTGGGCTAGAGAAGCTGGGGGAAATGCTTTGTGAGCCCAACAGGAAC
CTCCTTGCAAGGCAAGGGCTGGGCGGAGGGGGCACTCAGGAGCCACTCAGCACGGGTTCCAGCCCTGCAGCTGGTGCACAGG
AGGCTGCTGAGAAGGTTTCCTCTCAGGGCTGGGTCTTCCTTTGGGAGAAAAAGCTAAAATTCAATAAGTTGCTGGTGTGCC
CTTAAATATTCTATCACATCTGAGCTGCTCCCACAATTCAAGAGAAGGAGAACTATCTTTTAAATATTCTATCACATCTGAG
CTGCTCCCACAATTCAAGACAAGGAGAACTATCTTTTTAAAGTCGGCTTCTAAGATTATAAATACCTTAATAGTGAGAATATG
AAGAATAGGGATGGTCTTACTAATTCAATGCAGAGAGAATTATGGGAGTCACTATATTTCCATGAATAATAATTTCAGATTTC
AGGCTGGGGCTGGTGGCTCATGCCTGTAATCCCAGCACTTTGCGAGGCTGAGGTGAGCGGGTCACGAGGTCAGGAGCTGGAGA
CCATCCTGGCTAACACCATGAAACCCTGTCTCTATTACAAAAATTAGCCAGGTGGGTGGCATGAACCTGTAGTCC
CAGCTACTCGGGAGGCTGAGGCAGGAGATTTAATCCTACAAGACCTACAGTCTCAGACAATGCTGCTGTCAGTGATCGTGGGA
AGCAGAGTTTGCAGTGAGCTGAGATTGTGCCACTGCACTCCAGCTTGGGCAACAAAGCGAGATTCCATCTCCAAAAAAAAAAT
TCAGATTTCAGTGTTAAGTAAAGTTGCCTACATTGTGTGAGTGACAGGGCAGTGGTGGATCCGAGAGTGTGGATCTGAGAGTG
AGTCAGAAATCAGCATGTAAAGATGAGGATCTATGCACATGAACTGAAAGTATGTAAACAGTTCATGAAATTCTAATAAATCC
AGTAGGAAATAAAACCCAAACTTATCCAAAACACAAATTCCCTTGAAATTATTATGGGAGCATGAGTTCATAAAGAACTCCTA
ACTCCTGTTTCAACTTCTGAATCCTAGTGTCCATGACATAAGAAAATCATCTCCAATTATGCATCACAGGGCAAATCTGTAAA
```

FIG. 6 (Cont. 12)

```
CTAAGAGTTTTTCTGTTGACGATCCTGGGGAATCAGGACACCAGGAAGGTGCTGGAGAAACTGTCTCAGGAGCGCCCCAGGGA
TCTCAGAGGAACGTGCTGGCACTCACGTGGGACATCAGCGTGCACTTGCTCAGAGTCATCAGTGAGCTGTGCTGGTGTCTGACG
GGTCCAGCATAGGGCCAAGGCACCTGCTCTGTGTCATGGACCGAGATGGTCCCCAGAATGATCCAAGTGGTCTCTGTGCTAAT
CTAATGTAGTTTCACAGTGAGAGGCCGTTCTGAGGGGGCTTCTTCTTCAGTGAAAGGACCTCTGTCCACAAATATTCCTAAAT
GGACAGGGCATGCATTTCCTCAAGCAGGATTAGGGCTTGGACCATCAGCATCTCACTCTTGCAAGGCTGATGTGTCATTTGT
CTTCCCTTTCTTATCATGGATCAGGCTTTGAGCTATGAAATGCCCTGTCTCATGAATATGTAAATACCTGAGATCCACTGAGG
TAAATATGGTCTGTGCCCTGAGAGCTTCACCCAACAATCACATCCCGCCTCTAGAGAATCCCCCGAGAGCATGGCTCCTCACC
ATGGACAGGACCTAGAGCTAATCTTCCTGGTGGCAGCAGCTACAGGTAAGGTGCTCCCAAGTCCCAGTGATGAGAGGGGATT
GAGTACAGTCAAGGAGGCTTTCATCCACTCCTGTGTCCCACCCTCCAATGGGTGTCTGCTCCAGGTGCAGCTGGGGCAGTCT
GAGGCTGAGGTAAAGAAGCCTGGGGCCTCAGTGAAGGTCTCCTGCAAGGCTTCCGGATACACCTTCACTTGCTGCTCCTTGCA
CTGGTTGCAACAGGCCCCTGGACAAGGGCTTGAAAGGATGAGATGGATCACACTTTACAATGGTAACACCAACTATGCAAAGA
AGTTCCAGGGCAGAGTCACCATTACCAGGGACATGTCCCTGAGGACAGCCTACATAGAGCTGAGCAGCCTGAGATCTGAGGAC
TCGGCTGTGTATTACTGGGCAAGATACACGGTGCGAGAACCCACATCCTGAGAGAGTCAGGAACCCCAGGGAGGAGGCAGCTG
TGCTGGCATGGAGGAGATGACAAAGATTATTAGATTGAAGACTTTCTTACAAAATAGCATTAAGTCATTTACGAAAACGAACA
ATATAAATGTGTATTTGAGAAATTGTAATTATTTGAGAGATTTCTTATGCAACATTTATTCTGTAAGCAAATTCTAGGGATTG
GAGAATTAATCAAATTAATAAAGCTGACATAGAAATTCCTCTGAAGGTATCTTTGTAAACATCAATTTCTGAATCAGTGTTGT
AAATGTTTTGGAACACAGACACAAGATCACATTTTAACTCTACTTTTGTCTCTATAAAAATGCCAAAAGAGTCTCATTTTG
ACCATGTACCTCTTTGAATTCCCACCATCAATGAATGATTGTTCTTGGGTTTCCACATTATATTACCATTTATCATTATGAGA
ATTGTGTGTTTTAACCATTATAATAGGTGAGTAATGGTATCTAATTTTTGCTTAAATGCACATGCCCCTAATAAAATTCATAT
TTAACAATTTTCATATAATTTTTGGTGAGATGCCTCTCCTGATATTTGGTTCATTTTCAATAGCACTGTTTTCTTTTGATTAG
TTGTAAGTTTACTTGCATATTGATTATAAAAGTTAATTAACAAATTAAAAGAATTCATTTAACAAATATGTGACTTGGAAGTT
GCAGGGGTTTGTCCTGCACACCCTGACACAATGACGAATGAATAAAGTGCACTGACACAAAGATATTCTGCTTTGCCAGCTCG
ACTGAGCATCTGGGCCACTTAGTCACAGCCACCGCCTCGATCAGTCAGGGAGACTTACATTTATTCAGTAAAGATTAATTGAC
AAAGGCCGTGAGTAAACACCACTAGAAGGTAATTGACATTGTGGACCTCTTGAGTGGAAAGCAATTAAGCACCCGCGGTAGAT
CAAAGGTTAGTCTTAGGAACACATGAGTAAACAAGCTAGTTAGATAAGCTCCTCACATTCCTTTGTTTCTACTCTACTTTATG
TAACTAAAGGTAAGGGGACTAGGCTGCCTTCAGCCAGATTTATTACCAAAGTTATGCAAACTCACAGGCCTTCCAAGAGGGTT
TGTGGCTATTAGAACTAAAATGTTTCCCACCAGCCTGACTGGACCACCACATCTCCCCATTTTTTGTTTTCTACATCAGGTCT
TTTGGATTGGAGCGTGCAGATATGCGCAGCAACATGTCTGTCAGGTGTGGCAGTCATTGCTCTTATTCTGGCTTTGCATCCTA
GAATTAGCAAATAACATAAAACAATCATGAGTAGAATTAGCAACATTCTTTTCCAGTCAGAGTGACCCCCAGGAGCGGGGTCT
AACCAGGAGAGATGATCTCACACACCCTTCCATATGACTGTTTGTTGGGGGTGTAGATCTATTGCGTGAAGAGATTCTAAAAT
TTTAGTTTGAACTTACTTTACGTCTGCTGTTAAATTGTCATGAAAGGTTCCCCAGAGGTATTGTTTTACCTCATCCTAACTAT
GTATTGATAGATTCCGTGGTAGAGAAGTGATACAGATATGTTCATGTTCCCAGTCACAGTTTAAATGCTGTCAGAATGCCACT
GCATCTTGTCGCTCCCTGACATATTCTAAAGCAGCCTCAAGGGCTAGCAGACGTGTGATAATTTTTTGATCTATACCTTGCTG
TAAGAGAAGTTCATTAGACACATTTTTGGCCAGATTATCTAAAAAGGCAGCAGTTTACACTAAGTCAATAATACATGCAACAG
CAACACTAGCTGTTGCCAGGATGACTATGGCTGAGACTATAAAGGCCATAAGTGTAACTATGAATCTTTTGTGTCTGACCTGG
GACAGGGCACGTTCTAAGGTTGCAAGGGCATAGGAACCTTGCCAATTGCATGCCAGATTGACTGGTAAGAATGCCTCAGATTT
TCTCTTTAATACCATGGCGCTAGTAATTTTTAAGTTAGATATACTGTGATTAGTGATACATGAGGCAAACTCACAGGCCTCCT
GCATCCAGGTCACAAACGTGGAGTTTTGAGGTGTAATGGAAATGTTAGTTCCCATAAGGAAATCGTATGGATGGGTAGTGCAA
ATTAGGCACTGATCAGTGTGATTATGAATAAAGCTTATAGCATAGTTGCAACGGGAAATATGGTATGTCCCATGCCAGGTGTT
AAGGGAGGTGCTAAGATGTCCCAGACACCATAAAGTACCTTGGGGCGGCATGGACTTTACTTGGGGCCTTGGATATGCCATCC
CCCCTTGGCACAAATTATAGGGGAAAAGACATGGCTATGAAACTGATTGATGCTCTGATGGATGAAGGTATTAGTAAGGCTGC
CCTGCAATCAGCCGCTGGGACTCCAGTCTAAGATGTTATAATTACCTAACTGGAGGCTATGGGCTCGTCTCCCATGACAGACC
TCCCAGCTAAAGTCGAACCGATTACTGTCCCAGCTTTGTTCCTTAGCACAGGAAGGAATGTTTGGGAAGAAGCAGCGGCATG
GATTGCATTGCTCAGTTTGAGGCTATCTGCAGCTAAGAATGTTAAGGCATTTCCTTTGCTATGATGTAACCATACTTGTTTTT
GGGCAGGTACACAGTAAGGGTTAGAGTCTTTATAACTTACACACACTGGGAGGATAATAGTGGATTGACATATAGTGTTATCT
GCCACCTTAGTCCATTGTGTGCCATTATTGAGGGACCCCACGTGGGGTAAATCTATCCCTCCTAGCCAAGCAGTCACGTTACT
ATAGGCTGGGAAGGGAGTGTCTTCCCATTTGGCAGGGTGAAAGAAAAGGTGTGTCTAAGATAGAGGCCCAATAGAGTGTAGCAG
GTACAGGTTGCAGACAAAGTGAGAGCATAAAAAGGATTAATACCCTACATGAGTTGCAATGTACAACAGAAATCATAGCACCA
AAACATTATCTGGAGTAAATGGTGTCTGCATTTTGGAGCAGGATTCGTTCAGCCTCCTGAGTTGTCCTTTTCAGTACCCCCCA
GGTAATGTCTGGGGATTGTGTTGTTCACAGAAGCTGCATCGTCCGGGCTGTAGGTCTTGTAGGGTTAACTCCTTCATTTCTG
GTACTGGGTTGGGTCCTAGCAATGCCTGGTATGGTTTGATGCGTCGTGCTGGAACCCAAAGACGACCCGAGGGGGTGTGGAT
ACAAGCGTACCCTCTTCCCCACATTAATAATTCACTTGGACCACACCATTCATTACTGTTTACATCTTTCCATAAAACTGCAG
GTTTCATGTATTGGGAAATTTTAGCAAAGTGCTTTTCTACAGCGGATTCAAATTTGTCTTCTAAATTAAAAAAATAAGGTTTG
TGCCAAAAGTGTTGCAGGGTCTGTACCCATACTCCCTGTTTTTGTTTTTTGTGCATATTTTAAGGGTGGAGTTGGCAAGTTC
TACTATTGCTTGTCCTTGGGGTTTATATGGGATACCTGAGGAATGTCGGATATTCCACGTGTGACAAAATTGTTGAAATTGTG
AGCTGGCCTAACCTGGACAATTATCAGTCTTAATTTTTTGCGGGTTGTTCCATAAATGCAAAAGATAAAAGAAGATGTTTAATG
ACATATCGAGTAAACTCTCCAGGCGGAGTATGTGCACTACTTAAATGAGTGTTGATATCAAAGGATACATGTACCTATCTAAG
TTTTCCAAATTCAGGGATGTGTGTAACATCTGTTTGCCACAACAGATTAGGTTCTAGGGTTAATACCTGTTGAAGGAGGAGAC
GTGCCTGTGAGCTGGCGATCTCAGAGACTGTTTAGCCAGTCTCTGTATAAGTTGAGCTGGCGATCTCAGAGACTGTTTAGCCA
GTCTCTATATAAGTTGGAATTGTTTAGATAAGTTTTTTGGTGGAAAAATTGGTGCAATTGGGTGGCTTGGTCAAGC
AGCGATATCATAACTTGAAGGTTGGCTTGATTATTGTCATAAGCTAATGACCAGGCAGTGAGCTGTGGGCTGGAATGTGTGT
AATAAAATAGGATGTGTACTTTGATTTAGCAATTGCTGAAATCAGAGAAAAAGAGTCCACAGGGCTGGCTCCAGAGTTGACTT
AATTAGGGCTGTAAAAGTTCTCTAGACCCAATATTAAGGACTCAACTTTAGCTTTCTGAGTGCTAGTAAACCCAGATTGAGTG
AATGAATTGTGTGGTGTCCACCAGACTGCTGCTTTTCCATATTTACCAGATCTATCAGTAAACAGTGCTAAAGCATTAAATAT
GGGGAGTAAACTATTTTTGTAGGTAACACATTAACTAGGCCTTTTGGGAATGATGAAAATGGGTAAATTCTAAGGGCTGTTA
GTAGAATATTACCCATAAAATGAATAATCTTGTAGCCAGGAAACTTTTTCCTACTAGGGAGCAAAGCTTGCTTTTAATTGCTC
```

FIG. 6 (Cont. 13)

```
CCTAACTAACTTAGGGGCTTTTTGTAATGTCTCTCCCTTTAGAGGTTACTGTTTTACTTAAACTGGATTTGGAGTCATGTTAG
GAATAAGAGAGAGATAACAGTGGCCATTATTAGAAAGAGGTTTCTCAAATTCTTAAATTTTACTTAACTCTTATCATAGAATT
ATAATCTGGGATGTCGCTTGTATACAAAGAACATAACAAATTTTGCTTTGGGCCGCCTGCGGAGCCAGAGAGCGGAGCAGGTG
GGTCCCAGGGCGGCTGCGGCTTTGTGCTTGCTTAGAAGCCACTTTTCGCCACCGCGTTTCCTCTGTGCCAGCTCCCTCCCCAC
ACTGCTCAGCAGCTGCTGCCGGCAGAGGGGAGCTTCCTGCACTTGCTCCTGCCCCTAATGCCTTTTCTTAACCCTTCGTGTAC
CTGATTGCCTTGCTGATCTTGCATTACTGGGCAGTCTAAGAGCTCCCCTTTTAATGCTGCTTGTCGAAGACAGGGACATATAG
CTGTAGTGTATTTCCTCTATTTTTTCTATCTATTGAAAGAGGGGGCTCAGGCAAAACCTCCGTTTCCTCTTTGTTATTTTGGG
AAGAGCAGGTGGTAAGGCAAGTGACGTTTCTTCCTCCTTCCCCTTTTGGGTTCTTCTTTGTATAATGGGACTAAAGCCATCC
CTACTAAAGCCCATAGTGTTAAAGATGATGCTGGGACCCGTTGCGCTTGTGTGTAATGCTGTTCAAGATTTCTCCCTACTTGT
TCCCAGAGCTTTACTTCTAGCTTTCCTTCTTCTGGGACCACAGATTATGTGAGACAACAGTTTTCATTAGGTGCCTTAATTGA
GCCTGCGAAACTGATGCTCCCCTAGCCTTAAGCAACTGTTACAATACTTTCATATGCTGTTTGTGTTGAGCTGATAACTGCTG
TCCCATGATGAAATCTCAGCCTGAACAATCTCCCCTGAACTTGGAGATCCCAAGTGGGCACCAATGACTTACTGTTTTACTGA
CTTGACCACGCAGTCTTCCTCAACCTTCGTTTTCATGGGGTCTGTCACGCTCCCTTTGCAGCGATCCTCACATGGGGCACCGG
CTGTGGGGGTCTGTCCTGCAGGTCCTGACACAACAACGGGTGAATAAAGTACACTGACACACAGATATTCTGCTTTGCCAGCT
TGACTGACCATCCAGGTAGATCAAAGGTGAGTCTTAGGACCACATGAGTGAACAAGCTAGTTAGATAAACTCCCCACATTCTT
TTGTTTCTACTCAAATTTACTAAACTAAAGGTAAGGGGACTAGGCTGCCTTCAGCCAGATTTATTACTGAAGTTATGCAATCT
CTCAAGCCTTCCACGAGGACTTGTGGCTATTATAACTAAAATTTTTCCCACGAGCCTGACTGAACCCCACAGGAAGTATTTTC
TCCAAGTCTGTGGTTGCCTTTTACTCCCTTATCAGTAGGTATCGCAGAAAAATGTGTGTGTTTGTGTGTGTGTGTTTGTAC
AAATTTAGATTGAAAACATATATAATTTTATTCATTCATAGATCATGCCTTTGGCATTATATCTGAAGTTTCATTATAAAATA
AACTAATAGTCATTATTTTTTCCATATCTCTAATCTCAGGCCACAATCAACTCATGAGTGTTTAAACTTCACCTGCTTGATTG
GAGGACCATCAATCTAATGTATTTGGAATACTTCTGTAAGGAGATGTGTTCTTCTTCCTATTATTTTTTAATTAATCATCTAT
TAATATCAGTATTGGTTGATGGATGTCCATTTTATACTTTGAAAAAGATCCATGCTACATCATTCATTTAATTGTTCAAAGCA
CCACAGCTTTATTAGGTGCTGGGAGCTCATTTTGTTTGAATCCTGCATCCTTACAGCACACCTCATATTTTTGTTTTTGAACA
CTTGCGTATTTCCTGGTATTACCATAAATTCTAAGCTTGTTTTCTTTATTACCTTTTTTTACATAGAATCAACCACTTTTATA
AAGATTGCATGTTTCTGATGTTAAAGAATAGTATTAAAATAAAACATTGTGATACTGGCTCTGTGTGTTGTTAATGTGGTATG
AGTACTTCTAGAACCTCTCAAACAATGGTCCCAGTAAACGTGCAGTGTTATGTGAACCCAAGTTTATGGACTCATTGAAACTA
TTTATGTATCTAATCTTCTGTAACCATATCACATTAAAAATGAGAACACACTGGTCTCTCCACCCAACTATGTTAGCACATGA
ACCTTTCTAGTCTTCTTTCTTTGCGTTTCCATAACCACCCACTGCAAAGTGAGAAACCCCATTCCACCATATGTAATTTTATT
ACTTAGCTGCACAGTTTCAGGACACATGCATAGCAGTATCAAAAGTGTAAAGCTGTGCCCTTGATGGAACCATGTTTATCTAC
TAGAATAGAGTGCTTATGTGCAGATTTTTTACACATTAAACTTATAGAATTTCTTCGTTTTCTGAGTTGCTTAGGTCAGCAAC
TTCATTTTCCACATTCTTCAATGAAGTCATTTCAATTACATTGTATAATTTCATTTATTTGAAATTCCATAAATGCTTAGACT
ATAGTCAAGTAAACAGACAGAGGATGTTCCAGGAATTTAGAGAGTGGGTATAAAATAAGCAAAAAAAAAAATGTGGTGTTTAG
GAAAAATAAAACTATTTTTAGTGATATGCAATGGTTGAGATATGATATAACTAATTTGTCTAAGCTAATAATTTTGTATAGA
AAATATAAACTTAAACATATTCAATTAAAAAAATTCAGCAGTTCATTAACCCCAGGATTAAATGCAGACTGTATAAAATTATC
CAATAACTTATTTGGTGAGAGTGGGGATGTTATGAGATACATGCAACAAAGAATGAAGTAATTTTCCCCATTTGCATATACAA
TGTTTCCATTCACTGAAGACCTTTTATTTTAAAAAAATCAATTTTCTACCTTACCCTTGTTTTTAATTCCCGACAAGCAAATA
ACCCAAAGGATTCTTTTCTTTCATTGGTTGAGAAAGATTTTCCCCTAACTTCAGCTTAGTTCAGGCATACGCTGACCTGAATG
GGCATTTACCCTCAGATGGGTACACACCTGTCAATATGTGGACTCTTCTGTCAGACAGACACAGCTTCACTCATGTGGATTCT
TCCCTCAAACACAAATGTCCCCACATGGACTATTTCCTCAGACTACCACATATGTCCTTACATTTACACTTTCCTCAGAAAAC
AGACATTTCCTCATGTGGACTCTTGTCTCAGATAAGCAAACATGTCTCAGTGTGAATGAAGTCTTCACTCAGATAAGTACACA
TATTTCAACACTGACTGTTTCCTGACACAAGCACATATGTCCAATGTTAAACTGTCTTGCGACAAAATGATCTCAAGATAATG
ATAATTATAAACTCCAACCCTGAAAATCTGTAGATCTGCATTTTGTCTATTGTAACATAACTTCATCTCATTGTCAGAAACAG
TCGTTTGCAGCTATAAATGCACTGATTACAGTCAGATTTCCATTTTCTCTGGAAATGTATTTCTTATGTTCTTACTGGACTAA
TTTGTTGATAATGTTTGCTCACATGAAGATACCTGAACAGTGTCCACATTAGAGAATAAAAAGAGCAATGGGCAGATTAACC
CTGTGCATCCAGACGCAGGAACCATTTGACTCTGCCTTCCCTGAAATGGAGACACAGAGGATGGATGAGCAACGCTGAGTGGT
GCACCTACGACCACAAAGAGAAAGACCTGGAAATATGTCCCATCCCCTCCTCATGAAAGGCAGCTCATCCCCTGTTCCTTCAG
GCCCTGGTGAGGAGCCACCCCATATCTGTGTCTTTCTTCAGTGTTCACACTATGGAGTCTGCACTGATCTGGGTTTCCCTTCT
CATCACCCTCCATATTAGTGTCCCTTGTAAATCAGGTCCAGCTGTGGCTGCTCATAGGGTTGTTCTCAGTCTATTTCCTCTGT
GTTCATAGAAGTCCTGTATGAAGTTCAGTGGTGGAGTCAGAGGGTAAACGTAGTACAGCCCAGTGGTTCACTGAGACTTTCT
TGCAAAGCGTCTGGATTCACCTTTTCTGGCAACAGCCTGAGGTTGGTCCAGCAGGCTTCACAACAGGGATTGTGGTGGCTGGC
AACAGTGAGTCAACAAGTGGGAGTGCTCAGGTTACTCTTCATGAGTACAAATAAATTAACTGGTCCAGCGACACCCTTTCAC
GTGCACTCTACCTTACAATGACTAACCTGAAAGCCAAGGACAAGGTTGTGTAATACTGTGAGCTTCACAGGAGAGAGATTATC
TGCACAAGCCCAGACACAAAAATCTGCAGGGAGACAGGAGGGAACTGCATGGTAGATGCTGCTCAGAAGCACCAGGGGGCACT
CAACACAAGGGGGCGCTCAGGCACACCAGGCGGCACTCAGGATACAGCTGGGGGCGCTCAGGCACACCAGGGGGCACTCAGGAT
ACAGCGGGGGTGCTCGGATCCACCAGGGGGCTCTTAGGGCACCAGGGGGCATTCAGGACCACTAGGGAGCCCTCAGGGCCAC
CAGGAGGACCTCAGGACACGTCAGCGTGCTGGAGCCACCGGGGGGGGGGGGGGGGGCTCTGAGGAAACCAAGAGACGCT
CTGAACCGCGAGGGGAAGGAAGCTCAGGACCACGAGGGGACGCTCAGGACACCAGGGGCGCTCAGAACACCAGTGGGCACTC
AGAACAGGAAGAATCTCTTAGAAAGCAGCTCCACATCAGGATCCTGGGAGGCTGTGGAGAAATGGGAACACTCATAAACTGTT
GAGCATTTAAATTAGTACAACCACTATAGAGAACAGCTTAGAGTTTCCTCAAAACCTGACGATAGAGTTATCATATAATCTGG
CAATCCTGCTGCTGGTATATACCCCTAAAAAGGAAATGTTTTTGCACTACCATGTCTGTAATAGCACTGTTAAAGCACTGTTC
ACAACAGTCAAAATTTGAAAGCAACCTATGTGCCGATTAACACATGAATGGATAAATAAAATATGGTACATATAGGATATGGG
TTAATATCATGCCATAAAAAAATGAGATTTTGTCATTTGCAGCAACATGGATGAAACTGGAGTTCACTATATTAATTGAAATG
AGCCCCAGAACAGAAAGACAAAATTCACATGTTCCCATTTATTTGTGAAAGCTAAAAATTAAGACAATTGAACTCGTGGAGATA
GAGAGGGAAAAGATGGTCACCAGAAGCTGGGAAGGTCTATGGTAGATGGGGATTATTGGGGATGGTCAATGGGTAGAAAAAGT
GATTAGAAATAATAAATAACACATAATATTTTATAACACAACAGAATAAATATAGTCCTCAATAACTTAATTATAGATTTTAA
AATAAAAGTTTATGAATGGAATGTTGGTAACTCTATTAATGCTTGAGAGGATGTATAAAATATTCTTCATGATGTGATTATTA
```

FIG. 6 (Cont. 14)

```
TGCAGTTCATGCTGATTCAGAGTCCTGTACCCCATAAATATATACGTGTACTATTTACCCACAAAGATTCAAAATTAAAGTGT
TTATGTGTCTAATATTCTGTAACTATATTACATTAAACCTAAGAACACACTGGCTTTTACACACTACTGTCATCCACATAGAC
ATTCATAGCCTTCTTTCTCTGCTTGTCCATAATCCCACACTCCAAAATGAGAAAACCTCTCCTAAGATATGACATTAATTTAC
TTAGTGCACAATTTCAAAATACACAAATCGTCTTTAGGATTGTTAAACTGACCCTTGTTGAAAATATGTTTATCAACTAGAAT
ACAGTGCTTATGTGGAGCTTATTTATGTTTTACAATCGCAACATCAAATTCTTTCCAAGTCTCTTGTGTCCAATATTTATGCC
CCACCTTCTTCAGTGTAATTAGTTCAAACCTTCTGATTGTTGTTAGATATTTTTATACAGCTGTCTTTTTTTGTGTTTCATGA
CCTGCTAAATACTTTCGAAGTTGTATGCATTTAGGTTAACACTTTGTCTCAAAAAATATGAGTTTTTCAGAAATTCTTTATGCC
ATGTGTCCATCATTGAATATCATAAAAATAGTTTCATTGGCCGGGCGTGTTGGCTCACGCCTGTAATCCCAGCACTTTGGGAG
GCCGAGGTGGGCGGATCACGAGGTCAGGAGATCGAGACCATCCTGGCTAACACAATGAAACCCATCTCTACTAAAAATACAA
AAATTAGCCGGGAGTGGTGGTGGGCACCTGTAGTCCCAACTACTCGGGAGGCTGAGGCAGGAGAATGGCGCGAACCCGGGAGG
CAGAGCTTGCTATGAGCAGAGATCGCGCCACTGCACTCCAGCCTGGGTGACAGAGCAAGGCTCCCTCTCAAAAAAAAAAAATA
GTTTCATTGGGATTAAAAAGTGTGTGTTTCACCTAATCCACACACCTTCTCCCCACCTTCCTGGGAAACCTCAAATGTTTACT
GGATCTATATTTTTATCTTTGGCAAAACAGCCTGGCTGTTCTCTTAGCCTCTTTTGCAAAGCATCAAGATTCACCTTCACTGA
CTACAGCATAAATTGAGCCCAGATGGCTGGGGACAGAGGCTGGAGTGGGTGGTAACAGTGATTGATTCAAGTGGAAGTTCTC
AGTGATATTCTGCATCAGCATAATGAAGATTCACAATTCCCAGGCACACCAATTACCAGCACAGTCTCCCTTAAAATAATCTA
CTTGGAAGCTGAGGGGCTCTCACAGGGGTAGGCAGTGTATTACTGTGAGAGACACAGCGAGGGACATTTCTGTGAGTCCAGA
CAGAAACCTCCCTGCAGGGAGACAAGAGAGGACTTTGTGATAAATGGTGCTTAGGACACCAGGGGCACTCAGGACAGCAGAG
GGTGCTCAGCAGAGCAGGGTGCGCTCAGGACATGGTGTGTGTTAGGGGCATTGCTCAGGATCACCAGGGGCTCTCAGAA
CCACCAAGGGTCACTCAGGAAACCAGGGGCGCTCTGGACACCAGGGGAGCTCAGAACCACCAGGTGGTACTCAGGACACCA
GGGGGCGCTCATGACCAGCAGGGCATGCTTGGGACTCTATGAGGCATGCAGGAGAAGCAGGCCATGCTCAGGGCAACAGGGGG
CTCACAGAACCACCTGGGGGTGCTCAGAACCACTAGGGGTCACTCAGGACAGCAGCAGGCATTCGGGACACCATGGGGCCCTC
AGGACCTGCAGGGGGCGCTCAGAACACCAGGGGAAGGTCAGAAAGACCTGGGGGCACTTGGAACCACCAGGGGGCACTCAGGA
CAGCAGGGGGCGCTCAGGACCACTAGGGGCGCTCAGGACCAGCAGGGGTGCTCAGGACACCATGGGGCATGCAGGAGCAGC
AGGCTGTTCTCAGGGTAACAGGGGGCTCTCAGAACAACCTGGGGGTGCTCAGAACCACCAGGGGGCACCCAGGACATCATGCG
GCCCTCAGAACCTGCAGGGGGCGCTCAGGACACCAGGGGAAGCTCAGAATGACCTGGGGGCACTCAGAACCACCAGGTGGCAC
TCAGGACAGCAGGGGGCGCTCAGTACCACGGGGTGCACTCAGGACAGCAGGGGGCGCTCAAGACACAGTGGGATGCTCAGGAC
CAGCAAGAGGCACTCAGGACCACCAGGGGGCACTCGGGGGACAGGAGGCACTCAGGACACCAGAAGAGGATCAGAACCACTC
GGGGGCACTCAGAACCACCAGGGGGCGCTCAGGACACTGGGGGCATTCAGAACCACCAGCAGGTTCTCAGGACACCCAGGGAC
ACTCAGGACAGCAGGGGCGCTCAGGACACCAGGGAGGGTGCTCAGGACACCAGGGGGGCTCTCAGAAACACCTGGGGGTGACCA
GGACTAGCAGGGGCATGCAGGACACCAGGGAAGGGGCTCAGGACACCAGGGGGTGCTCAGGACAGCAGGGGGCACAGAATCAC
GAGGGTGCATTCCAGACCACCAAGAAATACTCAGGACCAGGGGTAACAGAAACACCTAAAGACACACAAGACCACCAGGAGGC
ACTCACGACTGCTCAGAGTGCTGAGGACACCAGAGCTTCAGGACGAACAGGGGGTGCTCAGGCCACCATGGGGGGCTCAGGAA
CCACCAGGGTATCACTCAGACAACAGGGTTCTCTTAGGAGGCAGCTCCACATCAGGTGCCTGGGGAGGGTCAGATTTGCTTTT
AGACCTTGCTGATCCCTGATCTGGTCAAGCGAAAACCTTCCCAGGATCTCTCACCATTTCTTCCTTGTAACCCATGGTTTCTT
TCACGTACAAATCATTAACTTAGAACAGGAATTCAATTCAACTTTTAACCCTCCATATTTTTAGAATAACACTAGCAGTAATT
GAATGTTTTGATAATAAGAAATTGCGTATGCCTAATTCAAGCTCTGGTTCCATGCATGGGTTTTTGTTTTCTTTGCTGTGTCA
GTCACACTATAGTCAATGCTTTTCTACCAATAACTCAGCATAGGCATAGTGTTAAGTTTCTTTTTCTTTCATCTGCCTTTTGT
GGAGATGAAACACCACTTTCAGGGGTCCAGTTCCCCCCACCTTGGTTGGGTTCTGGTGTTCTGCTCCTCACACTATTTCTCCACC
TTCCCTTCTTCTGTCCAAGCCTTTTGTCTTCCTCAGTCTCCTAGCAAGGAAGCAACAAGTCCCTTTATTTTGCCTCTTCCATG
TCTGGTGAATCTGTTCACTTCTCTTCATGATCATTGAAGTCAACCAAGTTTAGGAGGATAACAGTTCTCCTTAGAATATGCTC
ATCTACCTGCAGACTCTCTGCCTTCCTCACCCCTTTCTAGGGTCCTGCAGACGTCACCTCCACCACATCCACTCCTTTACCTA
AGTACCACAGAATAGTCTCTGCAGCTCCTGCTGCTCTCTGTGTGCTCAGCACTAAGGCTCACTAGTGCTTTGATGATGAAGTT
CAAATCCCTAATGTGTTAGCAATTCTCAGACAACCCTGCCATTGTGAGTGAATTTTGGGGATCCTGGGCTGTTTTCAGTTCCA
TATTACTGGATGTTCTCTAGCATCCAGGAGTACTGGCAAATTAACATCTAGAATTTGTATTGCAAATTTATACAAAATCAATT
GTAGAAAAAATCCTAATTTCTAAATAAGAACATTTATCCTGACTTTTATAAAAATACAATGTGAATTTAACCAATAATATAA
TACAATTTTAAAAGTGATGTTTATCTTATATGTTATTAAGTTTATTAATAATTGGCTGGTATTTTAAAAGTATACTGATAGCA
AAACTGACAAATAAACCAACACAGATTCTATACATAAATACCATTGTCCATTTAATTAATGTGTTTGGCCAGAATGGCATTTA
CATTCAGTTCTACCGAGGCATGTCTTTAAATGTATTTGTTTATTGGCATTAGGATAGAGAAACACTCACACAGAAAAGCATTA
TTTGGGACTACTACATTATACTATAAAAGAGATAAATTCAATTCAATTAAATAAAATAAAAATAAATTGAATAAAATTCATGTTT
TGGTTTGGTATTTGGATAGGTGTTCATTTTTCTATTTTCACATGTATATTTCAGTACTGGGCATATGTGTGTATGTGTATGCA
TGATTATGAACTTCTAAAATACATTACTCCCCTATATAGTTATATAAATTGAAGTTTTGCATGTTAAGAGACAGTAGAAACCA
CAAAAGGGGAAAAGTTATAGAAAGCATTTGGAATACCTAGGGCCTACAGAGGAGTCATATTAAAATGAAAAATAATAGCTGAA
TATTTTGGAAATGACACATGCAGTAAGAAAATGTCTATATGAAATTAACAGGATATTGGCACAAAATTTAGAAAAAAATAACAT
GATTATGCCCACTATTGGTCTATGATATGCCTATAATAATAACACATTTTATTTATCATAGAAAATAAAATAATTATACAAAT
AGCACTCTCATTGCTTGATTTTAGTATTAGGTACTTCACTTGTTTTTTGATAGAAATGAACATTTATCATTTTTTGATGATAA
TTTCTATATTATCTTCTAAAATTAATGTCCATAATTATGATTGACATGTTATAATTTCCAGAAACCTATTTTATCAATTGTGA
CTTGTATTTTTATGATAGTATTTTTACATTCATATACATTTGATTCAGAATAATTGTAGATTAACAAAATAATCATAAAGTTA
ATACAGTGTGTTCCCATCTCTAAGTATCTCCTAAGATGAACATCCTCCACAATCATAAAACATGGTGTTAACACATTTACGTT
GATAACTTTAAATATATTCAATACCAGGCCTTATTTGAGATTTACCATTTTTCCAATAATTTCTTTTGTAAACCAAAAATAAA
ATTCTAAGCTTCCTCATCCAACTAAAATGAACTCAACTATCAGCCAAAGATATTTTAAAGTAAACTTTAAAACTTGTTCCAGCA
ATAATGGGAAAATGAGAGGTCAGATATGCCTCATTATGTCCTCCTGTCTTTGGAATTAAGGCACCTGTGGCCAGCATTAACAC
TAAAACAAAGACCCTTAGACTGACAAAACTATATTTTTTCTATAAACACTCTTCATAGTGAAAAGATACCAAATTACAATATG
ATTCTAGTATAGCATCACATGACAAACAGCAACGCCTAAAAATCTATTCTCTATGAAGTCTGCTACCTGGAGGTTTCATCTAC
ATAATAACAATTATGAGCTCCACAATCTCGTATCTTAATCCAGATACTCATTTGTAATGAGTGTGTAACATTTCAACCAATTG
CCAATCAGAAAATGTTTGAATTCACGTATGTCCTGGAAGCACTTGAGTAAGCTTATTCTGCCTTTCTGGACTGTGTAAATGGT
ATAGCTCACATGTGTTGATTCATATCTGTCTATACCTTCTGTACCACTAAAATGTATAAAATCAAGCTGTAACCAAACCATTT
```

```
TGGATACGTGTACTCAGGAACTCCTGGAGTTGTGTCATGGGCCTTGGCCACTCATATATATCTCAGAATAAACTGTCTTAAAT
AATTCACGGTTTGTCTCTTTTAGTGGATACTGTCTTTTTCTTTTTTCTTTTTTTTTTTGTTTTTTGAGACAGGATCT
CTCCTTGCTGTTGTTTTTGTATATTTGTTTGTTCCCAGATTCCAACAAGGTCATCACTTTGAATTGAGTTGTCATGTTCCTTT
ATTCTCTTCTGGCAAATCACAGTTTGTGTTTCTGAAGTTTTCTAGTTTAATATTTTATAGATAAAAATTTATCAAGTAGATTG
ATAGTCCTATTTAGGACACTTATATCTTTACTTATTTGAACACTGCTTGTCAATCACAATGAGTGTTGATTTCTCCGTCTTCT
ATACATGTTATTATATTTTCTGTTCCAAATCCATTCATTAAGTATTTTTAAATGTATTTTGGAAAGTTGATCCTATTACTTTA
TGTAATATTTCTCTTGAGTCCCAAAGGTCTTCTTTTTATGATTATTTTGTCTTAAATTAACATAGCTATTTAAGTTTTCTTTT
GGTTTATATTTTCATGATATATATTTTTCCATCTTTATTTTTTCTATTTCTGAATATGTAAAGAAATTTCTTGGAGATAAAT
AATAGTTGGGTGTTTTTTTTAGTCAACTATGAAGAATTATTTTTTAAAGATGTTACTCTTTTGTCCAATTATTCTTGTTTTA
ATTTGTATTTTTACAATAAAGTTTATTGTTTCTATTAACTTATTATTTAATCATTCTGTGACTAACATTTTATGGGTTACCAT
AAGGATAACAATAAAAAGTTTCTATAATTGAATTCTAATTCAAAAATTTAATTCCCATTCATATATACTACAGAGATATTATA
ACTCTATATATCTAATTCCTCTTTCCTATCCCATGTTTTTTATTTTCTGTTTGTATCTATACATGCTATAAAATGTAATATTG
GCATTTTTATAATTGCTTTCCACACTTACATAATGAACAAAATACAAATGCAAAAACTGTATTTCAACCTCATTTTTCCATTG
TTGACCATCTTCTTTGTGCATATTTTCAGGTGTTGGATCTATGTCACATGGCTATTCATCTAGAGACTCTGCTAAAATGTCTA
CGGAAAGATTCATGTGCTGGAAATAGGGTTTTCTCAGGTTTTATTGGTCCGACAGAATATTTATTTGTCTTTGATTTATTGTCT
CCAGAGACAATGTCAAGAATATGCTATATCTGCAAATGGGCGATCTGTAAACCAAGAACACATCAGTATATCACTGTGCAAGA
GGAGCACATGAGGGAAAGCCAGTGTGTGCCCAGACATAAACCTCCAGGGACACATGGGCGAATTAGCTGCAGGGGGAGCTTGG
GACCCACTGATGAGAGTCGACCCCAGAGGGAGGTGCACAGAAAGGTTAAGAACTGCTTTCCTGCCAGTATATTTTTAAAAAAA
CAAAACTTCCATCTGACAGTTTCTCCAGAGAACTTCCCTAATTTTAGCATTCTGTGCCTACCAATGCCATCACTAAATAGGTT
TTTAAAAAATATTGTAATATGAGGACATATTCTCATATGGACAAAACGCAAATTGACATTTACAGAAATGAAAAGTCCTCAAC
CGTGGTCGCTAGAATTGGAGACCTGTAGCAGCTCAGTGGGACCTGTTGAGTCTTCTCCAATCACACTCAGAACAGAGACCTTA
GTGCATCTCCCTGACTAGAATACCCTTTAGGTATCGAGATAACAGCCTAAAGATGGTAAATCATGAGAGTCTCAGATGTCCAG
ATGACAGACATGGGTCTATGGGAATAGTACTGTAACTGACAGTAACTAATTTTCCATACCGCCAGATGTCCTATTCAGGAGCA
GCTACAGCAGTCATGCCTAGGTGTGAAGATCACACACTGACCTCACCCATGCTGTCTCTGGCCACTTCATCACAACCAATGCT
TAATATTGGACGTGGATCTGCCAGTCCCCGGGGAATGGGTTGAATGGATAAAATGCATGGCTAGTGCTGCTGGAAACCCATTC
CTACTGTGGCAAATGGCAGCATCTCTTTAAAAGGCTAAATAATATTCTATTCTGTATACATACCACATTGCCATTATCCTTT
TTGTTTGTTTGTTTGTTTGTTTGAGATGGAGATTCACTCACTCTGTCACCCAGGCTGGAGTGCAGTGGCGTGATTTCAG
GTCACTGTAATCCCTGCCTTCTGGGCTCAAACAATTCTCCTGCTTCAGCCTCCGGAGTATCTGGGATTACAGGCATGCACCAC
CACTCCCGGTTAATTTTTGTATTTTTTGTAGAGATGGTGTTTCAACATGTTTGTCAGGCTGGTCTCAAACTGTGACCTCAAAA
AATCAACCCACCTCAGTCTTTGAAAGTGCTCAGATTGCAGGCGTGAGCCATAGCATCCAGCCACTTTTCTGCATTTTTTTTTC
ATTGACACTTAGATTATTTCAATATCTTGGCTCTTGTGAATAGCGCTGCAGTAAACATAGGAGTGCAGATATCTCCACAAGGT
GGTGATTTTTTCTATCTTGGGTATATTCCCAGAAGGGAGGTTGCTGGTCATACAGTAGTTCTAGTTCTAATTGATTTAAGATC
ATCTTACTGCTTTCCATAGTGGTGGAGATTCAGATTAGTGTAGCTATTATGAAAAACAGTTTCAATGTTGGGGAGTGACTGAA
AAACAAATAATGCTTGATTATGGTTCTCCATGAGAGTCTCTAATAAACCTAATGGAAGTTCAGAAAGTTTCCTCACCTTGTTA
AGAAAACATTTGTTTTGCTCATAATTCTCTTTCAGCCCAGAGTTGGCAGTATGTAGAATGGAGGCTGTTGGCTCGTTTAAGGA
TTCTGAAGCAAAGAACAGTAATGAGAGATGACAATAGAGAAAAAGAGAGAGAAGGAGATGCTGAATCATCATGGACTCATTCC
ACCTGCAAGCCTTTCACTGTAAAGCTCTATTGCTAAGGATCCTGAGGATTCTATACTCCCATGAATGCATAATCAGGATCCCT
CAATTCAAATTTTATTGGCAGAGACACACTGGGACCCCTCTAGGATATGTGCCCTACATTACTGGCTCAACATGCCGCACTGA
GAATCCTGCATTAACTGGCTTTATTTGTAGTGGTGAGTAAAGTTCACAGTTTTCAGTCATCCATGAAGGGGAGATTTTTTTTT
TGGTTCATATAATTTTTGCAGAAATTCAGGTATTAGTGAAAACCAATAAGATTGAGGATTTCTGGATATTTTAGCAACACTAG
GGATGATGGCCATTTTGTAGAAAAATTTACATTTTTCAAACTGACCTACATGTTAGGCTGACATAAAAAAATCCAACTACACA
GCAATATTATGGCAACACTTCAATACACTTGGTGGTGAAATACCTCAGAAATGAAATGTTACACAGATTAATTGAGTTAATGA
AACTGTTCTGAACTATGATAAACATTTGTTTGCACCCAGATTTGCTTGAATTCATTTGATTATTATATTCAGCTGCTGCCCT
AACTTATTTGAATGAGTAAGTTACTATTTAAATGACCCTGTCTGTTTGATTTGTTATATATACATCTGAATTAAAGAACTTAA
AGGACAGGTTTGTGCTATTATTAGAAAGAGATATTCTGGGGGGCCCTTGTTTGCTCCAGGAACCTCCACATTTTTAACTTAGA
ATTAATATAAATTCCTTGTGAATTGGGTCAGTCTTCAAGAGACCTAATCTCTAAAACATATACCCAGAACCTTCTCCAGACAG
ACCATCCAGAGGAAGAATCTTTCCAGTAATTTATCTCCATGGTGGAAGGTCCTTCATTGTCATGCAGAACCCTCTGCCCAGGC
TTCCTTTATTATGCAAATAATTAATATTAGCCAGTAGGGTAAGATTAAACAAAAATAGACCGGAGATGCTGCAGACAGGGAAG
GAAGTAATAGACCAAAATCAGCTTTATTAATGGAGACTGCTTTTAAAGGTCACAGCCAAGAAATGGAAGAGGATAAAATCAAT
GAGATGAAATTGTAAGAAACTTTGTCCAGTTCAATCAAGCCATCAGCAACCAGATAGCTTCAGTGGACATTATGTGTATTACA
ACATGGCTAAAGATTCTAGATTACACAAGGATTTTCTCTATAGTTTGCATATTGACAAAGTGGAAGATGGCATGGGAGATCTG
GTGGCAAACACTTAAGGTGCAATAATAGCTATTTTTCCTATATCATGACAATACATGGCATGCCTCTATATTCATTTCATTCC
AAAGAAGTCCTTCAGAAGGTCAAGTAAATGGAGAATCTTACATGCATGCCCAATGCAGTCTCCAAGAAGTGATTTTGAATGT
ACAGCTACACCAGTTACTGCAATGCTGTGTCTGACCTTCCCAGCATCTAAGATATTCATGAGTATCAAGGGGGAGATGGGTCT
AGGTGAAAGAAAGGAAGTAGTCATTCTTGAGAAGAATGGTATGGCCAAGATAAGCCTGAACTCTCTATCTTCTTCCATTTGC
TGCAGCTTCTTATTGCCCGATTGAGGTCACTCGCCCATGGTGGTAATGACATCAGCAATGCAGTACATTCTCTGGTGGCTTTG
TATCTGGTTTATAATGTGGGAGATGTTTCCTCAAGAGTGGTGACGCCAGTATGGCTTCTGCTCTCTGGTGGTGATGGCATCTG
CATTAGCCTAGGGGTTTGGAGAAAGAGAGTTATTCAGACCATGGGGAAGAATCTGACACTGTCACACCGCCTGGTGCCTTCAG
TACTGGACTGGCTCCTGCCCTCATTGGTGATTGCATCAAATATTGGCCTCCTCATCAGTACAACACATTGTAACAGTCTTCTT
TGTACCTGGCTTTAATCCAAGAAAGTTGTTGACTTATGGCTCTTTCATTATATTGTATGGCCTGGTTTGTCACAATCTTTATT
TCTGGAATTATCAGTGCTGCCATCTTGGCTGACTTCAAGTATGTCATCCTCACAGTTTGAAGCTGCTTGACATTAACATTTTT
GTCAATGTTTGGGACTACCTTACATATTCCGGCTCTCTGAAAGAATGATTAGCGTTAGGGAAGGCTGACACTAAATTTGGGAG
CCAGAGAAGGAAAGTGTTACTGTGCTACAGTTGTTTTGTGATAAAATATGGTTAGGTTAAAAATGAGCTATGTAATGTAGCCAG
GTTTCCACTGAGTTCCACTTTGCTTCTTGGCTGTCTATTCCTGTGCAAGTTTCTATATATTTTGTATCAGGCTTCAATTCCAT
TATGTTTTAAATGTTGTCTCTAAAGATAAACAAAGATTTTTTAAAACTACCAAACATGCAGCCATTTGACAGAGTGTGCGCTG
CATTTTTAGTCTCACCATCTTCTGCCCTAACAAGCACCGAATCTAACAACACAAATATCATGGAAGCTTTCCTTGGAGTAGCT
```

FIG. 6 (Cont. 16)

```
CCTGTAATTAGAATCATTGGTATTCTGCCCTCCTGTCAGTGGTGGAACGTTCTATTGGCACATGTGGAAACCTCTTAGAGGGA
TGAGTTTCTTTGAACACAATAAAATTTTAAGTTAGGAATAACTTATTTGAAAGCAATTCATTGAAGGTTATTGCTAAGAAGAA
GTTAGAAGCAGTCTTTTGGCAGTCATTTCTTCAAGATGTATGGCAGCGTAGGATGGATATATGAAGTGGAATAGGAACTTGGG
CTAGTTAAATGGAATAGCCTCCAATGTTAATCTGTTTACCTTTTAACTGAATGAAAAAGCCTATAGTTGTAAGAAAAGAAAAA
ACAATACAGTGCTCCCCTGTCCCACACATTACCTTCTCATCAGTATAATTAATCTACATTGAAGATGAGTGTGGTAATGCAGA
GACTCTATTTAGGGAGGAGAACATAGGGAAATGCAAAGACAATGGGAGAAAAAAGTCAAGGACAGTAGAGCAATTCGAAGCCT
CTGATACCAATAGCTTGAGGACCAAGGTCATGACTCAACTTTTGGTGGACACAGAGTCACTTCTCTTAGGGAAACTGCAGTAT
TCTAAGGTGACAATATGCAAACATGATGAATGTACACTTGCTACATCTCCAATTGTGTACTGTTTTCCTTACTTCTGTTTGAA
GAAGGGAGTCGTATACTCAGGTCTAGTATCAGTGTAGGGGGTGCTCCCTATTTGCAAGATACTAGAAAAAAATGGTAAGTTAG
AGGCCCATTGTTATAAAAATCTACTAGCTCCGTGTCAGTGTGTGTGTGTGTGTCTGTGTGAATGTGTGTGTTATTGAAACAGA
AGACATGGAGTGGGCATTGATCCACAAGCATAGATACCTACAGGCACTCTTAGATGTAATATTTAACTGCAGGAGTCTAAATA
AAATAAAGGATTCGCCAAAAGTCTTGAAAATTTTGGTGCTGACTATGTGTCCACTGATTCAATGCATCCTGAGTTCCAGGGAA
GGGAATCCCCAATTCTTTCATAGAGTTGACTGGGTCTCCTAAGGTCAATGTTTTCAAACGATGGTGTCAGTAACATATGGTGT
CACTGAAAGAGCATTTTAAACTAGGGCATGGCCACTTCCTATAGCCCTAGAGACACTGAGAGGTAAATGCCCTGTGAGCCCAG
ATGGAAACCTCCATGCAGGGCAGAGGCAGTGCTGCAGGGGGCGCCCAGGACCCACCCAGAACAGGCTCCAGCCCCAGAGCTGG
TGCACAGGAGGCTGCAGAGGGAGTCTCTCACAAGGACTGAGTGTTACTTTACTGAAAACCAAAAAATTATAACATGCTAAATA
AGAATTTTATGAGGACTATTTATGTATATTTAAATACCCTAATGTATTTAGAAATAAATAAATCAATAATTCAGTGAGAACCA
CATTTAAAAGGCAAAATTATTACTGCTTTGAGATATTTTACTAGTAAAAAGATAAAGAACAAGAATGGTTTTATTAAATAAAA
ATGTACACATTTCAGAGACACACTGGTCCCGAGAGTAAGACTGCGGAGAGCAAATCCTGGAAAGGGCGGAGGCTGTCCATGTG
CCATGGGAACTTGGGCTCACGCTGAGAACCATGTCCGGTGTGAGTCAGCTTCTTAGCGGAGAAATTCTCCCTTCACAAATTTC
CGGGCATATAAAGGGAAACATGTCATTAAATAAGAATGAAGATTTGTACCTCAGCATCCCACAGTTGTGTGGTCCATGTGAGA
TCTATTTTCTCTTTCTCGTGCTGGATCAGGTGTAATGCTATGAAGTAGTAGTCCTCATGAATACGCAAATCACCTGAGGTGAA
CACTACAGATAACTCTGTGCCCTGAGAGCATCACCCAATAACCACATCCCTCCTCTAGAGAAGCCCCTGAGAGCACAGCTCCT
CACCCATGGAGTGGACTTGGAGGATCCTAATTTTGGTGGTCGTAGCTGCAGGTAGGATAATTCTCAGTCCCCAGGACTAAGGTG
ACTGGGTCCAGTCAAAGGGGGTTTTACTCACTCCCGTGTCCTCTCCACAGGTGCCCAGTCCCCAGGTGCAGCTGGTGCAGTCTG
GGGATGAGATGAAGAAGGCTGGGGCATCAGTGAAAGTCTCCTGCAAGACTTGTGGATACACCTACCTTCACCAGTTACTCTAT
GCACTAGGTGCGCCAGGCCCATGCACAAGGGCTTGAGTGGATGGGAAGGATGTGCCCTAGTGATGGCAGCATAAGCTACGCAG
AGAAGTTCCAGGGCAGAGTCACCATGACCAGGGACACATCCACGAGCACAGCCTACATGGAGCTGAGCAGCCTGAGATCTGAA
GACACGGCCATGTATTACTGTGGGAGAGACACAGTGTGAAAACTCATATCCTGAGAGTGTCAGTAACCCTGAGGGAGGAAGCA
GCTGTCCCAGTTTTCAGGATATGACAGGATTTATGGGGTTTAATGTTGTTAGAAAATAGGTTATATAATTGAGGAAAGAAG
AAATAGAAAGATATATGCATTCTAATTATATAAGAAATATTCTTTTCAAATCTCACCCTATAAGCAAAATTAACAGAGTGGGA
AAAGCAGCAATCAATCAAGCTGAAACAAACATTCCCATGGAGGATTTGTGGGGCAGACGTTTTAAAATTGAATGGGTAAATC
ATTTAGGGCAAGATTGCTTGATCCAATACTAAGACTAAATGTAATTTCTGAGAAACTGCCTATCTTTTTATATTAAATTTATT
ATAAAGCAGTTTTAGGGTTACAGCAGATGTAAAAAGTAGAAACAGAGAGCTCCCATGTACCCCTGCCCAACACATACACAGCC
CTCCCCATGATCAGCTCCCTGAAACAGAGTCCTAACTGCGTTATGTGGGATGAACCTACATGGACACACTAGTTCTTTCCTTT
CCTGGTGGTCCCCCGGTATAACAAACATAAATTATTTTGAAGCGCCACGGGTTCTTCAAGTGGGTTACTGGGAATGATGCCAG
TTAGAGGGAAAGTGGGTGGGGCCATTCCTTTTTGCACTCTTTCTTCAGGAATCCATAAAATGCACATTGACTTAGAGCTCATC
TGACTCCTGGTTTTCTATGCCCCTTCCCAGAGGGTAAGTTCTCCAAGCGTGGGAGGAAGGTCCATTTCACTAAAAGGCCAGAA
GCTTCTGGTGAATTCCATAATGCACAACCTTTTTTGAGAAGTGGAGACTTTGGACATGAGGGATTTCATGTATGATGCCCTGG
AGTTGGATTAAATACAGCATAAGCTCTTGGGGGTATTTCTGGAGGAGGCCCTTTCTGCAGGAAATTAGAATACATGCAGGGGA
TCCAGGCAGGAAGAATCACTTCCTTTGACATCGTTTGGCACCTGAAGGAAGCCCTCTCAGCATTGGGCACTGGTCCCACTTGC
TGGCTGCACTTTAGCCAGAGGCCTGCGCCTGATCATTCTTGCAGTGGGAGAGCCTTACTGGGGTCACAGGTTATAAAAATGCC
TGTCACTCTCCAGCTGAGCAAGTCCATATGCGTGCTTGTCAGTGTCAACCCCATGATGAGTGCACTCTGGAAGGTGACAATCT
GCACACAAACCTCCTCCCACTAGTTACCCACTACTATACACTACTTTAAAAATTAATACTTATAATTATATAATATAATATAT
ATTATATAACTATATAAAAATGATTATGATGATGACATTTGGCTGTTGCAATTTCTTTAGGATCTCTGCATCTCTCTTCACTA
GACATGTAAGTCTTCAATTTCTTGTCCCTGTGACACGTTGCCCAGTGTTTGAAGTCAAAGTTGTGCCGAGTACCTGAGTATGT
CCTCAGAGAAGATCTCAGCAATGGTTGATTGTTCTACAGGGACTTTTCCAGGAGACCTGTCCCAGGGAGTCATGAGGTTCCTC
TGGAAATACTAGCCCCTGCAGGAGATGAGACGGAAGATGAGAATCAAGAGCAGGTGCAACATTGTCAGCAGGAGGCTCCAG
ATGCTTTCCAGACACAGTGAACCTTCACCCACTTGCCCACACTGCACAGGGAGTTTGCAGGGGCACAATGAGGTGCCTGTCTGT
GGGATGTTGGGGACAAAGTGAAAACCTGAGCTCAGCATCCAGGAAAGTATGAACTCCAGCCCTGATAATATGTAGCCTGTGT
TTTCTTTCCTTCTACGTGAACACTTTGCCTTATTGTTAAGAACAGAGGATTCTAGCTCTAAGTGCACGGATTGCAGACAGCTA
TGACTTTCCTCCGGGCCAGGCTCCTCTTAATGTACTTCTTGGACTTATTTGTTGATGAAGGTTGGTTCCATTAAATACCAAAA
CAGGGTTCATATTAAAGAAAAATGAAAGAGTGACAGGTAGATTAAACCCGAGCATCCAGTTCCAGTGATTCTTTGACCCTGCC
TTCCCAAAAATCTCCGATATGAACAATGACAATGCCCTCCATGGTTAGATTATATTATAAACTAGATTGAGCTAGAGTGTTTG
GTGTATTAAGTCACTATTTTTTTAGCTTCCCTGTTAGTTTTTGTTTGTGTGTTAGCATTAACTTTAAAATTCTATTAATCA
GTTCTCTAGTAGGTAGAAATTCATCTGAGAGTTTCTTCTCTTGTTGTCCACTTTGATAAGATTTCCAGAAGACATAAGAACCC
TTTTTGTTTGCAAAAATATTCCAAAGTTTTACACTAACTAGGAACATATATACTTAATTCTAATTTTTAATTTGTTTAAAAGC
TCTAATAAGTGCACTGTTTTCTGCCTTTTGAGTTAATTTCACAACACATAGGAGAATATATCCTAAATGAAAGTTTGTGCTAA
TAATACAAATTATTGGTAAATAACCTCTGTTTTAATTATTGAGGTATTATCCATTAATATATAATCTTAAATTGATGTTCTCA
ATGGGACTCTTACCTAAAGAATATACAAAATATTTTCGTATCTTGACATAAAATAGATGTGAACACATTCTTAGTATTCAGC
CATGTCTCCTGTCTATCACATTATGAACCACATGCTAACTTTGATTTACTTGGGACTTGTTCTAATTTCAAACTAGTTATTTT
TTTATCTTCATGCAGCTGGATTATTATGTGTGGCTATTTTATCAGAGAATGATAAAGACAATTTTAACAATTTTCACTGCAGG
CACGTCTAGGCAAGCCCCCTGTGCACAATGACCTTCGTGGGTTGGACATTCTATGGGACTCTCCCCTGTCTGCCTAGGAGAG
TTATCTGCCTCCTCCCTCTATCATTTTCCTCTTTGAATAAGCGCATCTAACTGCCGTTAGAATACAGACAAAGGCCAACCTTA
ACTGCTCCCAGCTGACAGGGGATGCTGTTTTGGGAAGATCTCCCTTGAGGTCTGTCTAAGGGACCTAGTAAAAGGGAGCCATT
ATCCCAGGCTTCACTTGGATGACCATTTGGAGTTGATGCCTGAAGGTGAGAAGAGACAAACCAGGTTATTAGAAGACATGTAT
```

```
CAAAACCAAACAAGGTGGTAAGGACAGTTTGAAAAAAAATTCCAAGGCTGCTGACACACCCAGATAACTGGCGGCTGTAGTTA
TGCCTGCTAAGATTTGGGTGCATGGGGCTTGGCTTTCGTTAGCTCCCTAGGACTTATTTTCCCAAACAAAGAAACCTCCGGGT
TAGGGGGACCCTATTTATTCCAGTCACCTGGCATGATTTGCAGGATAAPTGCTCAGAATTAAAATATTCGTCCAGATGTTTAT
ATAGCCCATGCCTGTGTTCTTCTGAGCTGCAGCCAGAGATCAFTGGTTCGTTCACAGCGATAAGCAGAGTTAGCTCTAAAATG
GAGGCAAATACTTAAAACAATTGGAAGAGACTGTAATTTAAAGACAAAFGTATGATATGTTTTGAAACATAATTTTTCTCTCT
CCAGTTCTGATTTTTGTCAGAAACTAATCATTATAGGACTGAGTGATTFGCAAAATAAACTTTAGTCTTGTGGTTGGTCFGAT
CATTTGCATAAAGTGGAGCAATAATAATTAATAATAATTCTGTAGGAAAAGCCTGCAAGCACCAGGGAGCTTCACAGTCTAACA
GTATGAGCACATGCATCCTCCAGCAACTCACTGAATATTTTCAAGTCAGCTGGTTCTTAGCTTAAATAACATCCAGTTGGTAT
CTGTCCCAGGAACACTAATATATGGTTCTCTCTGCAGGCCCCTCTCGCCACAGATTTAAGGTTTATTTTTTCCTCTGTGATA
TCAACTCAGATATGTTGAAGGTTTTTCCCACATTTGTGGTTTTTCAGGTTTGTTGTTAATAAGGTCAGAATAAGATCATAGTT
TACTCATTTTTTTACATTCCCATGCTGAGTAGCTACTTTTCTCTATAAAATCCATTAGCTGAGAGAAAAAATAACATTTTCCT
AACGGTGAACAATTAAATAGTTTGACATATATTTGTGTACCAGTATATAAFGCAGCTTCGAATCAAGGTGTGCCTCAATCATA
AAAAACATGGCTAAATTCTCAAAGAATTGTGCTGAGTGAAAGAAGCTAAGGAATTAAGAGTAAATTTTATATAATTCATTGTA
GAAATATTAGAAGATGCCACTACCATAAATTAAAATGAAGAAGACTTAAATTTTTCTGAGAAAATGGTGTTGGGAATGAFGCG
GATGTGATTTAAGTTTCAGAGGAATAAGGAAAAGATTTAGGGATTAATTTAATTATTCAAAAGTTGATTGAAGTGCCGAGTG
AATGGCTGCAAACATAGCCTCTACAFTTTTCAAATCATTCCCTATAAATCTGAATTAATTATTTATTTATTATACTTGAATAAA
GCAATAACGAAGAAATAAATGAATATTTTTGCTAAAATGGAGCAATAAAAAGACTGATATTGACAGAAGAAATATGACTGACT
TCTGAAAACACACATGAACCATGGTTCTCTCTGCATATTTAGGTGAATTACAGAAAGTTGTCATAACAGATGGGGAATCCTGC
AGACTTCACTAGGCATGGTCCACGCTGCCCTGGAGTTGTCTCAGGGGAGCTGCCTCCTCCGTGATTAGAGCACAGGCCCAGA
TAATAGGATTACATTTTTTTAGATGTGTAAACTTAGACGCACTGCACAGCTGCTGTATTCTCTATGTAAATTATCTTCTGTAA
AATACAACATTAAAGGCTGCATTAAATATATTGTGTAAATATGTAAAAATAAAATCAGATTATGAGAGCTAAATGTTAATCAA
GGCACAATCACATAATATAAAATTATATTTTCCTGAATGATGGAATTACTACCAATCTCCCCCAGGAGACTTCATCTGCACTG
GGCCCGGCCTCTCCTCAGATGTCCCATCACAGAGCTTGCTATATAATGGGGGACATGCAAATAGGGCCCTCCCTCTGCTGATG
AAAACCAGCCCAGCCCTGACCCTGCAGCTCTGGGAGAGGAGCCCAGCACTGGGAFTCCGAGGTGTTTCCATTCAGTGATCTGC
ACTGAACACAGAGGACTCGCCATGGAGTTTGGGCTGAGCTGGGFTTTCCTTGTTGCTATTTTAAAAGGTGATTCATGGAGAAC
TAGAGATATTGAGTGTGAGTGAACACGAGTGAGAGAAACAGTGGATAFTGTGTGGCAGTTTCTAACCAATGTCTCTGTGTFTGC
AGGTGTCCAGTGTGAGGTGCAGCTGGTGGAGTCTGGAGGAGGCFTGATCCAGCCTGGGGGTCCCFGAGACTCTCCTGTGCAG
CCTCTGGGTTCACCGTCAGTAGCAACTACATGAGCTGGGTCCGCCAGGCTCCAGGGAAGGGGCTGGAGTGGGTCTCAGTTATT
TATAGCTGTGGTAGCACATACTACGCAGACTCCGTGAAGGGCCGATTCACCATCTCCAGAGACAATTCCAAGAACACGCTGTA
TCTTCAAATGAACAGCCTGAGAGCTGAGGACACGGCTGTGTATTACTGFGCGAGAGACACAGTGAGGGGAGGCCATTGTGCGC
CCAGACACAAACCTCCCTGCAGGAACGTTGGGGGAATCAGCGGCAGGGGCGCTCAGGAGCCACTGATCAGAGTCAGCCCCGG
AGGCAGGTGCAGGTGGAGGCTGTTTCCTGTCAGGATGTGGGACTTCATCTTCTTCCAACAGTTTCTCTAATGAACCTCTCTAA
TTTTAGAATTCTGTGGTTCCTAATGTCATCTCTACATATTTTCAAAAGATCATTTTAACATGAGGACATAACCTCTCATGCAC
CAAATGCACATTGATGCTTACAAAGATGAAAAGTTCTCAACCATTGTGACCAGGATCGCAGTCCTGAGGAAGCTCACGGGTGT
CTGATGAGTCTCCTCCATTCAGGCCCAGGACAGAAACCTCAGAGGGATTCCTGGACCAGAACGGCAGGGATTCTGATCACAGC
CAATAGAGAGGCTGGGCCAGGGTCAGTGTCCTGTAGAAGCTCACAGGGFTCAAGTCTGACCCTTCTCCTGACCCTAAAGCCAA
TGAGCATCAGCCACTGATCTGGTGCFGCTTTTGCTCCCAATACATGTTCFTTCTTTGGAGTGTTTGTTCTCCCTTTTTTAFTTG
CTTTTCTTTCTTCCTGAAAAAGAAAACACATGGTCTCTGTGATCTACACTCCAGGGCTCAAGGCATTTTCTTAGAACTCAGGCA
AGGCTCAGGCTTGGCTACTCCAGCCACGTGGGAGAGGCTGACGGGATTTCCTTCTCTCTCCATATTCTCAGGGCCCTCCTCTG
TGTTGTGTGTAGACTCATCTGGGAATGCAATTGGCTGTTAGTAGTGAAGGGGATGAACTCATTTGATCAAAATGGGATGTGGA
TGTGGAATTAACCCTGTTCTATGCACACTGTCAGAGTCATCTTCTTCAGAAGTAGTGTTAGAAAGAGCTTGTGAAATTTATCG
GCAACAAAATGGATCCCCTTGTGTTAAAACCCTAATGAATGAAGCTGGGGAAGGCCATGAAGGAGGGTTCTAACACATATTCC
TGATAAGATGAACTGTCATAAATAGACTCTGCACAGCCACAACCTTTTACACGGAGACCACCACAGCCTTAAAAGCTTTATTT
CTCCAAGTAAATCTGCCCTGCAACTGCCTGTTCAACCTTACACCGCTGTCTCAAAATAGCTGCTGTCACCCTCCTCATTTTTC
CTTAATTCTCTTTTTTATTATTTTTAAATTATACTTTAAGTTCTAGGGTACATGTGCTCAAAGTGCAGGTTTGTTACATATG
TATACATGTGCCATGTTGGTTTGCTGCCCCCATTAACTCATCATTTACATTAGGTATTTCTCCTAATGCTATCCCTCCCCCTT
CCCGCCACCCCATGACAGGCCCCGGTGTGTGATGTTTCCCACCCTGTGFCCACATGTTCTCCTTAATTTTTTTATCTTCCFTTT
CCTACCTGAATGTACCCATACATATTTTAATTGAAATGCACATCCTGGAAAAAATATTATTATACTTTAGAGTCTCTTTCTGT
CTGTTATTCAGGTTGACAAGCTGCAGACGGACATGCCACATTTCTGTGAGACATAGAGGATGACATTTTTGGAGATGTCTAG
GAATCTCCAATGTCCATAAGATCAGCCATCAATAAATGCAGACTGGAGGTCCCAGAGGAAGTGAAGCTGCTGAATCGCCGTG
GAATTTCATTTTCTCCAGTTCTGCTCTGATGGAATCAGGCCCACCAATTTATCAATGACAATCTACCTAACTTAGAGTCAAT
TGATAACAGTATTAATATCATCTATTAAGTAAATTCATAACTATATATATAGTAAGAGAGGGAGAGAGAGACAGAGTCTCG
CTCTGTTACCCAGGGTGGAGTGCAATGTCATGAFCTTGGCTCACTGCAACCTCTGTCTCCGGAGTTCAAGCAGTTCTCCTGTC
TCAGCCTCCTCCCAGTATCFGGAAATACAGGCACACACCACCATATCCGGCTAATTTTTGTATTTTTAGTAGAGACAGTGTTT
CACCACATTGGTCAGGCTGGTCTCAAACTACTGACCTCAGGTGATCCACCCGCCTCAGCCTCCCAAAGTGCTGGGATTACAGG
TGCAGGCCACCAAGTCCGGCTAATFTTTGTATTTTTAGTAGAGATGGGGFTTCACAATATTGGTCTGGCTGGTCTCAAACTCA
TGATCTCAGCCTCCCAAAGTGCTGGGAFTACAGATGTGAGCTACTGTGCCCGGCCAACATCACCTATATTAATGTTGGATTGA
ATAACTACAAAGTCTACCCTAACCAAGTGTACCATCAAACTTACCATTACCCAGAGGGAAGAATCTTTAACATGAGATCGATT
TCTTAAGTGTTTTAAGGTGCAAAACTGACCACTGTACAATCACCCAATTATGATTTTGCTAATGAGTTGTAGAAGTTGCATGT
ACATTTTGGATATTAACACTTTTTCAGATGCAGCTTATAATTATATTCTCTCTTTCTGTGGGTTGGAAATTTTTCCATGC
TTTGCAGCATCTTTTTGCTGTGATGTAGTTCTGCTTGTTCAATTCTGCTTTTATTGTCTGTGCCTTTAATTTGAAATATAGGA
AATCATTCTTAATATTATTTTCTGGGTGGGGAAATTTTACAATTGCAAGCCATACGTTTAAGTATTTCGCCCATTTAGAGTA
AATTTTTGGTATTTAATCTAAACTAAAATTCTTAATTCTTTGCAFGTGTAGATTCAGTTTTTCTAACACCCTCTTAGGGAGAGA
CTTTGATTCATCCATTGTATATTGTTAGTTCTCATGCTGAAAATCAGTFTGCTGTAGATATATTAGTTTATTTCTGAGCTCTC
TCTATATATTAATGCCAATACCATCCTGTTATTATTTATGGATCAAAAFGTGCATATTTGTGAATTTCAAAATGTTGTTCAGA
ACTTGTGCATGCCAACAACTGTGTTTCTCCTGCACTCTTGGGCFAGTGAAGCTCTCACAGACCCTCTCTCACCTGTGCTGT
```

```
CTCTGCATTCTCCATCACAACCAGTGCTTCCTGCTGGAGCTGCATCCATCACCCCCGCAAGGAAGGGACTGGAGCGAATCAG
GTGCACAGGTCATGAGGGAGTGCACATTCCAACCCACTCCTCAAGAGTCCAGTCACTATCTCCAGATCCACATCCAAAAAACA
GTGTTTCCTGTAGCTGAGCTACCTGAGCAACAAGTACACAACCATGAATTTTAATACAAAAGACACAACGAGGGGAAGTCATT
GTGAGCCCAGATACAAACCTCCCTGCAGGGGAGCTCAGAAAGAGCAGGAGGCACTCAGGACACCAGGGAACACTCTGGACACA
TCAAGGCAGGTGCAATGGGGGGACAAGGGGCTGGAGATGGGGTTTGGCATCACCATCGTATTTCACCACTGGACACCCACCAC
CGTGTTTATTCTCATGTACCTGATTCTGTGTATTATTAGAAAATGGCATTTATATAAATATATAGCCATATGTAGGTGCATCA
AGTTGTCCTCTCCATCGTATGTGGACCTTTCCACTAAGACTCTGAGTCCCTGTATTTATATGAGCACCTCATAAATTATGGTC
AATTTTGTGGGATCTCTATCTTTTCTTTCTCCCTTCTTCCCTCCTTCTCTCTCACTCACAAACTCACACACACGCAAAATTCT
ACAACTTCAGTTACGTGATGTGTTGAAGACAGTTTATAATGTGCAGCTTTTCCAGTTTAGCTGATGTTCATATTGCTGTGAGA
ATAGGAACATTGTGTTTCTCAGCTGTGTATTTCTCTAAGGTAGCAGCAACTTTTTTTTTTAATTTGACATTTTTTAAAAATTT
TATTATTATTATACTTTAAGTTTTAGGGTACATGTGCACAAAGTGCAGGTTTGTTACATATATATACATGTGCCATGTTGGTG
TGCTGCACCCATTAACTCGTCATTTAGCATTAGGTATATCTCCTAATGCATTTTTTAAATACCCAGATACTGAAAGCAATCC
AAATATCAATCAGCAGCTTAATCATAAACAAATTGTGGTAAATTCATTCCCTGGAAAATCACCCACTGTTACATTCTGGTACC
GCTGGATACGTTCAACAGCAAAGGTAAAGTCACAAGTACATATGATGAGTCAAATAAGACAAATAAATACAAGTACACACATA
CAATTCCTCTTTTATAAATTCTATAAAATTAATACCAATCTAAAGTTACATAAAGAAAACCAGTAGTTGACTCTGGGTGTGGT
GTGAGAAGGAAAGGTGTAGGAACAAGAAATTACAGGAAAACAAGAGGAAATTTTGAGGGCACTTGAGTTTTTTCTGTGTTCAG
AAAGGTAATGGTTATGTCACTATTTGTCAAATTGTGCACATTATGGGATGGCTATTATTTGCTAATTTCACCTCATTAAAATA
TGCCAAATTTAAACACATATAATTTGGTAGAAAATAAGTTAGACAGAGATGAATAAAATATATGAGAAATAAAAAAAGAAAAT
CACCAGAACGTTGGCATAAGGACTTCACTCATCAAACTGAAGAAATTTTAAATTTCTCAACACAGAATTAAAGATTTAATTAAA
GATATATGAGAAATCAAAGACTCCTGGATATATACATGAATAAACCCTAAGCCTACCTATATTTTAGGGAAACACTAGAATA
CAACAAAATAATGTCATGAATTCATTACATAATGGGCGTTAATCAAACCCCACCAGGCATGTCCAGCTGTGTCCTGGGGTTGA
TTCAGGGAACAGGTGTGTCCTGTGGTTAGGAGAAGTGGCAACAAGCTCACAGCATCTGTTCTAGTTGACACCATAAAAAGGCC
AAGAGATCACAACCAAAATGTAGTGTGGATGTCACATCTGTGAGTGCCGCACACTCCCCATGTGAATACGAAAAGGTTGATT
ACCTCTTGAGGTGTCTGCTGAGAGTAGAGCTGGTCTCTCAGGAATGTCCAAAATGGCTCGATAGAGCAAGAAAGGAGACTGGC
TCAGGTTGCTATACCAGTTTGGTGGTGGAGGCAGAGTGAGGGTTCTCACTCACAGAAATGGGTTTGTGGGGTTTGAACCTCCA
AATGGCATCAAATGAGGGAGTTCTTGTGATTCCTAACTAGATCCACCTCGTGTCGGAAAGAAAGGAGATGATGGAGGAATGAG
CCTTAAGTTATCAGCAGTCAGACATCAAAACAAGTCTGATGACTTATTCTATGTAGCAACTATAAATAAATGAATAAAAATAG
ATCATAATGAATTATTCATAATAAATGAATAAAAATATGAATAAAAATAGATCAGTGTCCAATATGGGTGGACAAAAACCAGT
CTACACAAAACAAGAAGACTGCTTATAAGAATAAGCAAATCATAATGAAAAGGAGGAAAATGAGGTGAAAGGCACGGGGCAGG
GGATTACAAAGGGTCCTGTTCCAATGTCTTGTGTGGAGACTTTTCATTACCTAAAATCATCCGCTTGTTCTGAATGTCTTAG
GTGAGCTGTCTGCTCCAAAACATCAGAAGCGCCAGAGGATTCATGAGGATATTCAGTTTAATATCTTCTATTTAAGGTGCCTT
ACAATAGTGTAAAATTCTTAATTATTATTATTATAATAAGAGATAGGGTCTCACTGTGTCACACAGGTTGGAGTGCAGTGGCA
CAACCATAGCTCACTGTAACCTTGAACCTCTGGCTCACACAATCCTTCTTTATAAGCCTCCTGAGTAGTGAGGACATGAGACC
AAGCTGATTTTTTTTTAATTCTTTCATAGAAGTGGGGTCTCTCTATGTTATCCAGGCTGGTCTTGACTACTAGTCTTATGTGA
TTCCCCTGGTTTTGCTTCTCAAAGTGGTAGAATTATAGACATGAGCCACGATATTCGGTCTGAACTGATTCTTTAGTTGCAAA
ATATCAACCCAAGAATTGACTCCCTTAATTTTTTTCTGCAGTGTTTTGGTTAATATTGCCTGATAAAATTTATTCTAATTTGT
TTCAACAGCAGAATTCTTCCTGACGTTTTTTCCAATATATGTATTTTCATGGTTGAAGATCACAAAATACTGTTAAAACATGA
CATAAAAAGGCAACCTTAAACTTTTGGTGATTGGAGTTAGTATAATACAAAAATTACGTCCAATATTGTGTAACACACACATG
CAAAAAGACGAAGGTGAGCAATGAGGGTAAACTTTCTAAATGTATGAATCTTCCAGCTCCCAAGTCATAGGATAGTAACTGAT
GTGGCCTGAGGGAGGTACCAGAGTGACACAGTGCTAGTGGCATAACTCTTGGCCAAGAGACTTTCAATATTTTATTAAAGTTT
TTATATTTTTTAATTTAATGATGCCATTTTTTTCAACATATTCAGAATATTGTGAGTGGGATTGATTCTGGATGATATGAAC
AATGGGAATGCCTTCTATGTTTAGATAATATTAAGGACCAGGTTGAGATTGAAAGTTTGTAGAAATGATGCACCATAACATTA
TTCTAGTTTCCATACTAGGTTTTTTCTCTTTGCTTGCATTTCATTTCAAATTTATATGTCAGATATCTAGAATGTAATAATTT
ATTTAAAAATTTCTTTTCTTGTAGTCCATTTTGATGGGGCTTCCAGAAGATTTGAAAACCTCTTCTGCCTGCAGGACATTTTA
AAATTCTGCACTACAGTAAAACATCTGTATTTAATCATGGTCTTCGGTTTATTGACAAGCTCTAGTAAGTGCAATAACTTCTG
CCTTCTCGGCTGATTTTACATCAGATAGAGGAATTTATCTTAAATGAAAGTTTGTACTAGCAATATAAATTATGAGTTAATAA
CCACCACCTTTATTATTTAGGTGTTATTCATCAAGAAATAATGTTAAATCAAGGCTCTCAACGGGAATATTATCTAAGGGATG
CACAAAATGTTTTGCTAATCTAGATAAAATAGATGTGAACACACTCTTAGTATCCAGTCATGTCTCCTGTCTGTCACATTATT
AACCACACGGTAACTTTGACTTCACTTCGGACTCGTTCTCAATTTTCAAATTCGTTACATATTAAGCTTAATGTCTCTAGACTA
TTCTAGCAGAGTGAAGAAACAAGCTAGACTGACAAACAACCTAGGATGACAAACTTCTTGTCACTCTCTATAAGAACTTGC
TTCTCCCTGAACTTCAGACTTGTCGCGTGTTTTGAAACATTAATTATCAAAGTATTAAAGAAAATTTGCAAAGCTACATCTT
CTATGTTTATGTTATTGTTGATGCAATTGTAAAAAATAAGGAAAATGTATTCCTTTTCTATGTGCGTTTCCAAACTTAATAGC
AGATTTTTAGTAAGACCCAGAATAATAAAAAATTCAAATATTGTTCAGCTGCTTAACAGAAAACAAATTATGGTAAATTTGT
TTGCTAGAATGCTATCCAGTATTTAGAATAAATAAATGTCTGCTATACCCAACTATAAGGTAAAATATCGAATTACATATGTT
AAGTAAAATAAGCCAAACAAATAAGAATATATACTGCATTGATTTGTATAAATTTTAATAAACTAAATGACTCAGCCGCAATG
TATAGCTCAGGAGTTGCCAGAGAAATGGTAGAAGAATGAAAGGGAAAAGGAGGAAGAATGTAGAAGAACAAAAGGAAATGTTG
AGAATTCTCTTGTCCACCTTGATAACAATGATGGTTACATTATATTTATCAATTGTACAATTTAAATATGTGAAAGTTTATTA
TCTGTAAACTAAAACTCTCAAAATTTATTACAAGCAAACAATGGAAACTTAGACAAAGAAGGAGTGATAGAAAGATAGAAAA
AATGTATATTAAATTTCAGAAATACCTAAGAACTTATCTGCCTGAACCCTAGTTCTCACCATATTTTAGGTGAATGCTAGAA
TGCAGCAAAATCACACGTGTTCTCACTACAGAAAGTGGGTTCCACAACCACACTAGGCACGCCCCAGCTCTGTCCTGGAGTTGG
CTCAGGGAGTAATTGGGGCCAGTGATGAGGAGCACAGGCTCAGGTACTGGGGCTTACTCATCCAGACGTGAGCTCTTAGACAC
ATACTTAGCCCTTTCTCCATGCGTGGTTGACTTCCACATCTGTACATGGAGAAACAATTGACTCCGACAAAACATAATTTGCA
CAAATATGTAAAAATAAAATAGGATGATGAATTCAAAAAGTTTATCACAGCATAATTTTTATAATAAGACAGCATATTTTCTGA
GTACCATCGTTGTCACCAAATTCTTGCAGGGCACAGTCATTTTATCTGGGTACTGCCTTCTCGTCAGGCTTCCCACCCCAGAG
CTTGCTATATAGTAGGAGACATGCAAATAGGGCCATCTCTCTGCTGAAGAAAACCAGCCCAGCCCTGACTCTGCAGCTCTGGG
AGAGGGGCCCCAGCCCTGGGATGCCCAGGTGTTTCCACTTGGTGATCAGCACTGAACACCGACTACCAACCATATGAAGTCTG
```

```
GGCTGAGCCGGTTTTTCCTTGTTGCTATTTTAAAAGATAATTAATGGTGAACTAGAGATACTTAGTGTGAGGGGACATGAGTG
AGAGAAACAGTGGATAGTGTGGCAGTTTCTGATCACGATGTCTCTGGAGGTGTCCAGTGTGAGGTGCAGCTGGTGGAGTCTGG
GGGAGGCTTGGTACAGCCTGGGGGGTCCCTGAGACTCTCCTGTGCAGCCTCTGGATTCACCTTCCGTTAACTACTGCATGCAG
TGGATCTGCCGGGCTCCAGGAAAGGGGCTGGAGTGGGTAGGTTTCACTAAAAACAAAACTAATCGTGGAACAACAGAATACGC
CGCGTCTGTGAAAGGCAGATTCACCATCTCAAGCGATGATTCCAAAAGCATCGCCTATCTGCAAATGAACAGCCTGAAAACCG
AGGACACGGCCGTGTATTACTATACCAGAGACACAGTGAGGGGAGGTCAGTGTGAGCCCAGACACAAACCTCCCTGCAGGGGC
GCGCGGGGCCACCGGGGCGGTCAAAACCCACTGAGGACAGGACAGGTCCCAGGAGCAGATGCTGGGGTAGTTTTCCTTTCTC
ATCAGCTGGAGAAGTCAGGTTTGTATTTGCAGGACTCTGCAGCATTCTAGGCTGTGACATTTTATCACTTGTATTTATTATGA
CTTTATTATCGTTAGTATTTAAATTTTAGTAATTATTAAAATTATATATAAGTACATTTTAAATATGTACTTTGAAGATATAA
ATATTCCTAATTATTTGCACTGATTCTTCCAGAGTTTTATTAACATTTGTTGACATCAGCAACTACATAGCTATAGGGACATA
AATTTATAAACATAGAAATATGTATCGGCAAGCATGGTGGTCTGTGCCTGTAACCCCAGCTTGGGAAGCTGAGGCAGAAGTA
CTGCTTGAACCCAGAAGGCGGAGGTTGCAATGAGCCGTGATCGCACCACTGCACTCCAGCCGGGCAACTGAGACTCCATCTCA
AAAAACTAAATAAATAAAAAGAAAGAAAGAAAAAAAGATGTACAAATACACAGACCTATGCATATATGTGTAGGCATTCATAT
TAAACATTAAGATAAAATAATTCTAAAAACATGTCCTGAAGAATCAAAATTAATGATGAACTAAATATAAATTATTAGAGTAA
TTCATAATTGATTTTGGTTATTTTTAATTGTTTACATGCTTGTGATTTTACACAAAATATTAGTCATTTATCCTGATAAAACAG
GTCAAAATGTTATATCAAGAGTTTATTTACTTTGTATTACTAATAATATAAAATGTTCCACATATTTTTAGCCATGTTTTACT
TATCTGTGAAATGTGTTTATTAATTTTTCATTTTAATATGTCACCTTTATCTTTCTAATTTCCTGGATTTAATTCCACTACAG
CTGAATGCATTTTAATAATTATTGTAATCACATTTACATTTTTATTTGAATTTTCATATATATTTTATTAGGATTTTAATAT
CAATATAAATATTTTCCTACCATTGTCTATTTTCTATTTTTATGATATAAAATTAACATAAAAATGCTTAGATTTTCAATGTA
CAGCTTGAGGGCTTCTGACAAATGTGCGCACAAATAAGAATTATTTGCTTACTTTTTAGTGTATACTGAGGAGTGGGATTGCT
GGGTAAAATGATATCTCTGTTTTAAGTTCTTTAAGAAATCTCCAGTCTGCTTTCCAAAGGGGCAAGATTAACTTATATTCTTC
TCATCAGGGTATAAGTGTTCTCTTTTCTCCAGAGTCCCACCAGCATTCATTGTTTTTGACTTTTTCGTGATAGCCATTCTGA
GTGGTGTGTTGCTGCACACCTACAATCATCTCATATTTGATAAGGCTGATGAAAACAAGCAATAAGGAAGGGACTCCCTGTTC
AATAAATGGTGCTGGGACAACTGGCTAGCCATGTGATGAAGATTGAAGCTGGACGTCTACTTTCAACATACATAAAATTAACT
CAAAATTGATGAAAGACTTAAATGTAAGACCTCAAACCATAAAAATCCTTGAAGACAACCTAGGAAATACTCTTCTCGACCCC
AACTTTGACGAATAATTTTTGGCTGAGTATCCAAAAGCAAATTCAACCAAAACACAAATAGATGAGTGGGACCTAATTAACTA
AGGAGTTTCTGCACAGCAAACCCGCCAGGAGATAGATGCTCAGGACACCAGAGAGAACTCAGTTAAACCAGGGGGCGCTCAGA
ACAGCAGAGTGTGCTCAGGACACCAGGGGGCGCTCAGAACCACCAGCAGGAGCTCAGAACAGCAGAGTGTGCTCAGGACACCA
GGGGGCGCTCAGAACCACCAGCAGGAGCTCAGAACAGCAGAGTGTGCTCAGGACACCAGGGGGCGCTCAGAACCACCAGCGGG
CGCTCAGAACAGCAGAGTGTGCTCAGGACACCAGGGGGCGCTCAGAACCACCAGTGGGCGCTCAGAACAGCAGAGTGTGCTCA
GGACACCAGGGGGCGCTCAGAACCACCAGCGGGCGCTCAGAACAGCAGAGTGTGCTCAGGACACCAGGGGGCGCTCAGAACCA
CCAGCGGGCGCTCAGAACCACCAGGGGGCGCTCAGGACGGCAGGGTCGCTCAGACACCACGGTTCCCTTAGGAGGCAGCTCC
ACATTAGGTCCCTGGGCAGGGTGGGGTTTCCTTTTTGAACTTGCTATTTTTGACCTTGTAAAGCAAAGGTCTTCCCCAGGAT
CTCTTAGTATTTCTTCCTTGTAACTCATGTCTTGTCTTGTTTTGTTTTTGTTTTTGTTTTTGTTTTTGGTCATCTACAAAAA
CTTAAACTTAGAACAGTTGATTCAGAAAGGCAGGAAAGCAGGCATTCCTCTAAGTCTCCCCTGAGACAAATACATATATGATT
TCTTCCTCCCCACTATAAATTTATGTAAAAATGAAGATTCACTGAGTCAGACTAAATTGTGTATTCAGTGGAAGGATAATAAAT
GACACAAAAGAATGCAACCTATTGTCTCTTATCTTCTTCTAACCTGCAAGCCCCCATTTTCATTTGTCCTGGCTTACAGGAAA
AAAAAATGTACATTTCACATGTATTGACTGATGTCTCATGTCTCTGTAAAATGTATAAAAGCAAGCTGTACTTCAATCACCTT
GTGCACATGTCTCAGGACTTCCTGAGGCTGGTTATGGTGGGTTCTTAACTTTGGCAAAACAAATGTATTAGTCTGTTCTCCT
GCTGCTGATAAAAACATAATCAAGACTGGGTAACGTATAAAGGAAAGAGTTTTAATTGACTCACATTTCCACGTGGCTGGGGA
CACTTCGCAATCATGTCAGAAAAGGAAGGGACATCTTACATGGTGGAAGACTAGAGAGAGCTTGTGCAGATGAATTCCCCTTT
AGAAAACCATCAGATCTAATGAAACTTATTCACTATCATGAGTTCATCATGGGAAAGACCTGCCCCTATGATTCAATTACTTC
TCACTGGGTTCTTCCAATGACACATGGGAAATGTGGGACTACAATTCAAAATGAGTTTTGGATGGGGACACAGACAAACCATA
TTAATAAACTTCCTAAATTGACTGAGACCTGTCTCAGATATTTGTTGTTTATCCTACTCATGTACAGCCTTCAGAGTTCCAAA
GCCTATATCAGTTTTCCAGGATTGTTTCCCCTTTTTGTTGGTTATTTCCTCCTTTATTTTCTATGTTAGTTCCCTTTTTCTC
CCACTATTTTTCATCATTGGGATGTGAGACTTCACAACATTTGAAAGGTAGGTAACAATGAGCTATCTTAACAACATGGGAC
CTGTTTATCTAAGAGTAATCCATTCTATCAATGAAAGATAAAACAAAACAGGAGACCAGAAACTCATTTGGTTGTAAAATGCT
TCCCTCTGAATGATTTTGAAAAGGAACAGGTGGGGAAAATATAAAAGGAAAATAAAAACTTGTGCTGTCAATTCATTATGTCAT
GAGGGGGAAAATCCTAAAGGATGATCCATGCAAGAAACTGATTTTCCTTTCATTCCTAAGAGAATAGCTACAAATAAAAAGT
TAAAATATCTTCACAGATAGCTACTCTTTGTTCATTTTACTTTATATAAAGTGCTAACTTAGTTCAGGAGAACTACATAATTTT
TCTGTTTCCCTATGTGCTTCTCTCTCATTACAACATGTAAATTTTCATACTGTCCCTCTTTCCCCTCTATCCAGCTTTCCCCC
CTTTTTTGTATTGAAAGCCCTGAAAATCATCTTTGGGGAACGGCACTGACCACAAATTTTTCTGTGATTACTTGTATTTTCAT
TCCAGGCATGCCCTAACTTTGGCAAAATTAATTTTAATTTGATTGAGATCTGTCTCGGAAACCTTTGGTTTACACTAGGAAAG
ATCCCAAATTACGAGTCAATTACTATAAAGCTCAGCCTTCCCACTGTGTATGTGTGTGTGCATGTGTGTGTGTGTGTGTAC
ACGTGTGTTTAATTTTTGTGGCTTTGAGCCATGTAGTTCTCTCTGTGGACATACTATTTGGCGTGATCTTTGAATAGAGAA
TTCTGAAAGAAATAAGAGGCTCCTATGAGTTCTCTGAAAGTTTCTGGACTCACCATGGATCTTGACTGTGTCATTGCATCTGA
CAGTCCCAGGGAACAGACTCTCTGGTGGTTTCAAAGAATCTGTGCTTGGGCTCCCCCTGCAGTTTACTGGGTACAGTAATGTT
AAATCACTGTTTCGAGAGACAATTTCGAAAGCATTAGATGCTGCTGAGAGAGGATTGTGAACCAGGGGACAGCCCCTTCATTC
TGGGGGAGCGACATTGGGAGAATATGCTCTGTGAGCCCAAACAGCATCCTCCCCTGCCGGGTGAGGGCAGAGCTGCAGGACAG
GCCCAGAAACCACTCAACACGATGTCAGCCTGCAGGGAGGAGGAGTCTGAGGAGAAATTTTACCAGCATCTGAATT
ACACTTATTTCAAAACAAAAATGCAATTAAAAAGTTAAAATAAGTAATTAATGTCCAGGCACAGTGGCTTACACCTATAATCC
CAGAAATTTGGGAGGCTGAGGTGGGAAGATTTCCAGGAGTTTGAGATCAGTCTGTGAAACATAGTGAGGCTTCATCTTTACTT
TTGAAAATAAAATAAAATAAAACATAAATAATTTAGCAAAAACTACCGATGTGTCTTCCATATCCCATCGTACTTAGAGCATT
GATGTAACCCAATGAGTCAATGAGAACCAAATTTGAAAGGAGAAAATTTTAGAGTTTTCAGATATCTTAAGAGTTGGAAGATG
TAGAACAAAACTAATTTTATCAATTCAATGTGTGCAAACATGGAGAGACACACTCATGCCAGTAGTTCAACTTGCAAAGGGCA
AAAACCAAAAAGTTTGAAGTTGCTAGTGATCCATTTGTAGGTGAGATCATTTTGAGGATCATGTCCTGTGAGAGGCTGTTTC
```

FIG. 6 (Cont. 20)

```
TCTATTAGAGGAGTTCTGTGCTCATGAAGTGCTGGACATGCTAGGGGACAAATATCAGTAAACAAACATCAGAACTTGAATGT
CAGCTTCCCCCTGCTGCATTCTCCGTGTGTCATCTCTCTGTTATTTCTCATGCTAGATCAGGTCTTTAGCTATGAAATATTCC
ACCTAATTTACATGTCAATAGCTTGAAGTCTACTGAGTTTAATTCATATTTTTCTATATGTTACAGTTACAGTTTGTCCACA
AGGACAAGGTTTGTCCACAAGTTTGTCCACAAGGTTGTCAGTTTGTCCACAAGGACTCAATCATAGAAGTGCAGAGTCCTTTTC
GGGCCACATTTAATTCACTTTATCAGTGCCCTTCAGTATGTGGTTCCTGAGAATTTCACATGACAACACATTTACCACACTGG
AATTTAAGCAATCCAACACATGTTTGTAGCTTTATCTTGTAATAGGCTGTATTTCATATGGCAGCCTCTGCTTCAGTTTAGCT
AACACTATGGCTTTGTTTCTCTCTACAAGAACTTGTTTCTCCCAAGATTTCCATGTTTGTGAAAGGAAAAGAAATCTCTGGGA
CCCCCAAATCACTAAGCCAAAGGGAAAAGTCAAGCTGAAAACTGCTTGGGGCAAACCCACCTCCATTCTTTCCCTAAAATGAT
AGCTACTAACTGTCAGGCCTCTGAGCCCAAGATAAGCCATCATATCCCCTGTGACCTGCACATACACATCCAGATGGCCGGTT
CCTGCCTTAATGGATGACATTCCACCACAAAAGAAGTGAAAATGGCCTATTCCTGCCTTAACTGATGATACTATCTTGTGAAA
TTCCTTCTCCTGGCTCATCCTGGCTCAAAAGCTCCCCTACTGAGCACCTTGTGACCCCCTCTCCTGCCCGCCAGAGAACAACC
CCCCTTTTCCTTTACCTACCCAAATCCTATAAAACGGCCCCACCCCTATCTCCCTTCGCTGACTCTCTTTTCAGACTCAGCC
CGCCTGCCCCCAGGTGAAATAAACAGCTTTATTGCTCACACAAAGCCTGTTTGGTGGTCTCTTCACATGGACACGAGTGAAAC
TAAGGTTTTAAAAAACTACATACCTCCTTCAAAATTTGACCACAAGGAAAAACCTTGTGGACCAACAACAGACAGAGTCATTT
CTCTGCTCACATAAGTCAAATGCCTATCTGATTGCCACCATTTCTCTATTGTTTGCTAAGCCAGACTAAGGCCTACGTGACT
ATTCCTGTAAATTGTGCATTCAGTTAAAGGCTAATCAGAAACTCAAGAATGCAAGCATTTGTCTCAAACCTACCTGTGATC
TGGACGCTCTCTCCCCACTTCAGAAAGTCCTGCCTTTCTGAACCAAACCAATGTACATCTTACATATATTGATTACTGTCCCA
TGTCTCCCTAAATTGCATAAAATCAAGCTGTGTCCCACCACCTTGGGCATATATCGTCAGGACTCCCTGAGGCGGTGTCACTG
CCATGTCCTTAATCTTGGAATACGAACTTCCTAAATCTATTGAGATTAGTCTCAGGTACTCTTTGGATTACAGGTTTGTTTTT
TATTTCATAACTTCAATTATCTGAAATACTAAACAAAATTTGCCAAAGTGTACATTCTCTTGTTGCTGTTGTTGCAAAAAATA
TATTTATGTAACTTATATATAATTTATCATCTATGTGTGTTACCAAGCTGAGTAGCAGATTTATTAGTAAGACTTAGAGAGAG
TAATGAAAAATTCAAATGCCAGTTAGTAACTTAATAGAAAACAAATTATGCTACATTTGTTTGCTGAAATGCTACCCATTAT
TTGTAAGAAATAAACACATGCAACATAAAAGATTTAATTCTCAGTATTCTATTGAGAGAAATAATCCACATACATAAGAGCA
TATACTATATTTTTTCATTCTTATAAATTCTAGAATATAAAAGCTAGTCAAAAGACATGTGAAAACATCAGTAGATTTATAAA
GAAATGGTAGAAGAAGGGAAGGAGAAAAACCAAAAAAATATAAAAGAGCAAGAGGAATGCTGAGGGGAGTTGACTTGTCACCT
TCTTAAAAATAGAGATTTTATTTTTCAAAGTTTACTATTGTACAGAATAAATATGTGAATTTTCTTATCTGTCAATTAAACCT
CATAAAATTTATTACAAAAAAACTGAAATTTTAGACAAAAAGAGGGTGATAGGAAGGAACAAATAAATATGTTAAATGTCAAA
TATACCTAAAAATTTATTTGTCTGACCCCTAGTTTTCTCCGTATTTTTAGGTAAATGCAGCAAAATCACACAAGTTGTCGTGG
CAGGAAGTGGATTCTGCAAACCACACTAGGCCCGTTTATCTCTGTCCTAGAGTTGGTTAAAAGAGCAACTGAGGCCAGCTGTG
AGGAGCATAGGCCCGGGTACTAGGACTCACTCATGCCAGATATAAGCCCTTAGACACATACATAGCCCCTCCATGTGTGGGTT
CACTTTTACATCTGTACATGAAGAAACCACTGATTCCTAAATAACATAATTTATACACATAGGTAAAAATAATTAAAAATGTG
ATAGTTATTAAGTGTTTATCACACAACAATTTCACAATAAAACAGCATTTTCCCAAATGTAATCATTGTCATCGAAATCCCCA
AGGACACTCTCATCTGCCCTGGGCCCTGCCCTCTCCTCAGGCATCTCACCCCAGAGCTTGCTATATAGTAGGAGACATGCAAA
TAGGTCCCTCCCTCTCCTGATGAAAACCAGCCCAGCCCTGACTCCGCAGCTCTGGGAGAGGAGCCCCCGCCCTGGGATTCCCA
GGTGTTTTCATTTGGTGATCAGCACTGAACACAGAAGAGTCATGATGGAGTTTGGGCTGAGCTGGTTTTCCTTGTTGCTATT
TTTAAAGGTGATTCATGAGGAAATAGAGATATTGAGTGTGAGTGGACATGAGTGAGAGAAACAGTGGATTTGTGTGGCAGTTT
CTGACCTTGGTGTCTCTGTGTTTGCAGGTGTCCAGTGTGAGGTGCAGCTGGTGGAGTCTGGGGAAGGCTTGGTCCAGCCTGGG
GGGTCCCTGAGACTCTCCTGTGCAGCCTCTGGATTCACCTTCAGTGCTATGCACTGGGTCCGCCAGGCTCCAGGGAA
GGGACTGGAATATGTTTCAGCTATTAGTAGTAATGGGGGTAGCACATATTATGCAGACTCTGTGAAGGGCAGATTCACCATCT
CCAGAGACAATTCCAAGAACACGCTGTATCTTCAAATGGGCAGCCTGAGAGCTGAGGACATGGCTGTGTATTACTGTGCGAGA
GACACAGTGAGGAGAAGTTAATGTGGGACCATGCGAGAAACCTCCCTGCGGGAACGCTGGGGAAAGTCATCTGCAGGGGGCGCT
CAGGAGCCACTGATCAGAGTCAGCCCCAGCGGCAGGTGCAGATGAAGGCTGATTTCCTGTCACGATGTGGGACTTCATCTTCT
TAAAGTTTCTCTACTGAACCTAAGTTCGGAATTCTGTGATTACTAGGGTCATTTCTACATATTTTTAAAATGATTGTTTTAAT
ATGAAAACCTATTCTCCTATGCAGAAAATGCAGATTGATCCTCACAGAGGAGATGAAAAGTTCTCAACCATGGTCACCACTGT
CAGAGTCCTGAGGAAGCTCAGGGCTTCCTGGTGAGTCTTCTCCAGTCAGACTGAGGACAGGAACTCCAGAAAGAATCCTGACT
AGAACTGAGGTATTGCTCCTCACAAGAGAACTCAAGCTGCGGGGGGTCTGTTCCTGCAGACCCCTGACCCGGTGGCGGATGAA
TAAAACGTACACTGACACACAGATATTCTGTTTTGCCAGTTCAGCTGAGGGTCCGAGGCAACTTACAGACTCCAAGAAGAATC
CTGTAAAGAACGGCAGCAGTGGCCCTGAGCAGCTCGCACTCCAGGCGTGTATTGAGTATAGAATTAACAACAGAAGCTCTGAC
AACACACTTGTGGATAATTAACATGGTTAAGAGAGTAGTTCTACGAATGATTAAAGCTCAGGGACTGCGGTCTAAAGTAAATA
CCATTAGGGGGCAATACCCTGGTTAGTTAATGGAGGTAGGGTAACCAGACTTAACTGGGGAGCCCCTCTATTGTCCCTAGTATT
TACCCTATGCCTAACGCTCTAAGGTAAGAGCTGCCCACCTTCAGCCTGTTCAATTATTACAAGCTATGTAACCTTTCGGCCTT
CTAGAGAGGTATATGACTATTCCCTATAACTTTCCTTAATATTCCCCTTTAATATTTCCGCCACCATCCTGAGTGAATCCCAG
CAAGGACAGTCTTTGGGGATTCTGATTACAGAAAAAAGAGAGCCTGGGCCAGGGTCAGTGTCATGTAGAACCTCACAGGTTTC
TCGTAGGACCCTTCTCCTGACACTGAAGAATGCAAATCAGAATCAATACTGATCTGGAGCTTCTTTTCCTAATTCATTTACTG
TCTTTTTTAGATGTTGTTCTCATTTTTCCATTTGCTTTTCCTGCTTTCCGAAAAGGAAGATGTTTTGCTGTGGTCAAAATT
CCAGACCTCAAGCCCTTTTCTTGGCGCTCAGGTGGGTCTCAGGCTGTGGCTGCTGCAGTCACGCAGGAGAGTCTGGTGGGACT
TTCTTCACTCTTCGTCACTCAGGACCCTCCACTGTGTTGCATGGAGACTCATCTGGAAATGCAAGTTGCCAGTGGGAACTGAA
GGGACAAGCTTGTCTGGTTAATGTGGGATGTGGATGTGTTTCTAATCCTGTTCTGAAAAACCGTCACACAGTAACGTTCTTCA
CTAGTGGAGAAGGAAGTGGGTGTGAACGTTGTCAGAATAAAAATGGAGCCACGTGTGTTATAATCTTTACAGGCGAAGCTGGA
AGAGGTCATGAATAGAGGGTTCTCATGCACACATCCCTGATAACAAGAATTACCCTAAAAATACTCTGCACAACCACAATCTT
GAACAAAGGCTACCACAACAATAAGAGAATTAATCTGAGGGGATATCTCCCTGCAACTCCCTGTTCAGCCTTAAACTGATT
CTACCCTTGTTATTGATTCTTCTACCCCAGGATAATTGTCTCAAAATAGCTCAGGTAATCTTCTCATTTATCCTTCAGACACT
TGTCTTTCTTTACCAACCTAAATGTGACCATGGATAATCCCATTGCAATGCTCATTTTCAAATAAATACGATTTGATTTTGGA
GAATCTCTTTCTCTGATGTTTAGGTTTGACAAGCTGCAGAGGGACACACCACTTTCCTGTGAGATGTAGGGGATGACAGTT
TTGGGGGATGGCTGGAAACGTGCAGTATCCTTAGGGTCAGCCATCAGTAAATGCAGGCTGGAAATCTTAGAAAGATCTCAAGC
TGCTTAATCACCACGGAGTTTTACCTTCTCCAGATCTGTTCTGATGGAATCAGGGCCAAGTTTGTTATTGATGATAATCTACC
```

```
TAATATTGAGTCAACTGATCACAGTTTTAATAACATCTATTTAAAAATTCACACCTGGATTAGTGTTTGATCAAATAACTACA
AAGTATTGCCCAACCAAGCATACCATCAGGCAGACTGTTACCCACAGAGAAAAACATTGAACATGAGTTTGAGGTTCTCACAT
TGTTAAAGGTGTAAAACCGATTATGTTTAAATTATGCTATTTTTATTATTGTTATTGAGTTGTAGATGTTTCATTTACATTTT
GGATATTAACGCTTTTTCAGATTCATGGCATATTATCCAATTCTGTGAGTTGGAATTATTTTGTTACTTTGCGGAATCTTTTT
TTAAATCTAGTCCCACTTGTCCAATCTGTGTTTTTTTATTTGTTTGAATGTAAAATCCAGAAAAAGATTGCTAATTTTTTGA
GGGTTGAGAGTTTTACAATTGCACGTGTTTCATTTAAGTATTTAATGCATTTAGAATTAATTTTTTTGTTTATTCTAACCTAA
AATTCTTAATTCTTTGCATGTAAATATCCAATTTTCATAACACGCTCTTTGGAAGACACTATAATTTAGCAATTATATATTGA
TGGTTCTCACGCTGAAAGTCAGCTGGCCATCAATATGTGGGTTTATATCTAAGCTCTCTGTATGAATTTATGCGAATGCCATT
CTGATTTATTACTGTATGTTTCTAATAAATGTTGAGGCCTGGAAGTGTAATACCTCAAGCTTTATTCTTGCCTTGTTACAGAT
ATTAGACCAAAATATTCTAAAATTTTACTATTGAGTATAATAATAGCTGTGGCTTTTGTTAATTGGTTTCATTATGTACAAGT
AGTTTTCTTGTCTTCCTACTTTGTTCAGAGTTTTTATAATGAAATCCTGAATTTTTTTCAAGTGTTTTCTGTGTCTGATGAAA
TGTTACTGAGATATTTTTCTTTAGTTTTTTAATTAATCAACTGAATTGATTGATTTGAGAATGTCAAATCATCTGTGCATCT
CAGAATAAATTTGAGTTGATCATGGTGTATGGTCTTCTATAAAATCTTTAGAATTTATTTTACTATTGTTGGGGGGTTAATTT
ATGTCTACTAATGATATTGGTCTATGATTTTCTTTTATTGTGGTGCCTTTGTCTATTACTGGTAGTACTCTAACGGTAGCCTC
ATAGAAAGAGTTTGGAAGGTGTGTTGCAGACTACCTTTAAAATAGATTTTATCAGTGGAGAAACGGTGATAGTTTTTTTCTTC
AGTTTTCTGTTGGGAAGAGTTTTGTTTGTTTGTTTGTTTTTTGTTTTTTGTTTGTTTTGTTTGTTTTTTGAGACAGAATCT
CGCTCTGTTGCCCAGGCTGGAGTGCAGTGGCAGAATCTCGGCTCACTGCAAGCTCCGCCTCCTGGGTTCATGCCATTCTCCTG
CCTCAGCCCCCAAGTAGCTGGGACTACAGGCGCCTGCCACCACGCCTGGCTAACTTTTTGTATTTTTAGTAGAGATGGGGTTT
CACCGTGTTAGCCAGAATGGTCTCGATCTCCTGACCTCGTGATCCGCCCGCCTCGGCCTCCCAAGGGAAGAGTTTTATGTTGT
TTAAAAGATATTCTGAATAACTTAACCTGCTTAATGGGCTTACATAATATTCCTTTCTTCCATTCTTTTTAAAGAACTGCTTA
CCTTTCCTAATTATTTTTAGGGTGATTTTTCACATAAAGATTGTGCAATACATTTTGAGGTGAGACTTAGTGGATTTTCTCTA
ATGAATTAGAAATAATAAATCACTTAATTGACTATTGTATTAAGGTTGATTTGTTGAATATTTGCTAAAGGCCAGTTCTTTAA
GCTGTGCCATGTACTAAATCCCTAACCGACTATTTTATTCAGGTTGGTTTGTTGAATATTTGTTAGAGACCAGTTCTTTACAC
TATGGCATGTAATAAATTCCAAATGGCAGTACGTCATTGTTTACTTAGCTTTTGTGCTTATATTTTTCAGAGGAAAAAAAATA
CTGTAAATTGTAAATACCCAATACCTAACAGTATTGTATGCAAATCTGTGACTGTTGGCAGTGTCATCTCTGAGAAACAGATA
AAGTTTTATTTACTATATATAAAAAAAAGAGTTTGGAAGGTGTTTGCAGAAGAGTTAGAGAAGCATTAGCAT
TAATTCTTTAAAATGTTAAGACTAATTTTATGATGTAACATATAACCTATCATGGAGAATGTTCAATGGGTGCTTGAGAAGGAT
GTGTATTACATGGCTCTTGGTTGGAAGGTTCTGTAAATGTCTTTCAGGTAAATTTGTTCAATACTGTTGTTCAAGTTCAGAGG
CTTATTAAGAATTTTCTTTCTGGATTTGCAATACATTATTGCTAAGTGAGGTATTAAGGTTTTCCCTTATTTTTATATAGTTT
TCTATTTCTCTCTATATATATATCTTAAAGTTTGCTTAATGCATTTATATTTGTATTTGTACTGTGTAAAAAGTAAAATAAAA
TAATAATTGCTTAGTGAGTTTCATGGCACAATCACGTTATGAATAATCATATTTTCCCAAATGCTGTCATTGCCACTAACTCC
TCCAGATACATGGTATATTATCCAATTCTGTGAGTTGGAATTATTTCGTTGCTTTGCAGAATCTTTTTTTGTTAATCTAGTTC
CACTTGTTCAATTATGCTCCTCCGGGAGTCTCACATCTGCTCTGGGCACTGCCTTCTTCTCAGGCATCCCACACTGGAGCTTG
CTATAGAGGAGGAGGCATGAAAACAGGGCCCTCCCTCTACTGGTGAAAACAAGCCCAGACCTGGCCCTGCAGCTCTGGGAGAA
GAGCCACAGCCCTGGGATTCCCAGGGGTTTCCATGTGGTAATCAGGGCTGAACACAGAGCTCACTATGGGGTTTGAGCTAACC
AGAATTTTTCTTGTTGCTATTTTAAAAGGTGACTCATAGAGAAATAGAGTGAGTGAGAGTGAGTGGATATAAGTGAGAAAAAC
AGTAGATGTGTTTGGCAGTTTCTGACCAGGACGTTTGTGTATTTTCAGGTGTTCAGTGTGAGGTGGAGCTGATAGAGTCCATA
GAGGGCCTGAGACAACTTGGGAAGTTCCTGAGACTCTCCTGTGTAGCCTCTCGGATTCACCTTCAGTAGCTACTGAATGAGCTG
GGTCAATGAGACTCTAGGGAAGGGGCTGGAGGGAGTAATAGATGTAAAATATGATGGAAGTCAGATATACCATGCAGACTCTG
TGAAGGGCAGATTCACCATCTCCAAAGACAATGCTAAGAACTCACCGTATCTCCAAACGAACAGTCTGAGAGCTGAGGACATG
ACCATGCATGGCTGTACATAAGGTTCCAAGTGAGGAAACATCGGTGTGAGTCCAGACACAAAATTTCCTGCAGAAAGAAGAAA
GGATTCTGGGCCGAAGGGGACACTCAGCACTCACAAAACAGGTGGAGCCCCAGGGCAGGTACAGAAAAGCAGTCAAGGGCTGC
TGTCCTTCAGGATCTGTGCTTTCCTCTGCATGTAGCAGTTCCCCTCGAATCCTCTGCACTTTTATGTTTCTGTGCCCACCATG
AGGTCCCTGGATTACAAAACTTTAATTTAAAAGAGGAAACATTCTTATATGTCCCAAAACAAAAGTAAGTATTAGAGGCACA
AAAGTGCACAGGCGGCCAGGTGAGGCTGTAGACACTGCCACCCCGCAATGCCAGTCTCACAACTAGCACTGGAGAGTAGTGGG
CATTCAGTGGAGCTTCCTACCTATCCTGTGGTCCGAGCTAAGTCCAGCAAGGCCATTGGTGCCTTCCAGAGCACAGTAGTCCA
TCAGGAATCTCCCATGTGTCCCAGCAGCAGCCTTGCCTCAGTATCTCCACTGTGCACAGCCATTGTCTGGGAGGGAGCTCCCA
GGATGAGTGTCTTTGGCACACACCAGGTGGCGGGTGTTAGAGTGCAGTACAGCAGCTGGCTGCCTGGTCTATTGGGCTCCCTG
ATGTTGGAGGGATTTGAGGTGCATTCTCAGGCCCAGCACCCTCTTTGTGAATTTTTATATAAAAACCCTGATTTTACTTCATT
TTCTCAGATGACATAGATAACTAAAAACAGAATCTGCAAAGAAATTGTAATTTTCAACTTTACCCCAAATTCATTGTTTCTTA
ATTCTGTGCAAGATCCAAACATATTTTTGGCTTCCACATGAGAAATTGTTCTGTTTAAACTGAAATCATTTCTTCTCATATTC
TTTCTTTTGGGCCAAGTACAGAGATCTTGTTGAAAATAAGTTGGGTTCTTTCCACACACTAACCCTCACCTCCCCTAGAGAAA
GAGCAGAGATTGTCCTCACTCTGAGTCTAGGGGAGGAGCTGTTCCTGTACAATTCAGAGCCTGCAGAGACCCCCCCCCCCCGC
CAGGTGCAGCTTCAGTGAGTCAGACATTTCTCCATGTGGGCGACCTCCAGTGCCTGTGACTGCTTCTCAGGCCTAATTGTGGG
TTAAGAATTAGGACACTCTTTAAGTTATCACATCTGAATCCTATTCTGAAAATCACCATAAAGAGAGATAGTTCAATGGCTAT
TCTCCTGACATAAGTTTCTCTTTATTACTTGGTTCCAAGTATGGAGAAACATGTGACCCAATATTTGTCTGAATCCAACATCA
GAATCCCCTGCATTTCTCTGGGAAACTCCCGGATCGAACACAGGTGAGCTCTTTATTCTCACAGAAATGTATGTAGTTGGGAA
TTTCAACAAATTGTCCAGAACCTGTGCCTGCCAACAACTGTGTTTCTCGGTGCACTCTTGGCCTGGTGAAGCCCCAAAGACC
CTCTCCCTCATGTGTGTCATCTCTGCATTCTCCATCACAACCAGTGCTTCCTCCTGGATCTGCATCCATCACCCCTCTCTGG
GAGGGAATGGAGTGGATTCCATAGATGATGAAGGGAGCACACATTACTCCCCTTTCCTCAAGAGTCCAGTCAGTCACCATCCC
CAGATCCATGTCCAAAAACAGTTCTTCCTACAGCTGAGCTACATGAGCAACAATCACATAGCCATATATTTTTCAGCAATAGA
CACAGTGAGGGAATACACAGTGTGAACTCACACCAAAACCTCCCTGTGGGGATGCATAGGACAGAAGGGGTTGCTCAGGTCCC
CAGGGGGCTCTCAGGACACCAAGGGTCACTCAAGACCATTGTAGAGGCACGCAGGTAGCCGGGGCTCTCAGGAACCATGGGG
GAAAATCAGGACACCAAAGGGTGCTTGGTACAGCAGGGGGCTCAGGACAATTGTGGGGATTCAGAAAGAACAGCTTCAAGGCT
CAGCTTCAGGGCAGGTGCAGCTGGTGTGAAAAGGGGCTGGATGAGGCGTTTTGTGTCACCATCATGAAACACCACCAGACACC
CTCCACTACATCTGTTCTAATGCATGTGTTTGTATGATTAGGAAATGATATTGATATAAATATATAACCATAGCTAGGTGTGT
```

FIG. 6 (Cont. 22)

```
CTTTTTCTGCCTTCCGTCCTCCCTTCTTCTCTCTCTCTCACACAGAAATTTACATACACCCACCCCACAACACACATAAATCT
ATAACTTTTATTACCTGATGTATTCAATAAACCTGATTAATGTGTTTTGCAGCTTCATTGTTTATGGTGTTGTAGCAATAAAA
ACCATCTGTTTCCCAGCTGTGTACTTCTCTAAGCTGAGTAGCATCTTTGTTCATAATACCCAGAATGAAAAACAACCCAAATG
TCAATCATCAGCTTAACTGGTAAACACATTGTGGAAAAGTCATTCATTGACATACTACCCACTACTACCATCAGCTAATGTTG
GCTATGCTCCAAAGCATGGTTAAATTCACAAGTACTTCAGATGAGTAAAATGAGCCAAAGTGATAAAAGTGCATACATAGGAT
ACAACTTTCATAGGTTCTATAGAACCAAAAGTAATCTAAAGTTGCCAAAAAAAAATCAGTAGTTCACTGTGAATATTGTAGGA
GAAGGGATGGTCTAGGAAGGAGGAATTATGGAACAAGATAAAATGTTGAGGGAATTGACTTGTTATCTATGTTGATAGTGATA
ATGTCTATGACAATATTTGCCCAATTGTACACTTCATGTGGAGATTATTGTTTTTAGTTTAGCCCCATTAAAGATAGTATTAA
TTAGAACAGGTATAAATTGGTATCACAGGAATTAAAGATAAATAAAATACATGTAAAGTCAGAGAATCCTGAATATACACATG
AATGAGCACTGGACATCTCTGTATTTTTAGAGAAGCACTAGAATACAGCAAAATAATGGCACAATTTTACATCACTAAGAAAG
TTTATCAAACCCACCAGGCATGTTGTATTAGTTCATTTTCACACTGGTATAAAAAACTACTTGAGACTGGGTAGTTTACAAGG
AAAAGAGGTATAGTTGGCTCACAGTTCTGCATGGCTGGGGAGGCCACAGGAAACTTACAATCATGGTGGAAGGTGAAGAGGAA
GCAAGGCACGTCTCACAGCCCAGCAGGAGAGAGATAGAGGAGGGGAAGTGACACATACTTTTAAATCATCAGCGGTTGTTAGA
ACTCACTCACTATCATGAGAACAACATGGGGAAACTGCCCCCATGATCCAATCACCTCTCACCTGGTCCCTCCCTTGACATGT
GGGGATTAGAATTTGAGATGATATTTAGGTGGGGCAGAAAACCAATCTATATCACATGTCCAGTTCTGTCCTGGAGTTGTTTC
AGGGATCCAGTGTGTCCTGTTGATAGAAACAGTGACACCAAGTTCATATTATCAGTTGTAGTTGACACCATGCAAAGCCAAGA
GATCTCAAGTGAGATTTAGTGTGTATGTTGTGTCTAATGAAGTCACACACTCAGAGCAAGTGAATAGGGAAAAGTTCATTATC
TACACTGTAGAGGTGTCTGCTGAGTGCAGGGCAGGTCTCCCAGGAAAATCTAAATGGCTTGAAAGAAAACCAAAGGAGACTG
GCTCAGGGTTTTTATAATGGTTTAGTGGTGGGGCAAAGTGAAGCTTCCCACTCACAGATGGGGTTTATAGGGTTTGAAACT
CCCACTGGCATCAAATGAAGAAGCTCCTGTGAGTCTGAACTAGATTCATCTTGTGTGGCAAAAAAGGAGACGATGAGGAGTG
AGCCTTAAGTAATCAGCAGTCATGCACCAAAAGATAGAGTGACAACTTATTCCATGCAGCAGGAATAAAAATAATGAATAAGA
AAGAAGACAAGGGTTCAGTATGGGTGGACAACACCCAGATCTGCAGAAATGAGATGACTTTAGAAATGTAAGCAAAGAATAAT
GAGAAAAAGAAGAAGTGGATGGAAAATTAAACAGGGGCCTGGTCTAATGTCTTGGGTAGAAGCTTTTCACAATCAAGGACTAT
CAGCTTATTCTGCAGGTCTTAGGTCAGCCATCTGCTTAAAAACATCAGAAACGCCAGAGGGTCTATGAGGATGCTCAGTTTAA
CATCTCCTATTTGAGTAGCTTTACAGTTGTGTGGAATTCTTAATTGATTCTTTTTTGTTTGTTTTTAGGGACAGGCTCTCACA
CTGTTCCACAGCTTAAAGTACAGTTGTGTGATCATAGCTCACCTTAAATTTGAGCTCCTGACTCACACAACCTTTCCATCTTA
GCTTTCTGAGTATCTACAACTAGATGGGCACACCACCCCTACCCTCCTTATTTTTAAACATTTTTCATAGAAATAGCATCT
CTTTATGTTGCTCAGGTTGGCTTCGATTGCCTGGTCTCATAGGATTTCCCTCACTTTGCTTCTGGAAGTGGTGTGATTATAGG
GAAGATCCACTGCATCTGACCTGAATTTATTCTTTAGTTGTAAAATATGAAGCCAATAATTAACTGCCTGAATGTTTTCTGCA
GTGAGTTAGTTAAAAGCATCTGATAAGGTTCCTTCCTATGTGATTCACGAGCAGTATTTTCCGCTGATGTTCCTTCCAGTTTC
CTTGCTGAAGATCACAGGGAATTGTGGAAAATATGTAGCAAAAAGGCAGCCTTAAACTCTTCATTGTTAGAGTGGATATCACA
CAGGAATCACTTTCAGTATTTTGTAACACATGCATGCAATAGAGCAAACATGATCTCTGGGGGTAAAGTCTATAAACGTATGG
GCCTTTTAGCTACCAAGTCATAGGGTAATAACTGATGTACCCTGAGGACTGGACCATGATTCCATAGTGCTAGTGGAAGAACC
CTTGACCAAGGGAGTTTTACATTTTATTAAAATATGTAGAGATGCCACTTTTTAAACATTCCCAGAAGGTTGTGAGTGGGATT
GACTCTGTCTCGTATGAACAAAGACAATGCCCTCCATGATTAGATAATATTATAAACTAGATTGAGCTACAGTGTTTGCTGTA
TTGAATCACTGTATATTTTATTTTTTAGCTCCATGTTAGTTTTGTGTCTGCGTGTTAGCGTTGGCTTTAAATGATATTAATC
AGCTCTGTAGTAAGTAGAAATTCATCTGAGAGTTTCTTTCCTTGTTTTCCAGTTTGATAGGATTTCCAGAATACATAAGAACC
CTCTCTGTTTGTAAAAATATTCCAGGCCAGGCCAGTGGCTCATGCCTGTAAACCCAGCACTTTGGGAGGCCGAGGTGGGGGG
ATCATTTCAGGTCAGGAGTTTGAGACCAGCCTGGCCAACATGGTGAAACCTCCTTTCTACTAAAAATACAAAAATTAGCCGGG
CATGGTGGTGCTTGAGGATTGCTTGAACCCTGGAGGCTGATGTTGCAGTGAGCCGAAATTGTGCCACTGCACTCCAGCCTGAG
AGACACAGCGAGAGTCCATCTCAAAATAAAAGAAAACAAAACATTCCAAAGTTATGCACAATCTAGAAACATATGTACTTAAT
TCTCATTTTTAATTTATTAAAAAGCTCTAATAAGTTCAATGTTTTCTGCCTTCTCAGTTGATTTCACAACACATATAATAATA
TATCCTAAATAAAAGTTTGTTCTCTTAATACAAATTACTAGTTAATAACCCTTACTTTATTATTGAGTATTATCCATCAGTG
TTCATCAATGCTCTCAATGGGACTCTTACATAGAGAATATACAAAATATTTTCCTGATCATGACATAAAACAGATGTGAACAC
ATTCTTAGTATTCAGCCATGTCTCCTATCATGTTATAAACCACATGCTAACTTTGACTTTATTGGAACTTGTTCTAATTTCAA
ACTAGTTATTTTTTATCTTCATGCAGCTGGATTATTATGTGTGGTTATTATTCCGAGAGTGATAAAGACAACATTAACAATT
TTCACTGCAGGCATGTCTAGGCAACCCCCTGTGCACAATGACCTTGGTGCATTGGAGATTCTATGGGACTCTTCCCTACCTG
CCTAGGAGAGTTCTCTGCCTTCTACCTCTATCATTTTCCTCTTTGAAGAAATACATCTAACTGTCGTTAGAATAGAGACAAAG
ACAAATCTTAACTGCCTTCCAGCTGACGGGGATGCTGTTTGGGGAAGATCTCTCTTGGAGCCTGTCTAAGGGACCCCAGGAA
AAGGGAGCCATTATCCCAGGCTTCAGTTGCATGAGCATTTGGAGTTTGATGGTCTGAAAACGAGAAAAGGCAAATCAGATTAT
TAGAAGACATGTATCCAAACCTAACAAGGTGGTCAAGGTGGTAAGGACAGTTTGAAAGAAAATTCCAAGGCTGCTGACATGCC
CAGATAACTGCGGCTGTAGTTATGCCTGCTAAGGTTTGGGCGCATGAGGCTTGGCTTTTGTCAGCTCCCTGGGATTTATTTTC
CCAAACAAAGAAACCTCCAGGTTAGGGGCACCCTATTCATTCCCATCACCTGGCATGATTTAAAGGATAATTGCTTAGAATTA
AAATATTGATACAGATTTTTTTATATTCCCCATCGCTTTTTGTTTCTTCTGGGCTGTAGCCAGAGATCATTGATTGGCGCTCA
GGAATAAGCAGTCAGTCTAAAATGCAGGCAAATACTTAAACAACTGAAGAGATTAGAAATTTAAAGATGATCGTATGATATGTT
TTGAAATACAATTTTTCTCTTTCCAGTTCTGGTTTTTGTCAGAATCAAGTAATTGTAAGACTGAGTTGTTTGCAAAATAAACT
TTAGTCTTAAACTTGGCCTGATTATTTGCATAAAGTGCAGCAAGAATATTAATAATAATTCTGTAGGAAAAGCCTGCAAGCAC
CAGGAGTTTCACAGTCTAACACTATGAGCACGTGCATCCTCACGCAACTCGCTGAATATTTCCAAGCCAGCCTGTTCCTATCT
TAAATGCCATCCAGTTGTATCTGCCCCAGGTACACTAATATATGGGTCCTGCTTCTCTGCAGCCTCCTCTCTCCTCAGATTTC
AGGTTTTGTTTATTGTTTTCTCTCTGATATAAACTCAAATATGTTGAAGGTTTTTTTGTGTTGTTCAGGTTTGT
TGTTAATGGATCAGAATAAGATAATACTTTACTCTTTTTATTTATTTATTTATTTTGAGTCGGAGTCTCGCTCTGT
CACCCAGACTGGAGTGCAGTGGCCCTATCTCAGCTCACTGCCAAGCTCCGCCTCCCGGGTTCACGCCATTCTCCTGCCTCAGCC
TCCAGAGTAGCTGGGACTACAGGCGCCCGCCACCATGCCCGGCTAATTTTTGTAGTTTTAGTAGAGACGGGGTTTCACCGTG
TTAGCCAGGATGGTCTCGATCTCCTGACCTTGTGATCCGCCCGCCTCGGCCTCCCAAAGTGCTGGGATTACAGGCGTGAGCCT
CCGCGCCCGGCCCATACTTTGCTCCGTTTTATATTCCCATGCTTTAGTAGCTGCTTTTCTCTATCAAATCCATTAACTGAGAG
AACAAATCACATTTAGTTACAGGTGAACAATTAAATAGTTTGGCATATATTTATGTACTGGAACATAACGCAGCTTGAAATCA
```

FIG. 6 (Cont. 23)

```
AGGCATGCCTCACTCATATAAACAACATGGCTAAATTCTCAAGTAATTCTGTTTAGTGAAAGAAACTAAGGAGTTAAGAGTAA
ATTTTATATGATACATTTGTAGGAATTTTAGAAGATGCCATTATTGTAAATTAACACGGAGAAGATTTGAGTTTGTCTGACAA
TACGCTGTTGGGAGTAATGTGGATGTGAGTTGAATTTCAGAGAAATAAAAGAAAGATTTAGGGATTAATTTAATTATTCAAAA
CTTGATTGAAGTGCTGAGCAAATGGCTGCAAACATAGGTCAACATTTTTCAAATCCTTCACTATAAATTTGAATTAATTACTT
ATTAATTACACTTGAATAAAGCAATAACGAAGAAACCAATAAAATAACATTTGACTAAAATGGAGCAATAAACAGATCGATGT
TAACACAAGGAATATGACTGACTTATGAAAACATGCACATGAACCATGGTTCACTCTACGTATTTTGGTAAATTACAGAAAGT
TGTCATAACAGATGGGGAATCCTGCAGACTTCACTAGGCATGGTCCACGCTGCCCTGGAGTTGTCTCAGGGGAGCTGCCTCCT
CCAGTGGTTAGAGCACAGGCCCAGGTAATAGGACTAATTTTTTTAGATGTGTAATTTTAGACACACTGCACAACTGCTGTGTT
CTCTGTGTAAATTATCTCCTGTAAAATGTAACATTGAAACCTGCATTAAACATATTGTATAAATATGTAAGAATAAAATAAGA
TTATGAGAGCTAAATATTAATCAAGGCACAAGCACATAATATAAAATTATATTTTCCTGAATGATACAATTATTCCAATCTGT
CCCAGGACACTTCATCTGCCCTGAGCCCAGCCTCTCCTCAGATGTCCCACCACAGAGCTTGCTATATAGTGGGGACATGCGA
ATAGGGCCCTCCCTCTGCTGATGAAAACCAGCCCAGCTGACCCTGCAGCTCTGGGAGAGGAGCCCAGCACTGGAAGTCGGCGG
TGTTTCCATTCCGTGATCAGCACTGAACACAGAGGACTCACCATGGAGTTTGGGCTGAGCTGGGTTTTCCTTGTTGCTATTTT
AAGAGGTGATTCATAGATAAATAGAGATGTTGAGTGGGAGTGGACATGAGTGAGAGAAACAGTGGATGTGTGTGGCAGTTTCT
GACCTTGGTGTCTTTGTGTTTGCAGGTGTCCAGTGTGAGGTGCAGCTGGTGGAGTCTGGGGAAGGTTGGTCCAGCCTGGGGG
GTCCCTGAGACTCTCCTGTGCAGCCTCTGGATTCACCTTCAGTAGCTCTGCTATGCACTGGGTCCGCCAGGCTCCAAGAAGG
GTTTGTAGTGGGTCTCAGTTATTAGTACAAGTGGTGATACCGTACTCTACACAGACTCTGTGAAGGGCCGATTCACCATCTCC
AGAGACAATGCCCAGAATTCACTGTCTCTGCAAATGAACAGCCTGAGAGCCGAGGGCACAGTTGTGTACTACTGTGTGAAAGA
CGCAGTGAGAAGTCAGTGTGAGCCCAGACACAAACCTCCTGCAGGGTACCTGGGACAATCAGGGAAAGCCTGGGACACTGTAT
ACTGGGCTGTCCCCAGGGGCAAGTCCAGGTGATATAAGCCTGGGTTTCCTGTCATGATCTAGGGTTGCATTGTTAGCAAATTA
CCCCAGGGACCATCTCTAGATTTCCAATTCTGTAATAACATTTGATGTCGTCTCTGACTGCACAATGTCCCCTCAACTTTGTA
TCTTTTTTTTTTTGTAACAGGAGGACACATCCTCACCCTGCAGAAGCCTGAGTGTCACTTTGGGGGCAGAAATGACCTGCCT
TGATCACATTGATCACTGTCCTGAGGAAAATACCCCACAGGGGACCCCGATGACTCCAGCAAAGGCTCTGCCTCAAAACCATT
GAAGAGTCCTTCCTTTCATTAGAATTGACCACAGCACCTGGGCTTCAGCACAAGCCATACCACAGACGTCACAAAGCAGCAGC
TTGACACCTGATCCAGGTGCATTTCTCACCTTTAGAAGCTGAGAGAGGGGTGTATTCTCAAGGTCAACACACTCTTTGTGGG
TTTTTACACAGAAAACCTGCTTTTACTTTATTTCATTTGAAGATAAATGAACAAATGTGCATCTATAAATGATTGTAATTTTC
ACATTTATTCCAAATCCAATATTTCTGAATTCTGCATGATGTCCTGGCACAGGGTTGTGTTTTCTACAGGTATTTTTCATCAA
ACCAAGAAAATGCATTTTCCACTTTCCGTGGTTTTTCTCCATGTGCAGAGGCCTTGAGTAGAGCACGTCTGACTGTGTTTGTT
TTCACGCTGCTGATAAAGAGACCTTGAGTAGATCACGTCTGACTGTGTTTGTCTGTTTTCACGTGGCTGATAAAGACATACCA
GAGACTGGGAAACTTACAACAGAAAGAGTTTTATTGGACTTACAGTTCCACGTGGCTGGAAAGGCCTCACAATCATGGTGGAA
GGTGAAAGGCACATCTGACATGGCGGCAGACAAGAGAAGAGAGCTTGTGCTGGGTCTCCCCTTTTTAAAACCATCAGATCTCA
TGAGACTCATTCACTATTAAGAGAACAGTGCAGGAGAGACACAACCCCCATAACTCAGTCACCTCCCACTGGTCCCTCCCACA
ACATTGAGAATTATGGGAGCTACACATCAAAATGAGATTTGAGTGAGGACACATCCGACCCATATCATTCCACCCCAGGTTCC
CTCCCAAATCTCATGTCCTCACATTTCAAAACCAATCATGCCTTCCCAACAGCTCCCCAAAGGCTAAACTCATTTCATCATTA
ACTCAGAAGTCCACAGTACAACATTTCATCTGAGGCAAGGCAAGTCCCTTCCCCTTATGAGCCTGTAAATTCAGAAGCAAGTT
ACAAGCATTGGGTAAACACACCCATTACAAATGACAGAAATTGCCCATAACAAAAAGGCCCCATGCAAGTCCAAAATCCAGCA
GGGCAGTCAAATCATAGAGCTCCACAATGATCACCTGTAACTCCCCTTCTCACATCCGGGACATGTTGATGCAATAGGTGAGT
TCCGATGGTCTTGGGCAGCTCCACCCCTGTGGCTTTGCAGGGTACAGCCTCCCTCGGCTGCTTTCACAGGCTGGTGTTCAG
TGTCTGTGGATTTTCCAGGCACAAAGTGCAAACTGTCAGTGGATCTACCATTCCAGGGTCTGGAGGATAGCAGCCCTCTTCTC
ACAGCTCCACTAGGCAGTGCCCCAGTAAGGACTCTGTGTGGGAGCTCTGGCCCTATATTTCCTTTCCTCCTTGCCCTAGCAGA
GGTTCTCCATGAATGATCCACCACTGCAGCCAACTTATGACTGGACATCCAGGTGTTTTCATACATCTCCTGAAATCTAGGCA
GAGGTTCTCAAACACCAATTCTTAGCACTCTGTCGATAATGGTTCATTTTGGTGGCCTGTTCATTACTGGTATTTTCCAAAGG
AATCTCACTTGAATCTTTACTCTTTTGCATTTTGTCTCCATGACAATGTTGGGAAGTTTTACCTCCACCATCATAACATGATC
TAGTGATCTCACACATTTGTGGCAAACAATACCTACAAATTCAGAAGCTCTTTGCTTTTCTTTCCATGAAATATAATTCTTTC
TGTTCTGTGTATAAGCATATCTTAGCAACTCTGTGCACACCCACATAGATGTCCACAAGCCTATGAATTATTCTCTGTAAATA
AAAATTTATATCAATTTCCCTCAATGTTCATAATTCTCCTGAGGGTGAGGAAGCTCCTTCTCGATCTGTTCAAACAAAATGCC
CAGAAACCATCTGGTAGGTAAGGAGTTCACCTGGCTCTGGTGTGGGGTCTGTCTCTTTCCCTCTGTTGTCACACAGGTCAGCC
CAGTTGTTCAGGTCCTAAGAAGAAAGCCCAGGTTTGTCCTGATTTTAAAACACATCAAACTTCTGATGACTCTCCTGTTACCC
ACATCCATGGAGGATAGATTATTTATTATAATTCAACCAAACTAATGTCAAATGCCCAAGTTGCAATACCACACATCCTAGG
GTATGTTCATGCAATTCACTGGAGGAGAAAGTCTTTCAGAGACAGATGGATCTGAAATGATAAATATGTGGGTAAGGACTCTG
GGCTTGAGTATCATTGTCCAGCCATGTTTCACAAGTGTGTCCTGTCAGGGAAGGACAAGAGTTCCTTGTGTTCTCAGAGGGA
AGGGGTCACAGAGTTCCTCTCTGGTTCCCAGGAAAGATAATCGCACTAATCTTCATGATCTTCATGAGACTATCCTCCAGTGC
TGACCTGTTATAGAGTTTTTGTCTGAAGTTCTCACTGCAATCCCCAATCTACATATTTTCAATCAGAAGTGTTTAGAGGGCAG
GACATATCTTCACGGACACACATTGAGAAGGATGTAGATATGTCCCACTACCTTCTCCTGAGATCTCAGACAGAATCCCAGAT
TTCAAAAGGACACAGAAGGACAGCTCTCAGGTGCTTTTAAAAAATGACCCACTTCCAGGGACAGGGAGCTTCCCTATAACCAT
GGTGGATGTTCTGAACTACAATAAACATTGGATGGATCCAGGATTGTTTGAAGTCACTGTCATTATTACATTCAGCTGCTGTT
TCAATGTGTCTGAAGTAGTAAATGACAATTTAGATGACAATTTATATGAATCTTCAAGGGTAGAACAATATTGACCATATTCC
AAAATCTGTCCTTGATCCATGATCACACTCATCTCCCAGACCAGGTCCTTCAGCACGTCTCTTTACCTGAAAGAAGAGGACTC
TGGGCTTGGAGAGGGGAGACCCCAAGAAGACAACTGAGTTCTCAAAGGGCACAGGCAGCATCCTACTCCCAGGGCGAGCCCAA
AAGACTGGGGCTCCCTCCTCCTTTTTCACCTCTCCGTACAAAGGCACCACCCACATGCAAATCCTTACTTAAGCACCCACAG
GAAACCACCACACATTTCCTTAAATTCAGGTTCCAGCTCACATGGGAAATACTTTCTGAGAGTCCTGGACCTCCTGTGCAAGA
ACATGAAACCTGTGGTTCTTCCTCCTCCTGGTGGCAGCTCCCAGATGTGAGTGTCTCAGGGATCAGACATGGGGTATGG
GAGGTGCCTCTGATCCCAGGGCTCACTGTGGGTCTCTCTGTTCACAGGGGTCCTGTCCCAGGTGCAGCTGCAGGAGTCGGGCC
CAGGACTGGTGAAGCCTTCGGAGACCCTGTCCCTCACCTGCACTGTCTCTGGTGGCTCCGTCAGCAGTGGTGGTTACTACTGG
AGCTGGATCCGGCAGCCCCCAGGGAAGGGACTGGAGTGGATTGGGTATATCTATTACAGTGGGAGCACCAACTACAACCCCTC
CCTCAAGAGTCGAGTCACCATATCAGTAGACACGTCCAAGAACCAGTTCTCCCTGAAGCTGAGCTCTGTGACCGCTGCGGACA
```

```
CGGCCGTGTATTACTGTGCGAGAGACACAGTGAGGGGAGGTGAGTGTGAGCCCAGACACAAACCTCCCTGCATGGACGCGGAG
GGGACCGGCGCAGGTGCTGCTCAGGACCAGCAGGTGGCGCGCGGGGCCCCCAGAGCATGAGGCCGGGTCAGGAGCAGGTGCAG
GGAGGGCGGGGCTTCCTCATCTGCTCAGTGGTCTCCGTCCTCGCCAGCACCTCGCTGTCACCAGGGCTCCTCTTCTTTATTA
TCTGTGGTTCTGCTTCCTCACATTCTTGTGCCAGGAAGAAACGAGGAAGACAAATTTTCGTCTATAGTTGAAGCTTCACCAA
TTACTAGGAACTTGCCTACAAGTTCCTGCATGACCCATTATAACTTATCGATTAAAAAATATATATTCTAATGCTTCTCACCA
TCTCTTGATTTGTATCATCAACTGAATTGTACCCTCTTTGAAATTCATATGATGAAACCTTAAATTCAATGGATCTATATTGG
AATTTTAATGAAATAATTAAGGTTAAATGTGGTCATAATTGTAAGACCCTAATGCAATAGACGTGTTGTCTTTATAAGAAGAG
GAAGAGACACCAGAGACCTCTCACTTTTCACGTGCAGGCAGAGAAGAGGCCATGTGGAGACATAGTGCACTAGAAGGTGGCCC
AGTGCAAGCCAGGAAGAAGCCGCGCCAAGAACCAGCCCTGCCAGCACACTAATCTTCAACATTCAGACTGCAGAATTTTAAGA
AAATCAGTATTTGTTGTTTAAGCCACCCACTCCTGTTGTCTTCTTATGAAGATCCAGACAGACTAATACCACATAACTCTGTT
AGTGCTGTCCCCTGGATGGAGAATTAGCCTCCTGAGGCTGGGCACATCTCTCAGATTTCCACATAAAACAGGTAAAAAATAGT
AGTTCTGATATAAAAACTTGTCATGTCCCTGTTGGCCAATTTCTGGGCAAGGTCTTTTAAATAAGCCAAGTTTGCGGGGAAAT
GGAGACCATATGTTTGTGGGACTCTAACCGTGGAATCTACTGCATTGCTCTAGCAGAATCAAAAATTGAACACCAGTGAGCTC
TTTTATTCTCATTAAAATGTGTGTCTTTGGAAATGTTAACATTCTGTCCAGAATCTGTGCTCACAAACAACTGTGTTTCTTAGT
GCACTCTTGGCCTGGTGGAGCCCTCGCAGACCCTCTCCCTCACCTGTGCTGTCTCTGGATTTTCCATCACAACCAGTGTTTCC
TGCTGGAGCTGGATCCACGAGTCCACATGGGAAGGACTGGAGTGGACCAGGCGCACACGTCATGAAGGGAGCAAAAATTCCCA
CCCACTCCTTATGAATCCAGTCACCATCTCCAAATTCGGGTCCAAAAAACACTTGTTTTTACAGTGGAGCTATGTGAGCAACA
AGCTCACAGCCATGTTTAAAGAAGAGACAGAGTGAGGGGACCACGGTGCGAGCTCACACCCAAACCTTCCTGGAGGGGTGCA
CAGGACAGCAGGAGTCCCGATGATGGAAGGGGGTGGTCTGGATTCCAGGTCACTCTCAAGATCATTGTAGAGGCACTCAGCTC
ACCCGGGGGCTCTCAGGAGCCATCGAGGTAAATCAGGACACCAGAAGAGACTCGGTACAGCAGGGGGCTCTGGACCATTGTGG
GGATTCAGAAACAGCAGGTTCTAGGCTCAGCCTTAGGGCAGGTTGAGATGGGGTGAAAAGGGGCTGGATGAGGGTGTTTGTGT
CACCATAATATTTCACCACTAGACACCCGCCACTACATGTGTTCTACTGCATATGAGTGTATGATTAGAAAATCATACTTCTA
TAAATATATAACCATACGAAGGTGTGTCAAGTTTTCCTCTTCAACTTCTATCGGCCTTGTTCGTAAGGACTAATTCCCTGTAA
TTACTTGAGGACCTCATAAATTGTGGTCAGGTTTGTAGGTTTCCTCTCTTTCCTTGTCTCCCTTTCCCCTTATTCTCTCTCAC
ACAAATGGACATAATCCCCACTCCACACGCAAAGAAATCTATAACTTTCATTACCTGATGTATTGAATAAAATTGATTAATGT
GCAGCTTTCCCATCTTTGTTTGTTGTTCATGCTGCTGTAAGTATAAGAACCATGAGATTTCTCAGCTGTGTACTTCTCCAAGCTG
AGTGGCAGCTTTGCTTATCATACTGAGATGGCCAACAATCCAAATGTCAATCATCAGCTTAACTGGTAAACAAATTGTGGAAA
AGTCATTCATTGGCATACTACTGACTGTGACCACAATATACTAATGTTGGATACGCTCAACAGTATGGTTAAATTCTCATATG
GTGAGTAAAATGAGCCAAACAAATAAAAGTACACACATATGATACCACTTTTATACATTCTCCCATCCAAGTACTAACCAGGC
CCGACCCTGCTTAGCTTCCGAGATCAGACGAGATCGGGCGCGTTCAGGGTGGTATGGCCGTAGACACACTTTTATACATTCTA
TAGAATAAAAACTAAAGTTACATAAAGAATCAGTAGTTCACTGTGAATATTATAGAAGGGAAAGTGTAGACAGGAGGAATTAC
AGAAAAGAGAAAATTTTAAGCATAATTGACTTGTTATCTATATTGATAATAATGATGTCTATGATAATATTTGTACAATTGAA
CACTTCATGTGAAGATCTTTTTTTTTAGTTTAACATCATTAAAGATAGTACTAACTGTAACGTGTGTAATTTGGTAGAAACGG
AGTCAGACAGAGATAAAATACATAAAAAGTCAGAGACACCTGAATATTCACATGAGTGAGCCTGCACTTCTCTATGTTTTTAT
GAAAACACTACAATACAGCAAAATAATGACATCATTTTATGACGTGAAGGGGGTTTATTAAACCACTCCAGGCACGTTGTATT
AGTTTGTTTTCCCACTGCTACAAAGAACTACCTGAGTTTGGGTAACTTATAAAGAAAATAGGTTATTGACTCATAGTTCTACA
TGGCTGGAAAGGCCTCAGGAAACTTGCAATCAAGGCAGAGTGTGAAGGGGAAGCAAGAGACATCTCACATGGCAGCAGGAGAG
GTGGGGAGAACCACCACACACTTTAAATTATCAGATCTCCTGAAGCCTCAATCTGAGACCTCAATCATGAAAACAGCATGGAG
GAACCACCCCATGAGCCCATCCCCTCTCACCAGGTCCCTCCCTGGACGTGTGGCAATTCCAATTCGAGATCAGATTTGGGTGG
GGACACAGAACCAAACCATATCACATGTCCAGTTCTGTCCCAGAGTTGGTTCAGGAATCAGATGTGTCCTGTTAACAGGAGCT
GTGACACCAAGCTCCCAGCACCACTTGTAGTTGACGTCATGCAAAGGCCAAGATATCTCAACTAAGATTTAGTGTGGATGTGA
TGTTGGATGGTGACACACCCTCAGACCAAGTGGATATGGAAGGGATAATTATCTCTATTCTAGACGTGTCTGCTGAGAGCAGG
GCAGTTCTCTCAGGAAAGTGCAAAATGGCTTGATAGAACAGGGAAAGAGAGGGCCTCAGGGTTTGGTGGTGGGGGCAGATTGA
GTCTTTCCACTCACAGAAAGGGGTTTATAGGGTGGGAAACTCCCACTGGCTTCAAATAAGGAAGCTCCTGTGATTCTGGACCG
ATATTCACCTTGTGTGTAAAAAAGGAGGTAATGGAGGAATGAGCCTTAAGCTATCAGCAGTCACACACCAAAATACAGTGTGA
CAAGTTATTCTATGTAGCAACTATAAAAATAATGAATAAAAAACGAGATAAGGGTTCAATATGATGGGCAACACTCAGGTCTA
CAGAAAATGAGATGAGTGTTTATAAGTCAAAGCAAATAATAATGAGAAGCAGGAGGAGGGTGTGCAGAATTAGACAGGGGTCC
AGGTCCAGTGACTTGGGTGGAAAACCTTTTGCTATTAAGGATTATCAGCTTAGTCTGAAGGTCTTAGGTCAGCTATCTGTTTAA
AGACATCAGAAACACCAGAGAATCTTTGAGGATGCTCAGATTAACATCTCCTATTTTAGTAGCCTTGCAGTTGTGTGAAAACC
TTTTTTATCTTATTTCATTTTATTATTTATTTATTTATCTGTTGAGATGGAATTTCGCTCTTGTTGCCCAGGCTGGAGCGAAA
TGGCACGATCTTGACTCACCGGCCTCTTCCACCTCCCAGATTCAAGCGATTCTCCTGCCTCAGCCTCCCAGTAGCTGATATTAC
AGGCATGCACCACCAGGCCCAGCTAATTTTGTATTTTTAGTAGAGATGGGGTTTCTCCACATTGGTCAGGCTGGTCTCAAACT
CTCAACCTCCGGTGACCCGCCCACCTTGGCCTCCCGAAGTGCTGGGATTACAGGTGTGAGCCACTGCTCCGGGCCGAAAATCT
TATTCATTCTTTTTTGTTTGTTTTTAGAGACAGAGTCTCTCTCTGTTGCACGTTGAAAGTGGAGTGGTGTGATAACAGCTCAC
TGTAAATTTGAACTCTTGGCTCACAGAGTATGTTCCTATGTATCGTGCAGGTGTGTCTGTGTGTGTTTACCCGGCTTGGGGTC
CTCTAATTTTTGGATCTGTAGTTAGGTGTTTCACATTCTTAAGATATTTTTCTTAAGAAATATATCTTAAGATATAAGTATAT
CTTAAGATATCATTAATTCTTAAGATATTTTCTCTGTTTCTAATTTCTATTTTTGAAATTTGAAATATATCTACACTATACTT
TTTGATGTTAGTTCTTAAATTTCTTCACTCTTTTTCCCTTTGAAATTCACTTTGTGTAATTTCCAGTAACGGAGTTGAAGTCC
CTGGTTTCATTTAAGAGCTGAGCGAATTCTACTGCTGAGCGTGCCCAAGGTATATTCAACTTTATACTGCATCACTTTTGATA
ATTTTATGAATTTCCATTTGATTCTTTCTTAGTATTTCTCTCTGTCAGTCACATCTAGTCTTGCACTGTGTCCACATTTTC
TTTCAGATACTTTTAACAAATTCAATTACTTTAAATATCCTACTTAATAAGATAGTTCTAGTATTGTGTCATTTACAAATATC
AATTCTGAGGATTTTTCCATTATGACTTTGGTGTTTTTTATAACTTATATGACTTTGATGAATGTTATAATTTTTGTTGATAA
CCAGCCATATTTGGACCCTTGATATTGACGTATTATTTTATTTTGTGCATTTCTGCCTGTATTTGACCACACCCTATCTGTGC
TGGGCCTTGATTGTGGAGATGTCTGTGCATCTCTTCAGAGCTACATTTGACATTTACTTTTGCAACGGCTGTAGCAGTTGAAG
TGTGGTTCTTCTATGTCCACTGGAGACTTCAGATACTCTAGTGATACCTTGTTTTCATGCCTGCTTGGCTTTGTCTATTCACCT
CATTCCATTCTACAGAGAATCTCCTTCACATTCCTAGGGTGGATTAAAGTGTTATATTTAACTGCCAATTGTGAAATTGGCGG
```

FIG. 6 (Cont. 25)

```
AAGGCATTAGACTAAAGGAAGAAACTGACCTCTCGTTGGGCCATAATTCTAGAAAGCCGTTGTGATCCTGAGTCTGAGTGTGA
CCTTCCAAGTTTTCCCGACCCTCCTGCAAGTGAGATACTGGTCTGTGTGTTCTTGCCTCTTCCCCTGGGGTAGAGTCCTCCTG
TTTTCCCCAGTTGTTCCCTCCCACAGCTCTCACAATCTCTGTTGGTGTCCCCATCTTCCAGATCTGCTGCCATGACCTGCAGA
TTAAGGCTCTGATTCCATAAGAAACTGAGGGGAGCTGCTTCTCAATAGATCTTTGATGGGGACCTCTGTTCCCATATCAGTTC
ATGAGGGGCTGCTCCAGTGCCCTAGGATGCTGATTTTCATGGCTTGCTCCTGCAGGGTAATATCTGAGTTTCATAGTGGGAAT
CAGAGAGTTGGGTCTGGATGCATTTCAGAAGTGTGGGCTCTCATTCTCTCCCAGACAGTCACTTTGGGAAGGATAGATTCTTG
TGACTGTAAAGGTTCTTCAAGAGAATAGCACAACTCTTCAGTATGTTGTCCCTTAGAAATTTCTCACTACAACACGCTTAACAC
ACTCGACTTCAAGCAATGCAATGTGTATTTGTGCTCCATCTTGTAATGGCCTACGTTGAATACGACAGACTGTGCCTCAGGTA
ATTTCATATCTTGACTTTATTACTCTGTACAAGAACTTGCCTCTCCCTAGATTTCAATTTTTTTGTTTTAAACCTTCAGTTA
TCTGAAGCATTTAATAAAATTTGCGAACTTCCATCTTTTCTGTTTATCTGTTATTGCTGATGTTATTGTTTAAAAATAAATA
TATATTTCTCATTCATGTACATTTTTAAGCTGAGCAGCATATTTTTAAGTAAAACCTGGAATAATAAAAGAATCCAAACATTT
TTCAGCTGCCCCAAAAAAACCAAATTATGGTAAATGTGTTCACTGGAACACTACTCATCACTTATAATAAATATATTTCTGGT
ACACAGAGCAACAAAGAAAAATATCTAAGTGTTTATGCTGAGTAAAATACGCCAGACAAATAAGAATATGTACCATATTACTC
CATTTATGCAATTTCTTTTAAGTGAAAAAGAATCTAAAGCAATATCCAGAAGATCAGTAGTTACCTGGAAAAAGGGTAGACCA
AAGGAAGGGGAAAGGAGGAAACTTACAGAAGAACAAGAAAATGTTGAGGGGAGTTCACTTGTCCAGCTTGGAAATGATGGG
TTACATGGATGTTGATCAATTGCACACTTTAAATATGTGAAGTCTATTATCTGCCAATTAACACTCGCAAAATTATTGCAAGC
AGACAAATGAAAAATTAGACAGAGAGAGGATGGTATAAAGATAGAAAATATATATTAAATGTCAGAAATGTCTGAGAATTTAA
CTCCTGACCCTAGTTCCGTCCTTATTTTAGGTGAATGGTAGCGTGCACCAAAATCACACACATTCTCAGTACAGGAAGTGGG
TTCCACAAAGCACACGAGGTATGTCCAATTCTTACCAAGATTTGGTTCAGGGAGTAACAGTGATGAGGAATCACAGGCCCAGA
TACCGGGGCTCACTCATCTCAGACATGACCTCGTGGACACACACTTAGCCCCTCCTCCATGTGTAGGTTGACTTCCACATATG
TAAATGGAGAAACCATTGACTCCTACAGAACATAATTTACAGAAATATACAAAAGATAAAATAGTGCAAATACTTATCACAAC
AAAATTTCCTAATAAGACAGTGTATTTTCCAAATACCGTAATTGTCACCCAACTCCTGTGGGCCGTGTCATTTATCTGGG
TCTGCCGTCTCCTCAGGATTCCCACCCCAGAGCTCTCTATGTAGTAGGAGACAAGCAAATAGGGCCCTCCCTCTGCTGCTGAA
AATCAGCCAAATCCTGACCCTGCAGCTCTGGGAGAGGAGCCCCGCCCCGGGATTCCCAGCTGTCTCCACTTGGTCATGAACA
CTGAACACAGAAGACACACCATGGAGTCTGGGCTGAGCTGGATTTTCCTTGTTGCAGTTTTAAAAGGTGATTTATGGAGAATG
AGACACACTGAGTGTGACTGGACATAAGTGAGAGAAAACAGTGGATTTGTGTGCAGTTTCTGACCAGGGTGTCTCCGTGTTTG
CAGGTGTCCAGTGTGAGGTGCAGCTGGTGGAGTCTGGGGGAGGCTTAGTAAAGACTGGAGGGGTCTCTGAGACTCTCCTGTGC
AGCCTCTGGATTCACCTTCAGTAGCTCTGCTATGCACTGGGTCCACCAGGCTCCAGGAAAGGGTTTGGAGTGGGTCTCAGTTA
TTAGTACAAGTGGTGATACCGTACTCTACACAGACTCTGTGAAGGGCTGATTCACCATCTCTAGAGACAATGCCCAGAATTCA
CTGTATCTGCAAATGAACAGCCTGAGAGCCGACGACATGGCTGTGTATTACTGTGTGAAAGACGCAGTGAGAAGTCAGTGTGA
GCCCAGACACAAACCTCCTGCAGGGTACCTGGGACAACCAGGGAAAGCCTGGGACACTGTATACTGGGCTGTCCCCAGGGGCA
AGTCCAGGTGGTATAAGGCTGGGTTTCCTGTCATGGTCTAGGGTTGCCTGTTAGCAAATTACCCCAGGGACCATCTCTAGAT
TTCCAATTCTGTAATAACATTTGATGTCGTCTCTGACTGCACAATGTCCCCTCAACTTTGTATCTTTTTTTTTTTTTGTAACAG
GAGGACACATCCTCACCCTGCAGAAGCCTGAGTGTCACTTTGGGGGCAGAAATGACCTGCCTTGATCACATTGATCACTGTCC
TGAGGAAAATACCCCACAGGGGACCCCGATGACTCCAGCAAAGGCTCTGCCTCAAAACCATTGAAGAGTCCTTCCTTTCATTA
GAATTGACCACAGCACCTGGGCTTCAGCACAAGCCATACCACAGACGTCACAAAGCAGCAGCTTGACACCTGATCCAGGTGCA
TTTTCTCACCTTTAGAAGCTGAGAGAGGGGTGTACTCTCAAGGTCAACACACTCTTTGTGGGTTTTTACACAGAAACCTGGT
TTTACTTTATTTCATTTGAAGATAAATGAACAAATGTGCATCTATAAATGATTGTAATTTTCACATTTATTCCAATTCCAATA
TTTCTGAATTCTGCATAATGTCCTGGCACAAGGTTGTGTTTTCTATAGGTATTTTTCAACAGACCAAGAAAATGCATTTTCCA
ATTTCCCTGTTTTTCCTCCATGTGCAGAGACCTTGAGTAGAGCACGTCTGACTGTGTTTGTCTGTTTTCACGCTGCTGATGAA
GACATACCAGAGACGAGGAAACTTACAACAGAAAGAGTTTTATTGGACTTACAGTTCCACGTGGCTGGAAAGGCCTCACAATC
ATGGTGGAAGGTGAAAGGCACATCTGACATGGCGGCAGACAAGAGAAGAGAGCTTGTGCTGGGTCTCCCCTTTTTAAAACCAT
CAGATCTCATGAGACTCATTCACTATTAAGAGAACAGTGCAGGAGAGACACAACACCCATAACTCAGTCACCTCCCACTGGTC
CCTCCCACAACATTGAGAATTATGGGAGTTACATAAAAATGAGATTTGAGTGAGGACACATCCGACCCATATCATTCCACC
GCAGGTTCCCTCCCAAATCTCACGTCCTCACATTTCAAAACCAATCATGCCTTCCCAACAGCTCCCCAAAGGCTAAACTCATT
TCATCATTAACACAGAAGTCCACAGTACAACATTTCACCTGAGACAAGGCAAGTCCTTTCCACTTATAAGCCTGTAAATTCAA
AAGCAAGTTACAAGCATTGGGTAAACACACCCATTGGAAATGACAGAAATTGCCCATAACAAAAAGACCCCATGCAAGTCCAA
AATCCAGCAGGGCAGTCAAATCATAAAGCTCCACAATGATCACCTGTAACTCCCCTTCTCACATCCGGGACATGTTGATGCAA
CAGGTGAGTTCCCATGTCTTGGGCAGCTCCACCCCTGTGGCTTTGCAGGGTACAGCCTCCCTCCTGGCTGCTTTCACAGGCT
GGTGTTCAGTGTCTGTGGATTTTCCAGGCACAAAGTGCAAACTGTCAGTGGATCTACCATTCCAGGGTCTGGAGGATAGCAGC
CCTCTTCTCACAGCTCCACTAGGCAGTGCCCCAGTAGGGACTCTGTGTGGGAGCTCGGGCCCTAATTTCCTTTCCTCACTGC
CGTAGCAGAGGTTCCCCATGAATGAGCCACCACTGCAGCCAACTTGTGACTGGACATCCAGTGTTTTCATACACCTTCTGAA
ATCTAGGCAGAGGTTCTCAAACCCCAATTCTTAGCACTCTTTCCATAATGGTTCATTTTTTGGCCTGTTCATTACTGGTATT
TTTCAAAGGAATCTCACTTGAATCTTTACTCTTTTGCAATTTGTCTCCATGACAATGTTGGGAAGTTTTATCTCCACCATCAT
AACATGATCTAGTGATCTCACACATTTGTGGCAAACAATACCTACAAATTCAGAAGCTCTTTGCTTTCTTTCCATGAAATAT
AATTCTTTCTGTTCTGTGTATAAGCATATCTTAGCAACCCTGCACACACCCACATAGATGTCCACAAGCCTATGAATTATTCT
CTGTAAATAAAAACTTATATCAATTTCCCTCAATGTTCATAATTCTCCTGAGTGTGAGGAAGCTCCTTCTCGATCTGTTCAAA
CAAAATGCCCAGAGACCATCCGGTAGGTAAGGAGTTCACCTGGCTCTGGTGTGGGGTCTGTCTCTTTCCCTCTGTTGTCCCAC
AGGTCAGCCCAGTTGTTCAGGTCCTAAGAAGAAAGCCCAGGTTTGTCCTGATTTTAAAACACTTCAAACTTCTGATGACTCTC
CTGTTACCCACATCCATGGAGATAGATTATTTATTATATAATTCACCAAACTAATGTCAAATGTCCAAGTTGTCAATACCGCAC
ATCCTAGGGTATGTTCATGCAATTCAATGGAGGAGAAAGTCTTTCAGAGACAGATGGATCTGAAATGATAAATATGTGGGTAA
GGACTCTGGACTTGAGTGTCATTGTCCAGCCATGTTGCACAAGTGTGTCCTGTCAGGGAAGGATCAGAGTTCCTTGTGCTCTC
AGAGGGAAGGGGTCACAGAGTTCCTCTCTGGTTCCCAGGAAAGGTAATCGCACTAATCTTCATGATCTTCATGAGACTATCCT
CCAGTGCTGACCTGTTATAGAGTTTTTGTCTGAAGTTCTCACTGCAATCCCCAATCTACATATTTTCAATCAGAAGTGTTTAG
AGGCCAGGACACATCTTCAAGGTCACACATTGAGAAGGATGTAGATATGTCCCACTACCTTCTCCTGAGATCTCAGACAGAAT
CCCAGATTTCAAAAGGACACAGAAGGACAGCTCTCAGGTGCTTTTAAAAAATGACCCACTTCCAGGGACAGGGAGCTTCCCTA
```

FIG. 6 (Cont. 26)

```
TAACCATGGTGGATGTTCTGAACTACAATAAACATTGGATGGATCCAGGATTGTTTGAAGTCACTGTCATTATTACATTCAGC
TGCTGTTTCAATGTGTCTGAAGTAGTAAATGACAATTTAGATGACAATTTATATGAATCTTCAAGGGTAGAACAATATTGACC
ATATTCCAAAATCTGTCCTTGATCCATGATCACACTCATCTCCCAGACCAGGTCCTTCAGCACGTCTCTTTACCTGAAAGAAG
AGGACTCTGGGCTTGGAGAGGGGAGACCCCAAGAAGACAACTGAGTTCTCAAAGGGCACAGCCAGCATCCTACTCCCAGGGCG
AGCCCAAAAGACTGGGGCCTCCCTCCTCCTTTTTCACCTCTCCATACAAAGGCACCACCCACATGCAAATCCTCACTTAAGCA
CCCACAGGAAACCACCACACATTTCCTTAAATTCAGGTTCCAGCTCACATGGGAAATACTTTCTGAGAGTCCTGGACCTCCTG
TGCAAGAACATGAAACATCTGTGGTTCTTCCTTCTCCTGGTGGCAGCTCCCAGATGTGAGTATCTCAGGGATCCAGACATGGG
GATATGGGAGGTGCCTCTGATCCCAGGGCTCACTGTGGGTCTCTCTGTTCACAGGGGTCCTGTCCCAGGTGCAGCTGCAGGAG
TCGGGCCCAGGACTGGTGAAGCCTTCGGAGACCCTGTCCCTCACCTGCACTGTCTCTGGTGGCTCCATCAGTAGTTACTACTG
GAGCTGGATCCGGCAGCCCCCAGGGAAGGGACTGGAGTGGATTGGGTATATCTATTACAGTGGGAGCACCAACTACAACCCCT
CCCTCAAGAGTCGAGTCACCATATCAGTAGACACGTCCAAGAACCAGTTCTCCCTGAAGCTGAGCTCTGTGACCGCTGCGGAC
ACGGCCGTGTATTACTGTGCGAGAGACACAGTGAGGGGAGGTGAGTGTGAGCCCAGACAAAACCTCCGTGCAGGGAGGCGGA
GGGGACCGGCGCAGGTGCTGCTCAGCGCCAGCAGGGGCGCGCGGGGCCCACAGAGCAGGAGGCCCGGTCAGGAGCAGGTGCA
GGGAGGGCGGGCTTCCTCATCTGCTCAGTGGTCTCCCTCCTCGCCAGCACCTCAGCTGTCCCCAGGGGTCCTCTTTCTTTAT
TATCTGTGGTTCTGCTTCCTCCACATTCTTGTGCCAAGAAAGAAATGAGGAAGACAAATTTTCGTCTGTAGTTGAAGTTTCACC
AATTACTAGGAACTTTCCTAGAAGTTCCTGCATGGCCCATTATAGCTTACAGATTAAATATATATCAAGCTTCTCATCTCTTG
ATTTGTGTCATCAACTGAATTGTGCCCTCTTTGAAATTCATATGCAGAAACCTTAAATTCAATTGATGTATATTGGAATTTTA
ATGAAATAATTAAGGTTAAATGTGGTCATAAGTGTAAGACTCTAATTCAACAGACGTGTCGTCTTTATAAGAAGAGGAAGAGA
CACCAGAGACCTCTCACTTTTCACGTGCAGGCAGAGAAGAGGCCATGTGGAGACGTAATGCACTAGAAGGTGGCCCAGTGCAA
GCCAGGAAGAAGCCTCACCAAGAACCAACCCTGCCAGAACATTGATCTTCAACATTCAGACTGCAGAATTTTAAGAAAATCAA
TATTTGTTGTTTAAGCCACCCACTCCTGTTGTCTTCTTATGAAGATCCAGACAGACTAATACCACATAACTCTGTTAGCGCTG
TCCCCTGGATGCAGAATCAGCCCGCTGGGGCTGGGCACATCTCTCAGATTTCCACATAAAGTAGGCAAAAAATAGTAGTTCTG
ATATAAAAATTTGTCATGTCCCTGTTGGCCAATTTCTGGGCAAGGTCTTTTAAAGAAGCCCTGGGGGCTTTGTCACAAAAGTT
GCCTTTTATCATTTATTAGGACATAACTGATGAACAATGAGTACCAGTTGGATGGAGACTGACCACTGACCATCTTCTGCTGT
CTCCTAAGTATGCCACAGAAAACCACACCAACATTACTCTATGTCTTCAACTTTCTAAATTTGCACTGATTGGTATTTAAGGC
AGGCCCAGCGTTGAATAACTCCTTTAGTTTTTGCTTCTCTGGGAAAGGPCTTATCTATCCTGGCCTTGGTCTTCAAGTTTCAG
CAATTCTGGGAAGCCAAGGACGCCTCTATCTCCTCCTCCATGCTCTGCAACTCACCTGAGAACAGCTTTCTCATTGGAATGTC
TTCTGTTTAAGGAATAAGAGTCCCTGTTTCAGGCTTGGGTGCCTGAGTACACCTACTGGATCCAGCCCAGGATTGGAGAAACT
TTCCAGAACACATCACCTGAGAAATGACCAGTCACACTGTTACACTTTCACAATTTCCGCTTCCTCATGAGAAAATTAAAATT
GCAGAGACTTTTTCATAAGCGTTGTGCCATGTCCTTTCTTGTTTCTTGCCTGTTCATTTATGTCAGACCAGGTGCCACATCT
ATGTAATCAGGTTAGAATCCTGCCTCCAGTAACACATGAAAAGGACCTATGGTTGTACTTTTGGTCTTTGCTCCAAAGTGTAA
AGATTACAAAAGTCATCACCCTCATTCTTATGCCAAGAGTCATCTGCACAATCTGATCTTCAATACATTTTAGAATCCATCAA
ATGAATGAAATTCCATTTTTTAAATTACCACCCCAAAAACTAGAGAGATGGGCATGTCCAGAATAGCAGTTGATGGTTGCTTA
ACTGGAAGAGAAGTTTCAGAAGCCACAAGCTGTTGAAGGCACTTACGTGGTTAGCACTATAGACGTCTGCAAGACAGATGTGG
ACTAGGGTGAAATGACAGTTCCAGAGGGCCGCACTCTCCTCAGTCTTCTGGAATTTCCCTCTAGAAATCTCCAGAATCTAAAA
AATACAATCCAAATATGTTTCCTATGGGTCATAACTGGGGAAGTTTAATTACTGAAAAATATACCAGGAGCCTTCTCCAAAAG
ATCCTACAGGGAAGAACTTTTCCAGAACCTCATACTATGTGAAGGGAAGAAAAATCTGCCCATTCCAGATCCCTCCCCACTTC
CTCCATTATTATACAAATGAGTAAGGTTAGCCAATAGGGGTAAGATGTAAGCAAATAGTCCAGGGAAACTGAAGCCACAAAAG
GAGTAAAGATGAAAATTCAGCTTTTCCCCTGGAGATGCCTGGTCAAGGTCACAGCCCAGAAAAGGAATCTGATTGAGTCTCTA
GGTTTCCATGGTCAGAACAAGCAGTGCTGACCCGCACTGCACAATCCTTTCTAACCAGGATGATGGCTCTGGATTAAATATGA
GAGTGTGCCAATGCACAGTCTCTGAGGAGAACATAGGGACACTAAAAAAGCAATGGCAGGGAGTTAGACAAGGACAGTAGAGC
AATATGAAGCCTCTGACGTGAACATTTTTAAAAACAAGATCTTGGAAACTCCCTCATTCACCTCAGCTTCTTTTATCATGAAG
ACTTTCCAAGATTCTTAACTGAGACAAAGAAAATAACAACCTGCATGCACTTCCGAAGTCTCCGCTTGTATCCTGTTTGCTTTT
AGATCTCTAGGAGAAAAATGTCAGACACCTGGGCCTAGTGTCAATGTGGGAGGCACTTTCTACAGATGAGGCGCAAGAAGGAA
GGGAAAACGTGTGTTATTGGAATAGTGGATATGAAGTGTGCTCTCATCTGAAAGCATCTGCACCTGCTGGAAATCTCAGATGC
AACATTCAACTGCAAGAACCAAGGCACACCCAAATCTCCTGTAAGATTTGGATTCATTATCCACTGATTCAGTGCAACTGGA
GCTTCAGAGAAGGGGCTCCCTCCTGTGTCATAGCATCCTTGCTTTGAGTTCATTAGATTTAGTAAGGCTAATCAATTGTTTGA
AGAGATGGTGTCAGCAGCGTATGCTGTCACTGAAGGAGTATTCTAAACCAGGACAAAGCCATTTCATGTTAGGCGAGGGAAGC
TGGCGGAAAATGCTTTATGAGCCCCACAGGAACTTCCTTGCAAGGCAAGGGCTGGGCTGGAGGGGGCGCGCAGGAACCGCCCA
GCACAGGTTCCATCCCCGGAGGGGTGCACAGGAGGCTGGGGACGAGGTTCCCTCTCAGCGCCTGTGTCTTCCTTTGGCAACAA
AAAAAATCCTAAGTGTTCAAGAAGTTGCTGATGTGTCTTTAAGTATCCTGTTCCGTCAGAGCCTTTCCTATAACTGAAGGCAA
CCAGAACTGTGTTTTAAAGTCGGTTCCGAGGACTGCAAGTATCTTAATAGTGAGGATATAAAGGATAGGAATGGTTTTACTAA
TTGAAAGGATACAGAATTGTGGGGTTCCGAGGACTGCAAGTATCTTAATAGTGAGGATATAAAGGATAGGAATGGTTTCACTA
ATTGAAAGGATACAGAATTGTGGGAGTCACTATGTTCCTATGAATAAAAAATTCAGATTTCAGTGTTAAGTAATGTTGCCTAC
ATTGTGTGAGTGACAGGGCAGTGGTGGATCTGAGAGTGTGGCAGGTGCACAGACCTAGTGAGTCAGAAATCAATATGGAAAGA
TGAGGATCTATGGATATGAACTGAAAGTAAGTAAACAGTTCATGAAATTCTATTAAATGGAGTAGGAAATAAAACCCAAACTT
ATCCAAAACACAAATTCCTTGGCGATTATTTGGGAGCAGTGAGTTCATCAGGAACCCCAAACTTCTCTTACGTCTTCTGATT
CCTGTTGTCCATGAGATGAGAAATTCAGCTCTAATTGTGCATCACAGGGCAAATCTGTAAACCAGGAGTGTTTCTATTGAGGA
TCATGGTGGATCAGGATTCCAGGCAGGTGCTGGAGACACTGTCTCAGGAGCGCCCAGATGATCTCAGGGGGACCTGCTGGACA
CTCACGTGGAACATCAGCAGTCACTTTCTCAGAGTAACCAGTGAGCTGTGCTGGTGCTGGATAGGATGGGATGGGTCAAGG
CACCTTCTCAGTGTCATGGAGAGTGATTGTTCCAGAAATCATCCAGGTGGTCTCTACGCTAATCAAATATGGGTTCACAGGGA
GGAACATGTGCTCTGGGTGCTTGGTCTTCAGTGAAAGGACGTCTGGCCACCAAAAGTTTGTAAATGGAGCAGGGCATGCATTT
CCTCAAGGAGGATTAGGGCTTGGAGCATCAGCATCCCACTCTTGTAAGGCTGATGTGTCATTTACCTTCCCTTTCTTATCCCA
AATCAGGGTCTTCAGCTATGAAATGCTCTGACTCATGAATATGCAAATAACCTGAGATGCACTGAGGTAAATATGGATATTTG
TCAGCCCTGAGAGCATCATCCAGAAACCACATCCCTCCGCTAGAGAAGCCCCTGACGGCACAGTTCCTCACTATGGACTGGAT
TTGGAGGGTCCTCTTCTTGGTGGGAGCAGCGACAGGCAAGGAGATGCCAAGTCCCAGTGATGAGGAGGGGATTGAGTCCAGTC
```

```
AAGGTGGCTTTCATCCACTCCTGTGTTCTCTCCACAGGTGCCCACTCCCAAATGCAGCTGGTGCAGTCTGGGCCTGAGGTGAA
GAAGCCTGGGACCTCAGTGAAGGTCTCCTGCAAGGCTTCTGGATTCACCTTTACTAGCTCTGCTATGCAGTGGGTGCGACAGG
CTCGTGGACAACGCCTTGAGTGGATAGGATGGATCGTCGTTGGCAGTGGTAACACAAACTACGCACAGAAGTTCCAGGAAAGA
GTCACCATTACCAGGGACATGTCCACAAGCACAGCCTACATGGAGCTGAGCAGCCTGAGATCCGAGGACACGGCCGTGTATTA
CTGTGCGGCAGACACAGTGTGAAAACCCACATCCTGAGAGTGTCAGAAACGCCAGGAAGGAGGCAGCTGTACTGGCATGGAGG
GGATGACAAAGGTTATTAGATTGAAGATTTTCTTAGAAAACGACTTCAAGTCATTAAAGAAGAGGAACAACATAAATGTGTAT
TTGTGAAATTTTAATTGAGAGATTTTTCATACAACATTTATTCTGTAAGCTATTTCAGGGATTGGAATATGAATCAAATTAAT
AAAGCTGATATAGACATCCTCTGAAGGCATCTTCGTAAACATCAATTTCTGAATCAGTGTTGTAAATATTTTGGAACACAGAC
ACAAGATCACATTTTTACTCTACTTTTATCTCTATTTTAAAAAATGCCAAAAAGAATCTTATTTTGTGCATGCCCCATTTTG
AATTCCCACCGTCAATGCATGATAGTTCTTGGTTTTCCTCATTCAAGTTGTCATTTGTCATTAAGAGTGTTGTGTGTTTTAAC
CATTCTAATAGGTGAGTAACGGTATCTAATTTTTATTTAAATGCACATGTCCCTAAAAAATTCATATTTAACAATTTTTATAT
AATTTTTGGTGAGATGCCTCTCGTGATATTTGGTTCATTTTTAAATGCATTTTTTATCAGTTGTAAGTATGCTTGCATATTG
ATTATAAAAGTCATTTAACAAATTAAAATAATTCATTTAACAAATATGCATCTTGGAATTTTTTCTCCAAGTCTGCAGTTGT
CTTTTACTCCCTTATCCCTGTGTATTGCAGAAAAATGTTTGTGTGTGTGTGCCTGTGTATGTACAAATTTAGATTTTAAAA
ATGTACATTTTTATTCATTTAAAGATCATGTCTTTGGCAGTATATCTGAAATCTCATTGTAAAAGACACAATAGTCATTATTT
TTTCCATGTCTCTAATCTTAGGACACAATCAACTCATGAGTGTTTAACCTTCCCTACCTGATTGGAGGACTATCCACCTGAGA
CATTTGGAATACTTCTGTAAGGAGATGTGTCCTTCCCATTATTTCTTTATTTAGTCATCTATTGATGTTCCTATTGGTTTATG
GATGTCTATTTCATACTCCGAAGAAGATCCTTGTTACATTACTTGTTTTATTGTTCAAAACACCACAGCTTTATTAGGTGCTG
GGAGCTCATTTAGTTTGGATCCTGCATCCTTACAGCACACCTCATCTTTTGTTTTTAGACATTTCCCTGTTTCCAAGTATTA
CAATAAATTCTAAGCTTGTTCTCTACGTTACCTTTTTTGTACATAGAATCAGCCATTTTTCTAAAGACTGCTCGTTTTTCATG
TTAAAGAACAGTATTGAAATTTAAAAATGTGATCCTGGGTATGTGTGTTGTTAATGTGGTATCAGTACTTCTTCTAGGATATC
TCCACCAATTGGCCTAGTAAATGGGCATGTTTATAGGAACCCAAGTTTATGGACACATCGAAACTATTTATGTATCTAATCCT
CTGTAATGTGATTACATTAAAAATGAGAACACACTGGTGTCTCCATCCAACTATGCTACCATATGGATGTTTCCAGCCTTCCT
TCCCTCACTGTCCATAACCACCCACTGCAAAGTGAGGAACCCCATCCCACCATATGCCATTTATTACTTAGCTGCACAATTT
CAGGACACATGCATAGCAGTATCAGAAATGTAAAGCTCGTTGGAAACATGTTTATCTACTAGAACAGACTGCTTATGTGCAGT
TTCTTTACACTGTAAACTTATAGAATTTCTTCATTTTCAAAGTTGCTTAGGTCAGCAACTTCATTTTCCACTCTCCTCAGTGA
AGTCATTTCAATGACAATGTATAATGTCATTTATTTGAAATTCTTTCAAAGCCAAAACTATAGTCCGGTAAACATATAGAGGA
TATTCAAGGAATTTAGAGAGTGGGTATAAAATAAGTAAAAATGGCACTGTTTAAGAAGAGTAAAATTGTTTTTAGTGATATAC
AATGGTTGAGACACAACACAATTAATTTGGCTAAGCTCATACTTTTGTGACAGAAAATATAAACCTAAATATATACAATTTTT
GTAAAAAAACTTTAGCAGTTCATTAACCCCAGGGTTAAACAAGACTGTGTAAAATTATCTAATAACTTATTTGATGAGGGTGG
GGATATCATGAGACATATGCAACAAAGAATGAAGGCATTTTCCTCATTTGCATGTAAGATGTTACCATTCACTAAAGACCTTT
AATAAAAAAAAATTTCTACGTGATCCAGTATTTTTTCCTTCTGTCAAGCAAATAACTCATAGGATTCTTTTCTTTCCTTGGT
TGAGAAAGATTTTCCTACAAGCTTCAGCACACGTCAGGCATACACTGTCCCTGAATGGGCATTTACCCTCAGATGGGTACACA
CACCTGTCAACATGGGGGCTCTTCTGTCAGACAAACACACCTTTACTCATGTGGATTCTTCCCTCAGACAAACACACATGTCC
CCACGTGGACTCTTTCCTCAGATTACAACATTTGTCCTTACATTTACTATTTCCTCAGAAAACAGACATTGCATCATGTGGTC
TCTTGTCTCAGACAAGCAAACATGTCTTCAGTCAGATAAGTCTGTGGATTTCCACATTGACTGTTTCCTTACACAAGCACCTA
TATCCAATATTTAACTGTTTTGTGAGAAATTTATCCCTTTTCTCTGGAAATGTATTTTTATGTTCTTACTGGACATATTTTTT
AATAATGTTTGGTACTATGAAGATACCCGAACACTGTCCATACGAGAGAATAAGAGTAATAAGCAGATTAACCCTGTGC
ATCCAGACCCAGGAGTCCTTTGATCCTGCCCTTCCGAAATGGAGACACAGAGGAAGGATGAGCAATGCTGAGCAGTGCACCCA
TGACCACAAAAGGAAAGACATGGCAATGTGTCCCCTCCCCTCCTCATGAAAGGCAGCTCATCCCCTGTTCCTTCAGGCCCTGG
TGAGGAGCCACCCCATGTATATTCCCTTGATCAGTGTCCACACCATGGGGTCTGCACTGATCTGGGCTTCCCTTCTCATCACC
CTCAATATTAGTGTCCCTTGTGAATCAGGTCCAGCTGCGGCTGTTCCACATGGGGCCGTTCTTCCATTTCCTCAGTGTTTGCA
GAAGTCCTGTGTGAAGTTTATTGATGGAGTCAGAGGCAGAAAATTGTACAGCCCAGTGGTTCACTGAGACTCTCCTGCAAAGC
CTCTGATTTCACCTTTACTGGCTACAGCATGAGCTTGGTCCAGCAGGCTTCATGACAGGGATTGGTGTGGGTGGAAACAGTGA
GTGATCAAGTGGGAGTTCTCAGAGTTACTCTCCATGAGTACAAATAAATTAACAGTCCCAAGCGACACCTTTTCATGTGCAGT
CTACCTTACAATGACCAACCTGAAAGCCAAGGACAAGGCTGTGTATTACTGTGAGGGACACAGGAGAGGGAATATCTGTGTGA
GCCCAGACACAAAATCTCTGCAGAGAGACAGGAGGGAACTGCATGGTAGATGCTCCTCATAACCACAAAGGGGCAGTCAGGA
CCATCAGGAGGAGCTCAGGACACCTGGGGGTGCTCAGAACCATGAGGGGTGCTCAGGACATCGGGGCTCTCAGAACCATGAG
GGGTGCTCAGGACATCAGGGGGTCTCAGAACCACCAGGGGGCCTCAGGACACCTGGGGCGTCGAAGCATCAGGGGTGC
TCAGGATATCAGAGTGCCCTCAGTACACGAGGGGGCTCATGACACCAGGGCACTCAGAACCACCAGGGGGGCTCAGTA
CACGGGGGTTCTCTTAGGAAGCAGCTCCACATCAGGAGCCTGAGAGGCTGTGATTGCGTTTTAAACCTGGGTGATTCCCGACC
TGGTCAAGAAAAGTCTCCCCCAGGATCTCTCACCATTTCTTCTTGGTAATTCCATGATTTTTTTTACCTACAAAACATTAA
GTTAGAACAGGGATTTAATTCAACTTTTAATTCTGCAGATTTTCCGAGTAATAGTAGCAATGTTCCCTCAGGACAATTTTAA
AATTGGCTATTTATATATTTTATTTATGTAAATGATACTATCTTGAAAATAGTAAAATTTTAAAATCATACCTCTAATCCC
AGCACTTTAGGAGGTTCGGGCAGGCAGATCAGTTGCGCTCAGGAGTTTTAGAACAGCCTGGCAACACATTTAGATCTTTTCCA
TACAAAAGAAAAAGAAAAAGAAAATAGCTAGGTGTGGTGCTACCTCTGGTACCAGCTATTTGAAAGTCTGAGGTGGGAGGAT
CCCTTAAGCCTGGGAGGTTGATGCTGCAGTGAGCTGTGATTGTGCCACTACACTCCGGCCTGGTTGACAGAGTGAGACCCTTT
CTTAAAAATACAAACTGTTTCAATAAGTAGAGCTTTGTGTCTTTGTGCTGTAATAATCAGTTGTATATATTTTCTAACTGTAA
CTCAGCATATGCATGGTGTTCTGTTTCTTTTTCTTTCATTTGCTGTTGGTGGAAATTAAACACCTCTTTAAACGCTCTTGTTC
TCCCCTTTGGTTCGCTTCGGGTGTCCTGTTTAACAGACTATTTCTTCATCTTCCCTTTTTCTTTGAAAGTCTTTTTCTTTCTC
AGTTTCCATGCAGGATAAAGAAAGTCCCTTTACTTTCTGTCCTCCAAAGTCTGGTGAACAGTCCCCTTCTCTTCATAACCACTG
AAGCCAACCAAGTTTAGGAGGATAACAGCTCTCCTTAGAATATGCTCGTCTACCTGGAGACTCCTCTGCCCTCCTCACCCTTTT
CTAGGGTCCTGCACACATCACACTCATCCCATCCCCTCCCTTCCCTAAGTACCACAGAGTGGGCTCTGCAGTTCCTGCTTCCC
TGTGTGTGCTCAGCCCTGGGGCTCACTAGTGCTTTGATGATGACGTTCAAATCCCCATGTGCTTAGACTCTCTAAGACCACCC
TCTAGGAAGATGCCATTGTGAGTGAGTCCTGGAAATCATGGGCTGTGTTCAGTTTCATATTGCTGGATCTTCTCTATTTTAAA
GGAATACTGGCAATTAAGATTAGAGTTTGTATTGAATATTCATGCCAAAAAAGTTTTCTTTCAAAACTTTTCAAATAAAACAA
```

FIG. 6 (Cont. 28)

```
TTTTTCCTGCCTAGTTTTGAAAACTACAATGTAAATTCAACAAATAATATAATACAATTTTAAAGGTGACGTTTGTCTTATTGG
TTATTCAATTTATTAAAAACAGAAGATATTTAAAATAAATTCCATTGCACATTTAAGTGATGTATTTGACAAGAATGGCATTT
ACATACATTTTTACCAAAACACGTATTTAAATATATTTGTCTTTTTAATATTGGTAGAGGCAGACATACACGTAGAAAAGCAT
CATTTTGTACTACAATCTCAAACTGTAAACACAATTTAAATTCAGTTAAATAATTAGAATAAATATGAAACAGGCCGGGCGTGG
TGGCTCATGCCTGTAATCCCAGCACTTTGGGAGGCCGAGGCGGGCGGATCACGAGGTCAGGAGATCAAGACCATTCTGGCTAA
AACGGTGAAACCCCGTCTCTACTAAAAATACAAAAAATTAGCCGGGCGCAGTGGCGGGCGCCTGTAGTCCCAGCTACTTGGGA
GGCTGAGGCAGGAGAATGGCGTGAACCCGGGAGGCGGAGCTTGCAGTGAGCCGAGATCCCGCCACTGCACTCCAGCCTGGGCG
ACAGAGCGAGACTCCGTCTCAAAAAAAAAAAAAAAAAAAAATGAAACAAATAGGTGCGTTGTTTTGGTGTTTAGATATACA
TTCACTTTTGCATGGGCACATGTATGTGTCTTTGCTGGGCTGTTGTGTATGTATGTGTGCTTGTATGACCATCAAGTTTTCAA
ATACATCATTAAATTTCATAGTTACATTCGTCTTGGCCAGGCACGGAGGCTCAGGCCTGTAATCCCAGCATTTTGGGAGGCTT
AGGCAAGCAGATGACTTGGAGTTAAGAGTTCAAGACCAGCCTTGTCAACATGCCAAAACCCCATCTCTACGAAAAATACAAAA
ATTAGCCAGGTGTTGTGGCACGTGCCTTTAGTCCCAGTGCGACAGGGAAATGCTGGGTCAGAAATCCCACACAAAGTCTCTAC
TTGGTTACCACCTAATGGAACTGTAGGAAGAAAGCCACCATCCTTCAGAACCCAGAATGGTAGATCCACTGACAGCTTGCACA
GTGTGCCTGGAAGAGCCAGAAACACTCAGTGACAGCCCATGAGTGTAGCCAGAAGGGAGATTGTGCCCTGCAAAGCCACAAGG
GCAGAACTGTCCAAGACCATGGGAACCCACCAGTTGCATCCGGTAACCTGGATTTGACACATGGAGTCAAAGAAGACTATTTT
GGAACGTTAAGATTTGACTGCCCAGCTGGATTTCAGACTTGCACGTGGCCTGCAGTTTGGACCAATTTCTCCCATTTGCAATG
GCTGTATTTACACAATGCCTGAACCCCCATTGTACCTAGGAAGTAACTTGCTTGTTTTTTATTTTACAGGCTCATAGATGGAA
GGGAGTTGCCTTGTCTCAGAAAAGACCATGGGCTGTGGACTTTTGAGTTGGGGCTCAAATGAGTTAAGACTTCAGGGGCCTGT
TGGAAAGTCATGAATGGTTTTGAAACGTAAGGACATTAGATTTAAGAGGCGCCAGTGTTGGAATCATATGGTTTGGCTGTGTC
CCTGCACAAATCTCATCTTGAATTGTATCTCCCACAATTCCCACGTGTCGTGGGAGAAACCCAGTGGGAGGTGATTAAATCAT
GGAGGGAGTTCTTCTTTGTGCGTTATTGTGATAGTGGATGACTCTCATGAGATCTGATGGTTTTAAAAAACGGGAGTTCCCTG
CCCTCTCTTTGTCTGCTGCCATCTCCATGTAAGATAAAACTTGCTCCTCCTTGCCTTCCACCATGATGTGGAGGCCTCCCAAG
CCATGTGTAACTGTAAGTCCATTAAACTTTTTCCTCTATAAATTACTCAGTCTCATGTATGTCTTTATTAGCAGTGTGAAAAC
AGACTAATACAGCAAATATCAATCTCTTAAAATATTTTGTTGTTCTGCATGTAATATAGCACAGTCTAATATGGGAGGTAAAA
TAAATCATCCATGGACCTTCAGATATAAGTCATAGGGTAATTATGCCTGTGTCCCTGAAGGAGTGAACTAGAGGTTATACACA
CTAGTGGCACTACCTTTGGCAAAGGGTGTTCAGGGGTTTCTGAAAGTTCTGATAATTTTAATTTTAAAATTGAATTTACTATG
TATTTCTTCATCAACCTTTCCAGAAGATTTTTGGCAGTAAGAACAGCCTAGTATTGGAGTAATACTGATGAATTAGAGAGTTA
TTTTGTAATTATTCTCCTGAGATTTGCATGAATCAATTGATATAGAAGTTCGTATGTCCCAAGTTGAAACATCAGAATCAAGA
AGGCTTCATCACCCTTAATGGCTGTGGTTTTTGGCAAGGCAGTACTTCAATTCAGCCAGAAAGAGAGACAACAATAAAACTTT
CAAATGCAGGGGAGTCTGACCTCAGTCTCTCTCTTATAAAGGCAAAGGCAAAGCTGTGCCACATCAAGATTTTTCTTCAAG
CCTTCAGAGTCAACATTGGGAATGGAAAAGCCAATCACTTTGTCCTTAGAGAAGGCGAAGATCTGAGAGGAATGCAGAGTTGT
GTTCATGAAGGTGATGACATTGTTATTTCTTCTCCTTTGCCCAGTGACTGCTTTCAAGTTGAGTGTTTCAGATGTCAGACCTG
ACTTATAGGGATGGTTGTGACTGCACGTGTCTGACAGGGGCTGAGACTCTATATCTCTAAGTGTCCTGTCCTAGGAGCAGCTA
CAGGAGTCAGCCCTAGACTGGAAGTGCCCTCACTGACCCTCTGCCTCACCTGTGCAGCCTCTGGCCAGTTGAAGAAAGTTTTA
TCCCTGGAACATCTTTTGTCAAAACCACTCCAACTAGTATTCATGACCTATGGTCCACACCCTCAAGTACACAGACATGATCA
TGCTATGACTTGGTGTCTAGAAGATCCCTGCACTTTTAATTTTACCTCTAATATTAGACTCCACTTTATCACATGCGGACACA
GCAGAATATTTTAAGACTTTCATATGTTATGCTGAAAAATTCAATAGTTCATAAAAGTCTACTTCCCATCACTGCCAGTGTTT
ACTACTGATAAGGATCTGCCATCCCCTAGGGAGGAACTATAATGGATGGTGTGCCCTGTTAGTGGTTATGGGAATGAATCCA
TCTTGTGGCAAATGGCAGCATCTTCTTGTTTTGCAAGATTAAATAGTTTTCTATGGTGTATAAATACAACATTGTCTTTATCC
ATTTGTCTATCTACTGACACTCAGATTGTTTCCATATATTGGCTAAGATTAATAGTGTTTCAATAAACATAGGATTCAACTAT
CTTAACAAGGTGGTAATTTCATCTGCTTTGGGTATATTTCTAAAAGCAGAATTTCTGGTCATATAACATTTCCAGTTTTAATT
CATTTGGTGCCTTTATATTGCTTTCCATAATTGTGAAAATATAGAGTGGTATAGCCATTATGAAAACAGTTTCAGTTTTGAG
GTATGATCCATAAACAAATAATGTTTGATTATGGCTCTCCATGAGAAATTTCTAATAAATATGATAGAAGTCAAGAAAGCGTCT
CACATTAAAGCAAGGATTAATTTTATCCCTTACTCCCTCAAAAGCAAAAGATTGGAAGCATGCATGATGGAGGCTGTTAGCAG
GGTTCAGAATGATATCATAAAAGGGAAACTCAGTTGGATAAAAATGTTGGGCTTTCAGTCATAGGTATGTCGATACTCAATATG
AAACCGCGAAGTCAAATGAGGATCTAGAATGTGTTCACTTGAACCAACAGCACATTCTCAGACGCACCTATTGCTGCATCACA
AGGGTGATGAACTTTTGAAACAAGTAAAGTGTGAGTGCACAGTAAGTGATAAAGTTATCACCTTTACATGAAGTTTGTTCAAT
ATGCCAAAGGCTTGTACAGATTAATCATACACAAATATACACAATGTATTTTTGCATACACAGATGTCTAGAGGATGATTCTT
TTAGGGAAAATTCTTCAGGTCACAGAAATCTGTGTAAGTTGGAGGTGCCATGAAAAGTATCTCTTTTATAAATACTGGTCTAT
TGCTCAATTAGGGAAAATGATCTCTGTTGGAGAAAGCTTCCAATTTGGGAGATTTCTTCATTGCTTCTTGAGTTGTAAGACAT
GAACCAAAAAATTGACTGGAGTTTTTTGGAGTTTCATGGCTGGAGTTTCATGGCTGTGTTGTTAAAAATTTCTTATACGGTTT
CTTTCAATTATTTGAGATCAGTTTTTCTGATTTTTTTCTCCAGTAGATAAATTTTCACAAGATCTCAGGAAACCATGTCTCTG
GTGCTTTAGTTTGAAAAACTAACTTCCTAGGTAAAGAAGCTTCTGTCTAACCATGATGAGCTCATTTCTTCTGCATACCATGA
AGTTTGAGACCCCATTGTCCAGAATCATGAAAATTTTACACTCCAGTTTACTGAAAATCTTGACTTTGAATTTAATATTGATT
GGCATTGACAAAAATGGTTCATTCTTGGATGTGTCCTAAGTTGCTCACCCAACATATCAGTGGACTGAGAATCTTCCATTAGC
TCCCTCTGTCCATAGCACTGAGTCTATTGACAATCTTTGCAGTCCTCTATGAAGGAGAGTCCTGAGGTTCATCAGATTCTTGT
AGACACTCAGATGAACCAAAGGAATTAACGGAATTGAGGACTGCCAGCCATTTCCACAACACTAGGAATAATTACCATCTAAG
TGTAAAGGTCTACATCATTCAGAATACCCTGCATGACAGGCTGATGCAAAAAAAAATCCAACCCTGCAGAGGCTTCACAGCAA
CCCTCACAGTTCCTTCAGGGAAGAAATAATCTCCAAGTTCAGTGAGTCAGTAAAGCTGTTCTGAGCTACAGTAAACATTGGAT
TGGGCCCAGTTTTGTCTGAGTTCAATGTGATTGTATACTGAGTTCTGATCCTATATGGACTGAGTATGGATAATTTAAATG
AGCCTGGCTGCGTGGTTTGTTATATGAAAAACCTGAACTAAATATAAATAAAGGGCATGTCTGACTAGCATGAGGGTGAGAGA
TTCTGGGAGCTCCACCCCCCTTACTCTTATTGCCCTTTCCTCCAGGAACCTCCAGGTCCTCAGGGTGAGAATCCACACAGATC
CCTTCATGGCTCTATTGCCAGGAGACCAAATCTCTGATAAATCACTCAGACCTTCTTCAGACAGACAACCCAGGGAAAGGGC
ATTTTTACACCCTTATGTATGTGGGAAAGGTAATCCATACCCATTAGAAGCCCCTGCCAGCAGCCTAACTTTATCATGAAAA
TGGGTAAAATTAGCCAATAGGGGTACATTTAAGAAAATTTTCCTGTGATGTTCCATCAGAAAAGAGCAAAAATCAGCTTCAC
ACCTGGAGACTTCCTGTATCGGGCACAGCTCAGAGAAAGAAGATCACCACAGAATTAAAATGCAACTGTAAGAACATGTAATG
```

```
CTTCCGTGTTCCACACATTATGTCTCACCAGTTTAGTCAATATGGATTAAATATGAGAGCGTGGCAATGCACAAACTCTATCT
GAGGAGGAAAGTCAGAGAAAAAATGTTAAAGAAAATATGGCAATTTGAAGCCTCTGACACCAGCAACTTCAGCACCAAGGAAA
TGATTTCACCCTCATTGGCCTCAAATTTACTTTTCATGGAGCATTTTCAGGGTTCCAAAGTGAGACCAGGTGAATTCAATGTG
CATGCACTTCTCAGGTGTCCACGTGTATTTTGTTTATTTTATTTCTATTTGCAGAAAGTAAACACATATTCAGCCTTAGTGTC
AGTGTAGGGAGTGCTTTCCATGACATGAATACCAGAAAAAAAGGAAAAACATGGGGCCAATTAATGTAAAAATTAGCCACTGT
GTGTGTGTGTGTGTGTGTGTAGGTGTGATTTGAATACTAGAGTTGGAGTGGGCTTCTATCCACATGCACCTGCACCTGCAG
GTAGTCTCAGGTGCAATAATCAACTGCCTGACCCTAAAGGAAACAAGAATCTCCCCAAACCCCTGAAGAGTGTTTGGGTTTAC
CGTGTGTCCAGTGATTCAGTGCCTCTAGAGCTCCAGGAAGGGGCTCCCCGGTGATGCCTGAGATCTTTTCTTCAGGTCTCCC
CTGCAGAGTTCCTCTGGGTTTCCTAAGGGCAATTCACTATTTCAAAAGATGGTGTGAGAAGCACATGCTGTCACTAAAGGAGA
ATTCTGAGCCACGGCACAGCCACTTTATACTGGGCTAGAGACACTGGTATGAATATACTCTGTAAGTTTAGACAGAAAGCCTC
GTGCATGGTAGGGGCTGGGCTGCAGGGGGTGCTCAGGATAAACGCAGCACAGTCTCCCGCCCCAGAGCAGGTGCACAGGAGGC
TGGGGAGGGGTTCCTCTCAGGGCCTGGGACTTCCTTTGAAAATATCTAAAATAAGTATTTCACAAGGGCTGCTGTTGTTTGTA
TAAATATCCTATTCAATTGTGAGCATTTATCAAACTGGATGTTGTAATGACAACCACTTTTACAATGGGGATTTCAAACTCCC
CTAGATATCTTAATAGTAAGCAGCTGGAGGTCAAGAAGAGATCCTTTCTTTTAAATAAGTGCAATTTTTGGAGAAACATACTC
ATTCCCAAAATAACGCATTCACATATTAAGGTCTAGAAATGGCTCAAGTTGTCCCTGGTGCATTCGAATGTGGGTTCAAAGTG
AGGTGCGTGTCCTGAGGGAGCTTGTTCTCCAGTGGAGGAAGCTCTGTCAACACAGAGTTCAGGGATGTGTAGGGGTCGTATCG
CCTCTAACAGGATTACGGCTTGAACCCTCAGCATGTACAATTGTGTCGTCCATCTGTCATGTATTTGCTCTATCTCATCCTGG
CTCAGGAATTGGGCTATTCAATAGCATCCTTCGTGAATATGCAAATCACTAAGGTTAATACAGATATCTCTGTGCCGTGAGAG
CATCACCCAACAACCACACCCCTCCTTGGGAGAATCCCCTAGATCACAGCTCCTCACCATGGACTGGACCTGGAGCATCCTCT
TCTTGGTGGCAGCAGCAACAGGTAAGGGACTCCCCAGTCCCAGGGCTGAGGGAGAAACCAGGCCAGTCATGTGAGACTTCACC
CACTGCTGTCTCCTCTCCACAGGTGCCCACTCCCGAGTGCAGCTGGTGCAGTCTGGGCCTGAGGTGAAGCAGCCTGGGGCCTC
GGCGAAGGTCTCCTGCAAGGTGTCTGGTTAAACTGTCATCACCTATGGTATGAATTGGATACGACAGACCCCAGGACAGGGGC
TTGAGTGGATGGGATGGATCATCCTACCCTGGTGAACCCAATGTATGCCCACAGATTCACACACGGTTTGTCTTCTCCATGGA
CACCTCTGTCAGCACGGCGGATCTGCAGACTAGCTGCCTAAAGACTGAGGATGCAGCCATTTATTACTGTGTGAGGTACACCG
TGTGGAAACCCACATCCCGAGAGTTTTAGAAACCCTGAGGAAGGAGGCAGCTGTGATGAGCTGAGGCAGTGGTGCAGCATGTC
TCTAAACTTCCATTTTATCTAAGTTTGCATTGAGTTCCGCTTTAATATTAGCCAGGAATGTGGGATAGACGGGTGCTCCTAAG
AGGTCCTTAATTTGCCCATTTTGATGGGTTTTCCAGAAGACGTGAGAAGCCACTTTGTTAACAAAGCATCCCAAAGCCATGCC
CTGCTCCAGAAACACGTGTACCCATTTCCTGGTCTTTGGTTAACTGACAAGCTCTCATCAGCGCACCTGGGCTAATTTCTCAT
CAGGTAGAAAAATGTGTTGTAAAGCAAGGCTAACGTTGTGATAGCAATCCTGCTCAATAACCTTCAGCATCGTTGTTGTTGT
GTTCTATCAACTAATTACGTGACTTCAAGGTTCTCATTGGGAGTGTCTTATAAATTTAAGGGATATATAGAAGTTCCCCTAAT
TAAAATAAAACAATTGTGAGCACAACCTCAGTGTTCAACCATGTCTCCACCCTTCCCACCATTCACCCCAAAGAAATGTTCAC
CTCTCCTGGAAGTCGGGTTCATTTTCAAATTAGTTATTTTTTATTTTACTATATCAAGATTATTGTATGTGACTACTGTAGCA
GAAAGTGAATTATGGGAACTTGAAGTAACCAACGAAAGATAAATTCAGAACTAATTAAACAAGATGTCAGAACGTGATTGGCT
CTAGTCTTTTAAAATTCAGCAGGTTATGTAACCAGGCTTTAAATTTACACATCTTCCTGTTACCTTCACGGCACAGTCAACTC
CCATTATGTAAGAAATGGCAACTGCATTCCCAAGCGTCATCCAAAATTGTAAAAATAGACTGGGTGAGGTGAGGAGTTGATTG
TTTAAATTCCGCTCTGAAGAAGCAGCATCAACTCAACAAACCACCGCTTTTCCCTCAGTGACTAGAGCTATGTCGCAGGCCAC
ATGGACCTAAATATCCTTGATAGAGATAATAGGACTACATAAATTGGGCTGATCATTTTATGCTGTAAAATTAATAGGTGAG
TCTGCACTCCAGCCTGGGCAACAAAACAAGTCTTGCCTGTAAATACAAAAGAAAGATAAATTAATAGGTACTGACTTTGACAT
TTCGGATAATAATATTTTCATAAACCGAATTTAATTATACCCACATTGTTACCTACACCTTCACTGAAAAGTTCCTAGTTATC
ATGAGTTCCATCAACACTCCACGTGTTCAAATCTGGACATCCAAGAGAGTCTGGAGAATAAAATGCAATGAGGGCAGTGAAAC
TTGCATATATTCAGCACCTCTTAACTCAGGAGGACTCAATACACCCTGGAACACTCTGCTTTTCTGAATGGCTCACAATGACT
CCAGCTCACTCTCCAACCTCCTCAAACATCTGGCTTCTGTTTGCCCTAAGTTCACGCTCTGCTCTTAGTCTGTGCTCTGAAGT
CTTTTGCAAAGGTGAAAATGAGCTGTCAGATGGAACTTCCTTCTCACCTCAGCATGGAATTTACTGTTTCATTTAATGACCACT
CTTTCCATAATGGTTGATTTCTTTCAGCCTGTTCATTACTGGTGATTTTCAAGGGAATCTCTATTGAATTTTTACATTTTTGC
ATTTTTGTCTCGGTGACAATGTTGAGAAGTTTTTACCTCTAGCATCATAACATGATCTAGTGACCTGACACATTTGTGGCAAG
CAATACCTACAAATTCAGAAGTTCTTTGGTTACTTTCCACAAAATATAATTATTTCTGGTCTGTGTATGAGCATATCCTAGCA
ACCTTGTACTCCACACAGGTAGATGTCTACAAGCCTATGAATTAATCTCTGTAAATAAAAATTTATCTCAATTTCTTTCAATG
TTCATAATTCTTCTGAGGATGAGGAAGATCTTTCTGGATCTATTCAGACAATAGGCCCAGAGACCACCTGGTATGTAAGGAGC
TCACCTGGCTCACCTGGTTCCCCCTGTGTCTCACATAAGGTCAAGCCCACTTGTTCAGGTCCTAAGAAGAGAGCTCAGTTTTT
ATCTGATTTTACAACACTCCCAATTTCTGCTGACTCTCCTGTTACCCACATCCATGGAGATACATTATTTATTATACAATTAA
CCAAAGTAATGTCAAAGGCCCAATGTGCAATATTGCACATCCTAGGGTATGTTCATGCAATTGAATCGAGGAGAAAGTCTTTC
AGAGACAGATGGATCTGAACTGGTAAATATGTGTGTAAGGACTCTGGGCTTAAGTGTCATTGTCCAGCCATGTTTCACAGGTG
TGACCTGTCAGGGAAGAACCAGAGTTCCTTGTGTTCTCAGAGGGGAGGGGTCCCAGAAGTCCTCTCTGGTTCCAGGAAAGGT
AATTGCATTAATCTTGGTGATGAGACTATCATCCAGTGATGATGTACTATAGAGTTTATGTTTGAAGTTGACACTCTATCGCA
ATCTACATCTTTTCACACAGAAGTGTTTAGAGGTCAGGCCACATCTTCAGGATCCCACATTGAGAAGGACAGAGATATATTCC
ACTACCTTCTCCTGAGATCTCAGGCAGAAACCCAAATTTCAAAAGGTCTCAGAAGGGCAGCTCTCAGGGCTATTTAAAAATA
ACCCACTTCGTGGGACAGGGAGCATCCTTCTAACCATGATGGATGTTCTGAACTACAATAAACATTGCATGAACCAGGGTCT
GAATTCACTGTGATTATTACACTCCACTGCTGTTTCAATGTGTCTGAAGGGGTAAATGACAATTTAGATGACCTGGGTGTGTG
GTTTGTTTTACATAAATCTTCAAGGATAGAACAGCATTGAACCTATTCCAAAATCTGTCCCTGATCCAAGATCACACTGATCT
CCCAGAGCAGCATCTTCAGCACCATTTCCCTACCTGGAAGAAGAGCTAGTTGGGCTTGTAAGGAGGCCACAGGAAGAGAAC
TGAGTTCTCAGAGGGCACAGCCAGCTTCCTACTCCCAGGGCAAGCCCAAAAGACTGGGGCCTCCCTCCTCCCTTTTCACCTGT
CCATACAAAGTCACCGCCCACATGCAAATCCTCACTTAGGCACCTACAGGAAACCAGCACACATTTCCTTAAATTTGGGATCC
AGCTCACATGGGAAATACTTTCTGAGACTCATGGGCCTCCTGCACAAGAACATGAAACACCTGTGGTTCTTCCTCCTGCTGGT
GGCAGCTCCCAGATGTGAGTGCCTCAGGGATCCAGACCTGAAGATATGAGATGCTGCCTCTCATCCCAGGGCTCACCGTGGTT
CTCTCTGTTCACAGGGGTCCTGTCCCAGGTGCAGCTGCAGGAGTCGGGCCCAGGACTGGTGAAGCCTTCGGAGACCCTGTCCC
TCATCTGCGCTGTCTCTGGTGACTCCATCAGCAGTGGTAACTGGTGAATCTGGGTCCGCCAGCCCCCAGGGAAGGGGCTGGAG
```

FIG. 6 (Cont. 30)

```
TGGATTGGGGAAATCCATCATAGTGGGAGCACCTACTACAACCCGTCCCTCAAGAGTCGAATCACCATGTCCGTAGACACGTC
CAAGAACCAGTTCTACCTGAAGCTGAGCTCTGTGACCGCCGCGGACACGGCCGTGTATTACTGTGCGAGATACACAGTGAGGG
GAGGTGAGTGTGAGCCCAGACACAAACCTCCCTACAGATAGGCAGAGGGGCGGGCACAGGTGCTGCTCAGGACCAACAGGGG
GCGCGCGAGGCCACAGAGCCGAGGCCGGGTCAGGAGCAGGTGCAGGGAGGGCGGGGCTTCCTCATCAGCTCAGTGATCTCCC
TCCTCGCCAGCACTCAGATGTCCCCAGGGCTCCTGTTTCTTTATTGTCTGTGGTTCTGCTTCCTCACATCCTTGTGGCAGACA
AGAAAGGAGGAAGACAATTTTTCTGTTTACTGTTGAGGTTTCACCAATTACTAGGAACTTTCCTACAAGTTCCTGCGTGACTC
ATTTTACCGTATATGTGTGTGTGTATAAATATATACACATACACACACACACCATATATATACACCATATATATTATATAGAT
ACACACCATATATATTATATATATACACACCATATATATTATATATATACACACCATATATATTATATATATACACACGATAT
ATATAATATATATATACACACCATATGTATATTATATATAAACACACCGTATATATATATGGTTTCTCACCATCTCTTGATTT
GTGTCATCAATGGAATTGTGCCCTATTTGAAATTCATTTACCCAAACCTTAAATCCAATGGATCTATACCGGAATTTTAATGA
TGCAATTAAGGTTAAATGTGGTCAAAGTGTGAGACCCTAATTCAATAAACCAGTTGTCTTTATAAGAAGAGGAAGAGACACCC
GAGACCTCTCACTTTTCGCGTGCACACAGAGAAGAAGCCGTGAGGAGACGTAGTGCACTAGAAGGTGGCCCTGTGCAAGCCAG
GAAGAAGCCGCGCTAAGAACCAATTTTTACAGCTCCTTGATCTTCCACATTCAGACTGCAGAATTGTAAGAAAATCAATATTT
GTTGTTTAACCCACCCACTCCTGTTGTCTTCTTATGAAGATCCAAACAGACTGATACCACGTAATTCTGTTAGCTCTGGTTCG
TGGAGGGAGGAGCAGCCCCCTGAGGCTGGACACTTCTCTCAGATTTCCACGTGAAGTAGGTAAAAATAGTAGCTCTCATATAA
AAATGTGTCATGACCCTGTTGGCCATTTTTGAGCAAGGTCTCTGAAACCAGCCCTTGTGTGTGTGTCACAAATGTTTTCTTTT
ATCTTTTATTTGGACATAACACATAGACAAGGCGTACCAGCTGGATGGAGACTGGTCACTGCCCATCTTCTGTTGTCTCCTTA
GGATGTCACAGAAAACCACACCAACATCACCAACGTCACTGTTTTTCTTCAACCACCTCAAACCGACTATAGAAATGATCCCT
GCAGTATAAGTCTATTTCTTCAAACTTTCTAAATTTGCACTGGAATCTCTTCCTAAATGGGGAGCTACATGGGGTCTGAGTTT
TGTTCCTTTCTTCCCAGTCTTCCCCAAGTGCCAAGGACAGAATAGACTTAAAATAAAATTTGGCCGTCAGTGGCCCCAACCCC
ACATCACTTTCTAAAACCCACATCCTGCATCCATCCTTCTCTGGACACCCCTCATCGGGCTACCTACGAATGGCCAGAAGCTG
CCATCACCTTCTGGGCTGAGGCCACGAGTTATACACACGTGTGATTTCAGTCACACACACTCTACTGCAGGACACACCTGTGT
TCTTGAGGCACTCAGGCACCCTGCTGATCTCAGTCATTCTCTAATAAATTACACATCTCTTATTAATAAAGGTCCAGATGGTC
CCATCAGCTGCAGAGCAGTGGAGTAAAGCTCATGGGTGGGTCCGTCAGGTAGAAGTCAGACAATGGATGGGATGGCTGGTCAC
TTCCCTTTTCACTGATGTCCCCAGTGAATATTAATGGAATAAAACCATATTAACTACAGAGGGACAGAAAAGAAGACTAGCTC
ATCAAGGTATTTAAGGACCAGGAACTTTATTTGGGGGGAAAGTGAAGACATTTTAAATGGAAAGCCCTAAAGCACATACAAC
AGCTGACAGAGTGGCCACTGTGCACATGAAGGCTGAGGAGACGGATGGCAGCGTCCGTTCCTCCAAGATGTCCCTGGGTGTGT
GATGGTTGGACTCCTTATGCATATGAATATAAGAGCTGGACTCAGGGAGAAAAAGGGCCATATCTCATAGGAAAGGAAGCCC
AAAAAAGCAGATGGGCATCCCTGGAGAGAGCTCATTAGATTTGGTGTGTTAAGACAAAAATTTCTTCCAAAAATTGTAATGT
TCTAAGCTAAATATGAACCTCTTCAATAAACTGAGAATTAACAGGAGAATAGAGCTATGAGTTGAGAGAAGAAACAAATCATG
AGAGAGCAGAAAGCAAATCCACAAAAAACTGTCATATGACAGAAGTCAGAATGGAGCTGGGGCAGCTACTTCATTATTCTGAA
GACTTGTTGACCATGTGGAGAAGGGGCTTGAACAAATGGGGACGTTCTCCAACCTTCTGAATCAGCCTCCTTCTTATGCATGA
GTAAAAATCATAGTTCTGGGTGTGACCTTCCCAAATTTCCTGTCTGTACCTCTTCCCCCAGGGGTAGAGTGTCTTCCCACCAC
AATGGTTTCTCACCAGTGTCCTCAGCTTCTCCTCCATTGAACTTACCCTGCAGATTAAGAATTTCTTCTAGATGTAGTTCTTT
GGGAATTTTCTGTTTTCTTTAGTTTCTGTTGACTCCACCACACCCCATAGGTCACAGGTTTGATTGATTTCCCCTGGAGACAG
TGGAGGTGGATCCAGGCGTTCAACAGTCCTCGCTGTTCCTCCCTTCCTGTCAGCACCACAGGACAGCAGATAAGGGAGTTGAC
TGTAGATTTTTCGAATTCTTGGGAAAATCCTGCAAGGACTAGTAGATTCACACTCCAATACCATTAGCACATGCATCCAAAAA
AAATACTCACGAAATATTTCCAGGTTAGCTCTGTTCCTCTCTCAATGCCATCCAGTGGCACCTGCCCTGGGTTCACCAACATGT
GGGCCCCACTCCTCTCTGCTGGCATCTCTCTCCTCACATTTCAGTCTTCTCGTTAGCTCTGTGAAAGCAACTCAGATATGTTA
AAAGGTTTTCTTCTTCATTTATTCAGTTTTTCAGGTTTGTTGTTAATGAGGTCAGAATAAGACCATAGTTTTCTCATTTTTCA
CATTCCCACACTGAGTAGCCACTTTCTATATAAAGCCAGAAACTAAGGGAACAAATCAAATATCCATATCCACTACAGGTGA
ACGTTAAACAATTTGACATATGATTATGAACTAAAGTACAATGCAGAATTAGAATCAAGGCATCCTCATTCTCATAAAAGCAT
GTCTACATTCTCAAATAACTCTGCTGAGTGAAAGTAGCTGAAGAATTAAGAGTGCAATTCATAAACTTCTAATTGTATAAACT
GCAAAAGGTCCAACTATTCTAAAGTAACAGAGCAGATTTGAAATTTGTGAGAAACGGGTGTTGAAAGTAATTGGCTGGTGAGA
TGAAATTACAGAGAAGTGACAGAAAGATTTAGGGGTTAACTTAATTGTACACAACCTGATTAAAGTTTGCACACATACGTTAC
CATTTTCCAAATTGTGCAGTGTAGATTTGAATTAATTATTAATTGTACTTAAAAAAAAGCAGTAACAAATAAACACATGAATAT
GTTTACTGAGGAGGAACAAAAATAGATGGGTATGAACACTGGAAACATCTCAGACTCTTGAAAGTACACAGGCTTGAACACT
GGTTCTCTCCGTATACTTCCGGTAAACGGCTGAATACACTAAAAGAAAACAGAGATGTCCTGGCAGGGTGGAATCCTGCAGA
CCTCACTAGGTGTGTCCCACACTGCCCTGGAGTTGTCTCAGGGGAGCAGTCTCCTCTAGTGGTCAGAGGCACAGGCTGAGATA
ATGGGGTTAACTCTGTCCAGCTGTGTGACTTTGAATGCATTGTATAAACACTCTGTTCTGTATGTAATTTATCTTCCTTAAAA
TGCAACATTGACACTTACATTAAATGTATTCTACAAATATGTCAAAAAGAAGATGATGACTGCTAAATGATTATCAAGGCACA
ATCACATAATATAATGATATTTTCCTGAGTGATAAGATGACTACCAATCTCGGGGCACTTTGTCTGCTCTGAGCCCTGCCCC
TCCTCAGGATTCCCATCCCAGAGCTTGCTATACAGTAGGAGACATGCAAATAGGTTTCTCCCTCTGCTGATGACCAGTCCTGA
CCCCATAGCTCTGGGAGAGAAGCGCCAGCCCTGGGATTCCCAGGGGTTTCCATTTGGTGATCAGGACTAAAGCAGAGGACCC
ACCATGGAGCTTGGGCTGAGCTGGGTTTTCACTGTTGCTGTTTTAAAAGGTGAACTAGAGAGATTGAGTGTGAATGGATACAC
TTGAGAGAAACAGTGGATATGTCTGGAACTTTCTGACCAGGACACCTACAAGTTTGCAGGTGTCCAGTGTGAGGTACAGCTGG
TGGAGTCTGAAGAAACCAAAGACAACTTGGGGGATCCCTGAGACTCTCCTGTGCAGACTCTGGATTAACCTTCAGTAGCTAC
TGAATGAGCTCAGATTCCCAGGCTCCAGGGAAGGGGCTGGAGTGAGTAGTAGATATATAGTAGGATAGAAGTCAGCTATGTTA
TGCACAATCTGTGAAGAGCAGATTCACCATCTCCAAAGAAAATGCCAAGAACTCACTCTGTTTGCAAATGAACAGTCTGAGAG
CAGAGGGCACGGCCGTGTATTACTGTGCTGAGTCACCAGGTAAGAAGACATCAGTGTGAACACAGACACAGAATTTCCTGAA
ATAAGGGAGGAGTCTGGGCTAAAAGGGCACTCAGGACCCACAGAAAACAGGGGAAGCTCTAGGGCAGGTGCAGATGGTCATCA
TGGGCTGCTTTCCTTGAGGGTCTGAGGCTTCCTCTGCATCTAACAGTTTCCCTGGGAGCCTCTGGACATTTATGCTTCTGTGG
CCACCCCTGAGGTCTCTGGACATTCTCATTTGTTGCAAAGGCAGATGTAAGTATTGGAGGCATAAAAATGCACAGGAGGCCAG
GGAGTCTGTAGACATTGTTACCCCAGAAGGTCAATCTCACCACTAGTGCTGGAGGAGGGTGGGAGTTTGATGAAGCTGCCCTA
AGTATCCTGTGGTCTAAGCTAAGTCCAACGAGGCCATTTGTGCCTCCCTGAGCACAGTTATCCATCAGAGATGTCCCATGTGT
CCCAGCAGCAGCCATGTCTCAGTGTCTTCACTGTGCACAGCCAGTGTCTGGGAGGAGCTCCCAGGATGGGTGTCTTTGGCACA
```

```
CACCAGGTGGCGGGTGTTAGAGTGCGGTGCAGCAGCTGGCTGCCTGTTCTATTGGGCTCCCTGATGCTGGAGAGATGGGAGGT
GCATTCTCAGGTCCAGCACCCTGTTTGTGAATTTTTATATAAAAACCATGATTTTACTTCATTTTCTCAGATGACATAGATAA
TTAGGAACAGAACCTGCAAAGAAATTGTAATTTTCAACTTTACCCCAAATTTATTGTTTCTTAATTCTGTGTAAGATCCAGAC
ATATTATTGCCTTCCTCATGAGAAATTGTTCTATTTAAAATGAAATTAGTTTTTTCTCACATTCTTTGTTTCTGTTCAAGTAC
AGAGATCTTGATTAAAGTAAGTTGGGTTCTTTCCACACACTAACCCTCACCTCCCCCAGAGAAAGAGCAGAGATTTTCCTCAC
TCTGAGTCTAAGGGAGGAGCTGTTCCTGCACGATTCAGAGCCTGCAGAGACCCCCCCGCCAGGTGCAGCTTCAGTGAGTCAG
GTATTTCTCCTTGTGGGTGACCTCCACCGCCAGTGATTGCTGCTCAGGTCTAATTGTGGGTTAAGCATTAGGACACCCTTCAG
GTGATCACATCTCAGTCTTATTCTGAAAATCACCATGAACAGGGATAGTTCAATGCCTATTCTCCTGACATTAGTTTCTCTTT
ATTATTTGGTTCCAAGTATGGAGAAAAATGTGACAATAAATTTGTCAGAATCTAACCTCAGAATCCACTGCATTACTCTAGGA
TACTCACAAATTGAACACAAATGAGCTCTTTATTCTCATAAAAGTATACGTATTTGGGAATTTCAATGTGTTCTCCAGAACCT
GTGCATGCCAACAACTGTGTTTCTCAGTGCCCACTTGGCCTGGTGAAGCCCTCACAGACCCTCTCCCTCACCTGTGCTGTCTC
TGGATTCCCCATCACAACCAGTGCTTCCTGCTGTAGCTGCATTCATAAACCCCCAGGAAGGGACTGGAGTGAATCCAGTGCA
CAGGTCATGAGGGAGTGCACATTCCAACCCACTCCTCAAGAGTCCAGTCACCATCTCCAGATCCATGTCCAAAAAGCAGTTCT
TCCTACAGCCGAGCTAAGTGAGTCACAAGCACACAGCCATGTATTTTAACAAAAGACACAGTAAGGTAACCACAGTGGGAAC
TCACACCCAAACCTCCCTGTGGGGGTGCACAGGACAGCCACAGTTACTCAGGACCCCAGGATTCCTCAGGACACCAAGGGGCA
CTCAAGGCCATTGTAGATGCCCTCAGGTAGCCAAGGGTTCTCAGGAAACATGGAGGAAAACCAGGACCCCAAAAGGTGCTCCG
TACAGCAGGGGACTCAGGACAATTGCGGGGACTCAGAGCAGGCTCAAAGCTCAGCTTCAGGGCAGGTGCAGCTGGGGTTGAAA
GGGGCTGGATGAGGGGTTTTGTGACACCATCATATTTCACCACTAGACACACTCCACTTTGTCTATTCTAACGCATGTGAGTG
TATGATTAGAAAATGATATTTATATAAATACATAACCATAGTTAGCTGTGTCAAGTTGTCCTCTTGCTAGGTGTCCATAGCTA
GGTGCATCAGCCTTGTCCATAAGGACTAATTCCCCGCAATTACTGGAGAATCTCATAAATTGTGGTCAATTATGTCAGATTCC
TCTCTTTTTCTGCCTTCCTTTCTCCCTTCTTCTCTCTCTCTCACACAGAAACTTACATACACCCACCCCACAACACACCAAAA
TCTATAACTTTTATTACCTGATATATTCAATAAACCTGATTAATGTGCAGCTTTTCCAGCTTCGTTATTTATGCTGTTGTAAC
AATAAGAACAATGTGTTTCCTAGCTGTGTACTTCTCTAAGCTGAGTAGCATCTTTGTTTATAATACCTAGAATTAAAAACAAC
CCAAATGTCAATCACCAGCTTAATTGGTAAACAAATTGAGGAAAAGTCATTCATTGACATACTATCCACTACTACCATCAACT
AATGTTGGGTACACTCAACAGCATGGTTAAATTCACAAGTACTTGTGATGAGTAAAATGAGCCAAAGTAACAAAAGTGCATAC
ATAAGATACAACTTTCATAAATTCTATAGAACAAAAATAATCTTAAGTTACATAAAAATCAGTAGTTCCACTGTGAGTATTG
TAGGAGAGGGGAAGGACTAGGAAGGAGGAATTATAGTACAAGACAAAATTTTGAGGGAATTGACTTGTTATCTATGTTGCTCG
CGATGATGTCTATGACCCATTTGTAAAATTGAACACTTCATATGGAGATTATTATTTTAATTTAACTCCATTAATGATAGTA
CTAATTATAGCAGGTATAATTTGGTATCAAAAGAATTAGACAGAGATAAATAAAATACATGAAAAGTCAGAGACTCTTGAATA
TACACATAAATGAGCCCTGGGCATCTCTGTATTTTTAGAGAAATGCTAGAATATAGAAAAATAATGGCATAATTTTATGTCAC
TAAAAAAGTTTATCGAACTCCACCAGTCATGTGGTATTAGTTCATTTTCACACTGGTATAAAGAACTACCTGCGACTGGGTAG
TTTACAAGGAAAGAGATTTAGTTGGCTCACCGTTCTTCATGGCTGGGGAGGCCACAGGGAAACTTACAATCATGGTGGAAGGT
GAAGGGGAAACAAGGCACATCTCCCAGGGCAGCAGGAGAGAGAGAGAGGGGGGAAGTGACACATACTTTTAAACAATCAGTGG
TTGTTAGAACTCACTCACTACCATGAGAACAACATGGGGAAACTGGACCCATGATCCAATCACCTCTCACCTGGTCCCTCCCC
TGACATGTGGGGATTACAATTTGAGATGATACTTTGATGGGGATACGAAATCAATCTATATCACATGTCCAGCTCTGTCCTGG
AGTTGTTTCAGGGATCCAGGGTGTCCGGCTGATAGAACCAGTGACACCAAGCTCACACCCTCAGCTGTAGTTGACACCACGCA
AAGCCAAGAGATTACAACTAAGATTTAGTTTGAATGTCGTGTCTGATGAAGTCACACACTCAGAGAAAGTGAATATGGAAAAG
TTTATTATTTGCACTCTATAGGTGTCTGGTGAGTGCAGGGCAGGTCTCCCAGGAAAATCTGAAACAGCTTGAAAGAAGAGGAA
AGGAGACTGGCTCAGCATTTTATGATGGTTTGGTCCTGGGGGCAGAGTGAGGCTTCCCACTCACAGAAAGGGGTTTGCAGGG
TTTGAAACTCCCCCTGGCATCGAATGAAGAAGCTCCTGTGATTTCAAACTAGAGCCACCTTGTGTGGCAAAAAAGGAGATGAT
GGAGGAATATGCTTTAAATCATCAGCAGTCACGCACCCAAAAATAGTGTGACAACTTATTCTATGCAGCAGGAATAAAAATAA
TTAATAAGAAAGAAGATAAGGGTTCAGTGTGGGTGGACAACACGCAGGTCTACAGAAATGAGATGACTTTAGAAATATAAGCA
AAGGATAATGAAAAAAGGAGGGGAAGGGGAATTAAACAGGGTCCTGGCTCTGATGTCTTGGGTAGAAGCTTCTCACAATCAAG
GACTACCAGCTCATTCTGCAGGTCTTAGGTCAGCCATCTGCTTAAAAACATCAGAAACGCCAGAGAATCTATGAACATGGTCA
GTTTAACATTTCCTATTTGAGTAGCTTTACAGTTGTGTGGAATTCTTAACTGGTTCTTGTTTTTTCTTTTAGATACAGGCTCT
CACCCTGTCACACAGTTTAAAGTGCAGTGGTGTGATCATAGCTCGCTGTAATTTTGAACTCCTGACTCATATTCTTCCCATCT
TAGCCTCTTGAATATCTAGAACTAGAGGGGCATGCCACTCATCCCCTCCTTATTTTTTATTTTATTTTTCATATAAATAAGG
TCTCTTTGTGTTGCCCAGGCTGGTTTTGATTGCCTGGTCTCATGGGATTTCCCTCACTTCCCTTCTGAAAGTGGTGTGATTAT
ACAGATGATCCAGTGCATCTGGCCTGAATTGATTCTTTAATTGTAAAATACGAACCCAATAATTAACTTCCTGAATGTTTTCT
GCAGTGAGTTAGTTAAAAGGATCTGACAAGATTCCTTCCAATATGATTCAAGAGCAGTATTGTCCACTGATGTTCCTTCCAGT
TTCCTTGTTGAAGATCACAAGAGTCTGTGGAAAAGAGGTAGTAAAAAGGCCGCCTCAAACTCTTCGTGGTTGGAGTGGGTACC
ACACATGCAAGCAGTAGGACAAGGATGATCTCTGGGGTAAAGTCTATAAACATATAGGCCTTTTAGCTGCCAAGTCATAGGGT
AATAACTGATGCAGCCTGAGGAGTGGACCATGGTTTCATAGTGCTAGTGGGAGAACCCTTGGCCAAGCAAGTTTTACATTTTA
TTACATTTTATTAAAGATTTGATAATTTTAATGTAAAGATGACATTTTTTAAACATTCCCAGAAGATTGTGAGTGGTATTGAT
TCTGTCTCGTATGAACAATGACAGTGCCCTCCACGGTTAGATTATGTTATAAACTAGAATGAGGCTAGAGTGTTTGGTGTGTTA
AATCACTATTTTTTTAGCTTCTATGTTAGTTTTTTGTTTGTGTGTTAGCATTTGCTTTAAAATTCTATTAATCAGATCTCTAG
TTGGTAGAAATTCATCTGAAAGTTCTTCCATTGTTGTCCATTTTGATAGGATTTCCAGAAGATGTAAGAACCCTCTCTGTTT
GCAAAAATATTCCAAAGTTGTGCACCATCTAGAAACATAGTTACTTAATTCTAATTTTTAATTTATTAAAAAGTTGTGATAAG
TGCAAAGTTTTCTGCCTTCTGAATTGATTTCATAACACACAGAATAATATATACTAAATGAAGTTTGTACTAGTAATACAAA
TTACTGATTAATAACCTCTACTTTTATTATTGAGGTATTATCCATCAATATATAATCTTAAATCAATGATCTCAGTGGGAATC
TTACCTAAGTAATATACAAAATATTTTCCTGATCTCGACACAAATAGATGTGAACACATTCTTCATATTCAGCCATGTCTCC
TGTCTATCACATTATGAACCACATGCTAACTTTGATTTACTTGGGACTTGCTCTAAATTCAAACTAGTTATCTTTTATCTTCA
CGCAGCTGGATTATTATGTGTGGCTATTTTATCAGAGTCGATAAGATACAATACTAACAATTTTCACTGCAGGCATGTCTAGGC
AAGCCCCCTGTGCACAATGACCTTGGTGGGTTGGACATTCTATGGGACTCTCCCCTGTCTGCCTAGGAGAGTTATCTGCCTC
CTCCCCTCTATCATTTCCTCTTTGAATAAGTGCATCTAACTGCCGTTAGAATACAGACAAAGGCCAACCTTAACTGCTTCCAG
CTGACAGGGGATGCTGTTTCGGGAAGATCTCCCCTTGAGGTCTGTCTAAGGGACCCAGTAAAAGGGAGCCATTATCCCAGGCTT
```

FIG. 6 (Cont. 32)

```
CACTTGGATGACCATTTGGAGTTGATGCCTGAAGGTGAGAAGAGACAAACCGGGTTATTAGAAGACATGTATCAAAACCAAAC
AAGGTGGTAAGGACAGTTTTGAAAAAAAATTCCAAGGCTGCTGACACACCCAGATATCTGGTGGCTGTAGTTATGCCTGCTAAG
ATTTGGGTGCATGGGGCTTGGCTTTCGTTAGCTCCCTTGGACTTATTTTCCCAAACAAAGAAACCTCCGGGTTAGGGGGACCC
TATTTATTCCAGTCACCTGGCATGATTTGCCGGATAATTGCTCAGAATTAAAATATTCGTCCAGATGTTTATATAGCCCATGC
CTGTGTTTCTTCTGAGCTGCAGCCAGAGATCATTGGTTGGTTCACAGCGATAAGCAGAGTTAGTCTAAAATGGAGGCAAATAC
TTAAAACTTATTTCTTCTCTCAGTTAATGGATTCTATAGAGAAAAGTAGCTACTCAGCATGGGAATGTAAAAAAATGAGTAAA
CTATGATCTTATTCTGAACTCATTAACAACAAACCTGAAAAACCAATTGAAGAGACTGTAATTTAAAGACAAGTGTATGATAT
GTTTTGAAACATAATTTTTCTCTCTCCAGTTCTGATTTTTGTCAGAAACTAATCATTATAGGACTGAGTTGTTTGCAAAATAA
ACTTTAGTCTTATGGTTGGTCTGATCATTTGCATAAAGTGAAGCCATAATAATTAATAATAATTCTGTAGGAAAAGCCTGCAA
GCATGAGGAGCTTCACAGTCTAACACTATGAGCACATGCATCCTCCAGCAACTCACTGAATATTTTCAAGTCAGCCGGTTCTT
AGCTTAAATAACATCCAGTTGGTATCTGTCCCAGGAACACTAATATATGGTTCTCTCTGCAGGCCCCTTTCTCCACAGATTAA
GGGTTTTTTTTTTTCTCTGTAATATCAACTCAGATATGTTGAATGCTTTTTCCTTATTAGTGGTTTTTCAGGTTTGTTGTTA
ATGATTTCAGAATAAGATCATTGTTTACTCATTTTTTTAAATTCCCGTGCCGAGTAGCTACTTTTCTCTATAGAATCCATTA
ACTGGGAGAAAAAATAACATTTTCTTATGGGTGAACAATTAAATAGTTTGACATATATTTATGTACTGGTATATAATGCAGCT
TGAAATCAAGGCATGCCTCAATCATAAAAATCATGGCTAAATTCTCAAAGAATTGTGCTGAGTGAAAGAAGCTAAGGAATTAA
GAGTAAATTTTATATAATTCATTGTAGAAATATTAGAAGATGCCACTACCATAAATTAAAATGAAGAAGACTTAAATTTTTCT
GAGAAAATGGTGTTGGGAATGATGCGGATGTGATTTAAGTTTCAGAGGAATAAGAAAAAAGATTTAGGGATTAATTTAATTAT
TCAAAACTTGATTGAAGTGCCGAGTGAATGGCTCCAAACATAGTCTACATTTTTCAAATCATTCCCTATAAATTTGAATTAAT
TATTTATTTTTATACTTGAATAAAGCAATAACAAAGAAATAAATGAATATTTTTGCTAAAATGGAGCAATAAAAAGACTGATA
TTGACAGAAGAAATATGACTGACTTCTGAAAATACACACACATGAGCCGTGGTTCTCTCTACATATTTAGATAAATTACAGAA
AGTTGTCATAACTGATGGGGAATCCTGCAGACTTCACTAGGCATAGTCCACACTGCCCTGGAGTTGTCTCAGGGGAGCTGCCT
CCTCCAGTGGTTAGAGCACAGGCCCAGGTAATAGGACTCATTTTTTTAGATGTGTAATTTAGACACACTGCACAACTGCTGT
GTTCTCTGTGCAAATTATCTCCTGTGAAAATGTAACATTGAAACCTGCCTTAAATATATTGTGTAAATATGTAAAAATAAAATC
AGATTGTGAGAGCTAAATGCTAATCAAGGCGCAATCACGTAATATACAATTATATTTTCCTGAATGATGGAATTAATACCAAT
CTCCCCCAGGACACTTCATCTGCACGGAGCCCGGCCTCTCCTCAGATGTCCCACCCCAGAGCTTGCTATATAGTCGGGGACAT
CCAAATAGGGCCCTCCCTCTGCTGATGAAAACCAGCCCAGCTGACCCTGCAGCTCTGGGAGAGGAGCCCAGCACTGGGATTCC
GAGGTGTTTCCATTCGGTGATCAGCACTGAACACAGAGGACTCACCATGGAGTTTTGGCTGAGCTGGGTTTTCCTTGTTGCTA
TTTTTAAAAGGTGATTCATGGAGAACTAGAGATATTGAGTGTGAGTGAACACGAGTGAGAGAAACAGTGGATATGTGTGGCAGT
TTCTAACCAATGTCTCTGTGTTTGCAGGTGTCCAGTGTGAGGTGCAGCTGGTGGAGTCTGGAGGAGGCTTGATCCAGCCTGGG
GGGTCCCTGAGACTCTCCTGTGCAGCCTCTGGGTTCACCGTCAGTAGCAACTACATGAGCTGGGTCCGCCAGGCTCCAGGGAA
GGGGCTGGAGTGGGTCTCAGTTATTTATAGCGGTGGTAGCACATACTACGCAGACTCCGTGAAGGGCCGATTCACCATCTCCA
GAGACAATTCCAAGAACACGCTGTATCTTCAAATGAACAGCCTGAGAGCCGAGGACACGGCCGTGTATTACTGTGCGAGAGAC
ACAGTGAGGGGAAGTCATTGTGCGCCCAGACACAAACCTCCCTGCAGGAACGCTGGGGGGAAATCAGCGGCAGGGGGCGCTCA
GGAGCCACTGATCAGAGTCAGCCCCGGAGGCAGGTGCAGATGGAGGCTGATTTCCTGTCAGGATGTGGGACTTTGTCTTCTTC
TGACGGTTCCCCAGGGAACCTCTCTAAGTTTAGCATTCTGTGCCTATGAACGTCTTCTCTAAGTATTTGAAAGAGATTATTTT
AATATGAAGAGCAGTTCTCACTCGCCCAAAATGTGGATTGATGCTTACTGGGATGAAAAGTCCCCAAACATGGTCACCCCGAT
AAGAGTCTGAGTGAGCTCAGGGCTTCCTGCTGAGTCTCCTCCTATCAGACCAAGGACAGGGACCTCAGTGAGGTTCCCCCGTC
AAGAACAGTCTTTATGGATACTGATTGTGGGCGGCAACCCACCCAGGTGCCGACGCAAGAGACCGAGGACACGAGCTGTTCCA
GTACAATAAAATATAAAACAAGAATAGTTATACCAGATATAGATCTTAGATATGATTATATATGAATATCATTAATCATTAGT
TGGTAGCAATTACTCTTTATTCCAATATTATAATAATCCTCACTCTACAATCATAACCTAGGAAAAGCCAGGCCATACAGAGA
TAGGAGCTGAGGGACATAGTGAGAAGTGACCAGAAGACAAGAGTGCGAGCCTTCTGTTATGCCTGGACAGGGCGACCAGAGG
GCTCCTTGGTCTAGCAGTAATGCCAGCATCTGGGAAGACGCCTGTTGCCAAGCGGACCATGGTCTAGTGGTAGACTCAGTGTC
AAGGAAAAACACCTGCTACTTAGCAGACCAGGAAAGGGAGTCTCCCTTTCCCCGGGGAGTTTAGAGAAGACTCTGCTCCTCCA
CCTCCTGTGGAGGGCCTGATATCAGTCAGACCCGCCCGCACTTATCCGGAGGCCTAACAGTCTCCCTGTGATGCTGTGCTTCA
GTGGCCACACTCCTAGTCCGCCTTCG▓▓▓▓▓▓▓▓▓▓▓▓▓▓▓▓▓▓▓▓▓▓▓▓▓▓CTTCTAGATAGCAGTAGCAAATCAGTGAAA
GTACTAACAGTCTCTGATAAGCAGAAATAATATTGTAAGCTGTTTCTCTCCTTCTCCTCTCTCTCTGCCTCAGCTGCCAGG
CAGGAAAGGGCCCCCTGTCCAGTGGACACGTGACCCATGTGACCTTACCTATCATTGGAGATGGCTCACACTCCTTACCCTGT
CCCTTTGTCTTATATCCAATTAATATCAGCGCAGCCTGCATTCAGGGCCACTACTAGTCTCCGCATCTTGGTGGTAGTGGTC
CCCCGGGCCCAGCTGTCTTTTCTTTTTATCTCTTTGTCTTGTGTCTTTATTTCTATGCTCTCTCTCCGCACACGGGAGAA
ACCCACTGACCCTGTGGGGCTGGTCCCTACACTGATCACAGACAATAGAGGGTAGGCCAGGTCAGTGTCATGTAGGACATCA
CAGGTTTCACCTCTGAACCTTTTCCTGACACTAAATATGCAAATCAGCATCAGCACTGATCTGGTGATTCTTTTGTTCCTAAT
CCATTTACTTCCTTTTTCAGTCGTTGTTTTCATTTTTCCATTTGCTTTTCCTGCTTTCTGCAAAAGGAAGATTTTTCCCTGTG
GTCAAAATTCCGGACCTCAAGCCCTTTCCTGGCGCTCAGGTGGGTCTCAGGCTGTGGCTGCTGCAGTCACGCGGGAGAGGCTG
GTGGGACTTTCTTCACTCCTCGTCACTCAGGGCCCTCCACTGTGTTGCATGGAGACTTATCTGGAAATGCAAGTTGCGACTGA
GAACTGAAGGGGAC AAGCTT
```

BAC (14+5)
- The human sequence can be cut out as a single 210 kb BsiWI-fragment. The BsiWI sites are boxed and in red font.
- Overlap with the 3' of BAC9 is highlighted in yellow.
- Overlap with the 5' of Annabel is highlighted in blue.
- Human VH3-43 is highlighted in green.
- All other human VHs are highlighted in grey in the order of VH5-51, VH3-49, VH3-48, VH1-46, VH1-45, VH3-21, VH3-20, VH1-18, VH3-15 and VH3-13.

FIG. 7

```
tgtgtttctaattttgttctgataaactttcacagagtaactttctgcactagtcatgtgaggaagaggatgtgaacgtagtc
agaataaaaatagaacaacttgtgttataatctttacaggtgaagctggagaaggtcatgaatagagggttctcatgcacaca
tccctgataacaagaactaccataaaattactctgcacaaccacaactttcaacaaaggctaccacaacaataagagaattaa
tattgtgaggatatctgccctgcaactcccagtacaatcttaaactgattccaccttgttattaattcttctaccccagga
taattgcctcagaacagctcatgtaagtcctctcatttatccttaaaacaacctttaccaaccttactaacctgacttcct
ttacctacctaaatatgcccagggataatcccactggaatgctcattttcaaatacatattatttgattttggagaatttctt
tctgtctgatattcaggtgtgacaagctgtagagggtcacaccactttcctgtgagatgtaggggatgacaatttgggggat
ggctggaaacatccaatatcctcagggtcggccatcagtaagcgcaggctggaagtctcagaacgagttgaagttgcttaacc
acggaattttaccttctccagatcagctttgatggaatcagggcaaactggttatcaatgataatctacctaacattgagtc
aactgatcacagttttaataacctctattaaaaattcacaccaacacttggattagtgtctgatcaaataactacaaagtatt
ttccagccaagtataccataaaacagaccattacccatggagaaaaacatttaacatgagttctaggtccttacattgttaaa
ggtgtaaaactgattatttttaaattatgctttttattttgctattgagttgtagaagtttcatttacatttggatattaa
cgcttttttcagatacatgatatattatccaattctgtgagttggaattatttcattgctttgcagaatatttttttaatcta
gtccaacttgttcaattctgcttttttttaaatgtgctttgaatgtaaaatccagaaaagattgctaattttgaggattgg
gagttttacagttgcaggaatttcattgaaatatttaatgcatttaaagttaattttttgtgttttattctaacctaaaattctt
aattcttcacatgtgaaaatccagttttcataacatgctctttggaagacaccataatttagccattgtatgttgatggttct
catgctgaaaatcagttcgcctcaaaatgtgggtttatatctaagctctctatatgcatttatgctgaaaccattcggattt
attactctgtgtttgtaacaaatgttgaggactggaagtgaaatgcctcaagcttattcttgccttattacagatattagac
ccaaatattctaaccttctactagtgagtataataatagctgtcgcttttttttttttttttgattcagagtttcactcttg
ttgtgtaggctggagtgcagtggtgtgatctcagctcaccgcaacctctgcctcccgggttcaagcgattctcctgcctcggc
ctcccgagtagctgggattacaggcatgcaccaccacacccggctaattttgtattttcagtaaagatggggtttctccatgt
tggtcaggctggtcgcgaactccagacctcaggtgatcctcccgcctcagcctcccaaagtgctgggattacaagcatgagcc
actgcacccagcctcttcattttttttttattcatatgttcattcagcagccactatgtcttcccattgatttctttggtttc
ctctttactatctttttctttttagtaaagctgttactcctaagggaagatgggaggtgggcctggacagggatttggtgcat
tcctctcttcactcacagttcttattgatctctccagtgtctctagaacactggttttcctggcattaccgctgcagataatt
tctctcttgcaatgtagtgctgatgaggaggtgtgtctggatgcatttcagctatagttgctgtttttgctttccctgacacaacc
gtcccaaggggtagaggctggagcattttgtgatgtgtccccagtgactgaaagaaaaagccttcaatagcaggaggaattcctc
aactgtatacactctgagaatttaaacaatgacttctctatcacactcaaattttaaaccatccaatgaatatgtctactttaa
tcgtgtgtttaacttaaatgatatttggcagcctctgtcccagaaaagattatcatctgctcctgtttattccctgcaagtct
ttatctctcttcagatttcagatatcttgtttgtcttataacatcaaaaatctgatgaatttaagaaaatgtgctaatttgca
gatcagtaagctttagtagttgtgagaataataacaaatttttatgggatgcctgcatctccaagctgagtagcatctttatt
tctaacactcagaaactagaaacaatgcaaatatcaagaagatatatagataaagagtaatggcatgctaatttacggtaatc
atagccatcactagaatcaatacactgttgatgctcaatgtggttgaatcacaagtagttataatgagtgagaagccacacac
ataaaacacatactatataattcctgtataataaattcttgaaactcaaaaccaaagtattcaatatgaaggattgactcaga
atatggcaagggaaaaaaataattgggaaggaggaattgtagagtaacacaaggaaacttttaagtgtaatttatttgtttgt
tatctggatggttttggggatgcacaggtgagcacgagtggaattacattttgttgtgtttgttttttttctgaagagatgtg
gtcctactctgtgacccaggcaggactgcagtggtgggatcatagttcaatgtagcttccaacttctggtcaccaacaatcct
cctgcatctgccatctcaagtagctgaaactacagttgtgtgccaccaggctcagcttgagtacttattaaatcaaacacttta
tgcaatatttaatgtatgcaataatgtctcattgagagtattacaaataaatgaatggataatttgttcagtacagattgat
ggaaaatagacactaacatgaggaatgtctgacatttatgaacatacaactgcataaaatgtgttctcttacattcattaggt
aaacacaatagtgcatacacatcaaaccatgctttcattacaggaaggaagttctgaaaatgtcactgggggtgacccacgct
gtgctgggcttggttcggggcagtcaggcccggtggtgagaagcacaggcccagataccaggcttactctgcaaatgtgag
ctctggggacattgtaccacccatctgtgcttctgctggtaattttccatctgtaacgtggaaataacattgatactacatac
cgtgatttctccacatatgtaaaaataaaataagatgattgctgctaagtttaaataagggcagttttcataggtccattgta
cctcaataaaattactttaaaataaaaattacaaatacagttgtaggtttaaagagtttatcacagaacaaacttataataag
aaactatattttcaaaaattgtatcaatatctctaaactcccccaggacacactcacctgctctgggctctccactctcctca
ggattcccaccccagagcttgctatatagtaggagacatgcaaacagagccaaacctctgctgatgaaaagcagcccagccct
gaccctgcagctctgggagaggagccccagctccaggattccaggtctttccatttagtcttcagggctgagcacagaggac
tcaccatggagtctgggctgagctgggttttccttgttgctattttgaaaggtgattcatgggaatgagttgaatgtaagtg
aatatgagtgagagaacagtggatgtgtgcggcagtttctgaccagggtgtctctgttttgcaggtgtccagtgtgaggtg
cagctggtggagtctgggtgaggcttggtacagcctggagggtccctgagactctcctgtgcagcctctggattcaccttcag
tagctcctggatgcactgggtctgccaggctccggagaagggctggagtgggtggccgacataaagtgtgacggaagtgaga
aatactatgtagactctgtgaagggccgattgaccatctccagagacaatgccaagaactccctctatctgcaagtgaacagc
ctgagagctgaggacatgaccgtgtattactgtgtgagaggcacagtgaggggaggtcagtgtgagcccagacacaaacctcc
tgcaggggcatctggagccacaaggggcgctcaggatacacagaggacaggggcagcccagggcaggtgcaggtggaggtc
aagggctgctctccttcagggtctgtggcttcctctcatctaacagttccgcagggagcctcttgtatttacagtgatgtgct
actgaggtttctaagtttgtaaagtttattactacaggaggaaccactatcaaacgccttaaggcaggtgtcactaatggag
aaaggaaagtgcacaggaggctgggtgaggctgtggacactgtctgcctatgattcaagtttcacaagcagtgacggagaaat
gggagtttgatggagctccctaactaccatgtggtctaaactaagtccaactaagtccctgagctctgggtgcccatcaggga
tccgccatgtgcccggcagccgcgtgccttttgtctcctctgcgcccaatcactgtctgtgatgagcttccaggatgtgtgt
gtttggcacaaaccaggtgatggacgtcagacagcagcagctggtgcccggatcatggctccctaatgctggaggaatgaga
ggtgcattctcagggacaagacattgttgatggattttttatgtagaaacccagccatcttacttgctttctctcaggagacataga
agaagcaaccatgcagtcagcaaataattataatttccacaattacccccaaatgtttaatccttaattctgcgcagggtccca
ccgtagagtcacctttctcatgaggaatggttgaatctagaatgagtccacatgatttttcatattttggcttctgtccatgt
tcagagagttagagtagagtaagtttggacctttcacacactaagcctcacctccccacagaaagagcagagacttcaact
attcctgagtgtggggtaggggctggtcctgcacacctcagagcctgcagagactgccacgtgcagtgttatagacttgggtg
```

```
ccottcaggtccatcagcaagtcagagacctaaacaaatattccctattcatgttgaattggcagagtgtaaaaatctagaag
acaaatggccaggaaaaatgtgcgattttgcatgggtgaaggtctggcaagttaatcatcttgaggactgttgaggtcctga
ggtggtcctgcccttgcttgatgcccaggccgtagtccaactcacacgaaattgccagggaatagacagtagttttttttagta
gttcttgttatcaggcataagtgcatttgaattttctcttcatggcctttcctggcactatttctcattttttttaacacaca
tagtttcaactagatttatccacttcacagggtcacagagaaggtggaagaaggaggaggccctggtatgggtctcgaagaaac
atggaaagagtggagagggacaatagcagggtgtaaggaattattgagacttactctgccctcccaggaggctcaggcca
gccttttctgcatttgaggttctggttataaacgctgtagactcctcccttcagggcagggtgacaactatgcaaatgcaa
gtggggcctccccacttaaacccagggctccctccacagtgagtctcctcactgcccagctgggatctcagggcttcatt
ttctgtcctccaccatcatggggtcaaccgccatcctcgccctcctcctggctgttctccaaggtcagtcctgccgagggctt
gaggtcacagaggagaacggtggaaaggagcccctgattcaaattttgtgtctccccacaggagtctgtgccgaggtgcag
ctggtcagtctggagcagaggtgaaaagcccgggagtctctgaagatctcctgtaagggttctggatacagcttcaccag
ctactggatcggctgggtgcgccagatgcccggaaaggcctggagtggatggggatcatctatcctgctgactctgatacca
gatacagccgtcttccaaggccaggtcaccatctcagccgacaagtccatcagcaccgctactgagtgagcagctg
aggcctcggacaccgccatgtattactgtgcgagacacagtgagagaaaccagccccgagccgtctaaaaccctccaca
ccgcaggtgcagaatgagctgctagagactcactcccagggcctctctattcatctggggaggaaacactggctgtttgtg
tcctcaggagcaagaaccagagaacaatgtgggagggttccaggaaactgtataggggaacctgaccatgggagg
tggattctctgacggggctcttgtgtgttctacaaggttgttcatggtgtatattagatggttaacatcaaaaggctgcctaa
caggcacctctccaatatgacagtattttaattagtgaaaattttacacagttcatcattgcttgcttgccttcctcctcct
gtccactctcactcactccttcttttattttctacttaatttacaaaatcatttaaccccttttttgaactattaataggtta
tcttttgtttggtgattgttttccttcaataatatgtactgaataattcatctttgtgccaattcataagtattctggtgtaa
taaagacttctttcataaaaattggataaattaaaataaagataaattttttaaaaacatacgatctatcaaaactgaaccata
aagaaataaaaactctgggttgggtgtgtttgctcattcctgtaatcccagcactttgggaggccatggccggtggatcacct
gaggtcaggagttcgatatcggtctggcaaacgtggagaaacgctgtctccactaaaaatacaaaaattagctggacatggtg
gtgctcgcctgtagtcccagatacttgggagcctaaggccagagaagagattgaaccggggaggcagaggttgaaataagccg
aaatctagccactgcattccagactgggcaacagagtgagactccatcccgaaaaaaaaaactgaacagacctatgagtaaa
gagattgagtcagtgattttttcaaacatctcaaatcaaagaaaagtcaagaacttcatggcttcactactgaattttatcaaa
aatttaaaaaaaactagaatctctctatacaaatttccaacaaatttaaagaggaaaaatacatgcaagcttattttggaagt
cctatttccaaagcaaggaaaagacactccaaatatatataaaatttacaggctaatatccctgattatctagtttcaaaaactct
caagggtggtgagaaaccaaattcaacagcacattaacaacagaattcaccatgatcaggtgtggtttatctctaggaagcaa
tgaagtttcaacctgcagaaataaatgtgatatatcaaatgaaatattgaaggactaaaaccatgtgcaccatatgtccatg
tcaatagatgcagaaagagcctctgtcgaaatccactacactctaattttaaaaatctgaacatattatgcataaaacatat
ataccctcaacataataaagaccacatatcacaagcccacatctaacatcatacacagtgatgaaaatttatttttcctctaag
actagaaactagacaagatgcttcactatcaccaatattattaaacacagcactggtggtctagacaaaacaggccagaaga
aaaaatagaagtcatccatatagtaatgaataaatataaatatattttttacatattacatgctcttatttatacaaagcct
taaacactccaccaaaaaaagattgaaactaatgaagaaattcaataaagttgcagaatccaaatcaaacttacatttcaaga
tggcaggttagaggcattgctagtattcctcttccacttggaaggacaaactgatgtggagagatgaacatcgcggacttatt
ttcaagaagcaatgcaggaactgaacagaaacactgaaataatctacaaactttctgaaaaagcaggaagctgcagcctacac
tgtgagtcaggtgaagggctgggagtcccccagcattgagggagaacagccaaaaattcagccagtggtcccaagttgaaag
tagctctcaacaggggtgtaatcaaacctaggggttgggacgaactccccttggccagggcctgggtgggaagtgttaaaag
tggtctctgcaagttttaggagccatgggtgcaggagctgtgccctgctttgcagcagcaggaagggcatggcatgaaacc
catggctgcagtctccatggggacagcctatgactcctggcatttggaggtattgatcacagattgactgaaactcatctcac
tgctgccagtggaacaccacgggagtggatcagcctcaccaagtatgtgggaactgtgtgggcctaccacccctgccactc
cccaccccctgcccaaacttctgtggaggagaggcagccatggtcccatctggaacatcatcccagtggcctgagaaccacc
ctgtccccacacccacaggggctgctgcttgcctgcatacagagactcagaggggaaaccacctggcccaaccctcacct
tgctttgtgcagccacctgccctggcagcttaacacaaaagacagcatcttttgggagctacatagccacacccactgcctaa
gaatccatagtagccccataccctgggcaacacaaggcttgcaaaaatcccaccgctaataatgcagctggtgctcttttgca
agcaccacctcttagctggaggccaaccaactatgcattacagcatctcctagtagactaacactgcatcctggaaggagaaa
atgactgtgcgatctcagttatcaccatggcctgcaccactttggatgaccaggagatcctgagtctctccatgtgaccagtt
cattgctactataccccatcattcaagaaagccgtacacaaaggctatcaatatccatggaatttcacagagtctccttcact
ctcctgcctgccactccccatcagacccggttctgctgttcactgttgaaaaatatgaggacagttcacatcactggatcactt
agagacatttgcccacaccagcctgaagtgtgtcaacgtcactgggcagctagacctagagaagaaacataactcacagtacc
atggctccaggttctcctcctcttaggggaagggagtgcaccacattgagggaacacctcatgggacaagagaatctggatg
gcaggccttggacaccagatcctccactggtgggaaacttcttctagcagaagtacagttgcagcactgggtcagctggga
aagtcttcagctcttctcaacagacagccctgttgcttgtgaagaatcttgaagaagaggaagcctttccccttgtacacc
actgtaggcacacttgggtctctcccacaagacctcagcatgggtgcaactatagacagcctttctggaacacatcattgtg
actgcatccccagaaacagcactttctggattcaggcttgcatgagacagagagtcacagttcctctctatttggcacatga
acatttgtacagatgaaaaacatgcctgtcttatctgaatagccggaatactgggacagcagtatgtctgagaggtggataa
atttcctactgacttgacaagagagctgaggtggttccaacccttccaccgataagacctcagtgggactcactaaaacctc
tttcagccaactctgtcaaggctgggacttaatttaccaacctgctttagccacaactagtttctacccaaggaaaagtcctc
cactgatgtgaagcttgagccatcaagcaaataaataaatcactgggacaaataaaataaacatgtgcatgccacagaggaa
tgagataaggtttaagagaccctctaccattctaaccccatagaagcagttgcacttgctcacagaccgagcagatttctactg
caatcaacataggaaagcccttacatcaaagattctccataaccccgaacttctacagagtcttcaccccctctaaggacca
aaaaccaaatcaggttgtaattaattataagcattaaagtctcattcttaagggaaaaaatccatttaaaaacaaacacaag
aaacagtcaaatcaaacataaattcaataataattagaaaatctaccaaaatgagaggaaatgagaaaataactggggaaaa
atgagaaaacagggtgctgtgccagtgccaaaaggtcacaaggtcacactacctctccagcaataaaccataacaaaaatgga
gtctttgaaatatcagaaagaaaatcagaatgttgattgataagctactcaagaagatatcagaaaaaggcaaaaatcataa
```

```
taaataaatttataaaactgttgagaatatgaatacaaattttttacagagagatagacatcctaaagagaaaccaatcagaac
tcctgaaaatttaaaaaaatgcagggaattggaaagggaattacaaaatgccatggaaagtttgaaaaatagactagaaaaaa
gtagcagaaataacaatagactagaaacagtacaaaataaaagtagaagtaaaatattcgaggaaaaagaaaaaggaaacagt
taaagaaaaaagtagaaagaccagactattattgaaataaccaaatcagagagaaaaataaatttaaaaagagccaaaagaagtg
aaaaaagtctccaggaaatatgggattatgtaaaacaaacaaattttaagaataattggtgctcctgaagaagaaaaaataata
ataagtttgggaaaacttctctgaaggaataattgagaactacttctctggcctgactaaagacctagatatccaaatccaaa
aagttcaaggaactcctggggaattcattgcaaaaatccttcaccaagcatacagtcatcaggctacctaaagtctacatga
aggaaataattctaagagcagtaaaacgaagaaacccatcagaataatggcagacgtctcagcagaaacttgacaagcaagac
agattagggttctattttcaaactccttaaacagaaaaactttcaaccaagaattcttttttatcccgccaaactgttttata
aataaaaaagaaataaagtcattttcagaaaaacaaatgctgagggaattcatcactatcaaaccagcactacaagaaatgct
agaataagttctaaaccttgaaacaaaaggccaatatgcacaaaaatggaacctcttaaaaattaaaaactcacggggcctat
aaaacaataacacaatatcaaagaatataaacaaaattaggtaacgacatgacaaagagaatagcaactcatatctaaatattca
cattgaatgtaaatcataaaaggcatggaagaaggaatttcacaaaaatagaaaccaggagtgagcaggactagctattttg
atctcagacaaaacaggacttcaaagcaaaaacaatttaaaaagacatagatgatcactatacaatgataaaaggatcaattc
aacaaaaaattacaattacatattatatgccaccaaacactggaggaactagattcattaaacaagtactgctagacctaaaa
aactgagagagttagcaaaacaatcataatgggagattttagtacaatcatgacagtactaaacagatcttcgagacaaaag
tcaacagataaacaatgcacttaaatgactcactggaacaaatggatgcagcagatatttacagaacattctatccaagatct
gcagaatatacattcttctaatcagcacatgcaacattctccaaggtagagcatatactaggccacaaaacaagtctcaataa
attttaaaacaatgaaatcatatcaagtatcttctcagaccacagcagaataaaactaaaaatcatctcgctaaagaactgt
cgaaaatgaacaaatacatagaaattaagaaatttgcttctgaataatatctgggttaacagttacatcaagatgaaaattta
aaaattatcttaattaaattataataatgagacaagttattgaaacctcaaaaataaaggaaaagcagtgataagaggaaagt
ttatagtgccagctgcctgcatcaaaaagtctgaaagagcacaaattcacaacctaatgtcacaccttgagaaattggagaaa
caagaacaaactaaacatagagccagaagaagaaaagaataacaaagatcagagcagaactaaatgcaatccaaacaaaaaa
aagcaatgaaacaaacagttggttatttgaaaaaataaacaaattcatgggtcattagctagattaacaaagaaaagaatatc
aaagatccaataagctcagaaatgaaacgagacattacaatctacaccactaatataaaaaataatttgagactactaagtt
caccttcatgtgcacaatgtagaagacttagaggaaatggaaaaatttctagaaacatacaacactcctagattaaataaaaa
agaaacagttactttgaatagacaaataacaaacagtgagttaatcagtaattcaagaattgccaacaataacaacaatga
aatagggccaggtgaattcacagctgaattctatcaaaaatttaaagaagaattgctgccaattttgctgcaactatttttt
aaatttagataaaaaagaatcctccctaaattattctatgaagctagtataaccaagataccaaaaccaggaaaacacacaca
cacagacacacacacactctacagatgaatttccctgataaatatagatgcaaaaatagcaaaaaaaaaatagctagttgag
ttcaacagcacatcaaaaagataattcctcatgatcaagcgtgtttcatctcagaattgcagggattatttgaacatactcaa
gtcaataaatgtaatacatcacataaacagaattacaaataaaaaccttacgattgtctcaatagatgcagaaaaagcattca
acaaaattcagcattttttaatgataaaaactgtaaataaatgaggcatagaagaaacctgcctcaaactaataaaagttaca
tatgaaaaatccacagctaatatcatgctgaatgtgaaaaagttaaaagcatttaccctgagaacacaaacaatacaaggatg
cccaagttcaccaattctattcaacatagttctggaagttctagccagagcaattagtcaggagaaaaaaataagggtatcc
aaatttaaaaagagaacgtcagactatcactgtttacagatcaagggattatatatattaaaaccctagactcctccaaaata
ctaatagttttagtaaatgaattcagttaagtctcagattacaaaatacatgtacacaaattagtagcacggctatatatcaa
caacagcaatgctgagagttaaatcaagaactccatccctttacagaagctgcgaaaagatagtatatttaccaatatactt
aaccaaaagggtaaaagatctcaacaaggagaactacacaacactgctgaaagaaatcatagatgatacaacaaatgcaaat
gcatcccctgatcatgattgcaagaatcgctattgtgaaaatgaccataatgcctaaagcaatctacagaatcaatgaaatt
cttattaaaataccaacattattttcttcagaattcaaaaataataacgctgaaatttatttgaaaccaaaaaaagccaaaa
tacccaaagaaatcctaataagataaagaaaattggagccatcacattactgaacttcatattacaccacaaggctgcagtta
ccaaaacaacatggcactgacataatagtaggctcatagaccactggaacaaaatagagaacccagaaataaagccacatatg
taaatccaactgatgctttgcaaaatgtaccaaattttaaattgaaaaatagacaccacatttaacaaatggtacaagaaaaa
ctagcaagccacatgtaaaagaataaaactggatttctatctgtcaccatataaaagaccaactcaagatgaatcaggtactg
aaatataagacattaaactcaaaaattctagaaaacaatattggaaaaacacttttagacatcagggtaggcaaagaatttat
aactaagacccaaaagcaaatgcagcaaaaacaaaactaaatttatggaacccatttaaactaaagtgtttcttcacagcac
aactaagagtcaatggagtaaaaagacaactcacagaacgggagaaaatatgtgcaaacttcacatctgacaaaaaattggta
tattcagaatctacaaaatactaaaacaagtcgccaagaaaaaacaaacgatcccatttgaaagtggacaagggacataaata
gatagttctcagaagaagatatacaaatggccaacaaacatatgaaaaactgtgtaacatcactaatcatcaggaaaatacaa
attaaaaccacaatctaataacacctaatcctgcaagaatggccactataaaaagtcaaaaaacaaaagggaatgctatacaa
ctgttgatgaaaatgtaatttagtataaccactatggaaaacactattgagatttcttgaaaagcagaaagtagatctacta
tttttttttttctttttgagatggagtctctctcagtcacccaggctggagtgcagtggtgcaatctcatctcattgcaacct
ccgcctccgtgtcaagtgatgctcccacctcagcctccggagtatctgggattacaggcacccaccatcatgcctggctaat
tgtttttttgaattttgtagagaagggtttcccatgttggccaggctggtctccaactcctgacctcagctgatcctccc
gctcggcagccaaattactgaaattacaggcgtgcagcatcacacctggccagatctactgtttgatccagcaatctcatta
ctggagagctaccaaaggaaataaagtcattatatgaaaagacgtgtatatgtatgtttatagcagcagaattcaaaattg
aaaatatgtgaaaccaatttaaatgcccattggccaatgagttcagaagaaaatgtgacatcgcctgtaatcccagcatttc
gggaggccgagagggcggatcacgaggtcaggagatcgacaccatcctggccaacatggtgaaatcccgtctctactaaaaa
tacaaaaaatttgccggacctgttggcgtgcacctggagtcccagctactcggaggctgaggcaggagaattgcttgaaccc
gggaggcagaggctgcagtgaaccgagattgcagcactgcactccagcctgggtgacagagcaagactcgtgcctcaaaaaaa
aaaaaaaaaagaaaagaaaaagaaaattgacatatatacatcatggaatactccaagccgtaaagggaatggca
taatgtcctttgcagcaacttggatgaagctggaggtaatgagtataagtgaagttcacacaggagtagaaaagcaaaactgt
gtttgcacacttacaagtgggagatgggctatgaacttgcaaaggcatacagagtgatataagggacttttggagactcagaag
ggaaagaataggatggatactagagagaaaataactacactttaggtagagtgtacactattcaggtgatgaatgtactaaaa
tctcagaatttattgctatataattcctccatctaacaaaaaaatatttaccccccaaagctattgaaattaaacaaaaatcaa
```

```
cctacaaaaataagcatcttctgtatacactaaaaaatgattattcaaaattaaaatcaagaaaataaatctaaatacaacag
cttaaaattcataaaataaattttaccaaaataaatttaacaaggatacaaaatatctgcacattgaaaattataatatattg
attaaaatgtaagaaaacacaaatacatggaaggctatcttgtgttcttgtgttactggaacatacattgttaatatgtccat
cctaacctaagcatttacagattcaatgcaatcccattcaaaatttcaaagatatgcatttacataaattgaaaaaaaaaacc
tctctcatttgaatggctgggtgattgacccggactatcaatttgaaatcagactactactccacaatggaggtgagacaga
gtatgtctggaatacaggagatttcttaggacatctcttagtattactttgccatgggattaagatcaatgggaaaaacaac
ctaattcaggcaggaatacaaatggcccagatacttcagaaataaaagtttgggtcttcacccagattaaaaatcctgaccag
ccaaggtacttgctgaaggcaaaacaaatacagaatgggtagtggaagaaggtagttgtcaataccaggaatgaccacacgac
cagaagtggggaccgtaattgtcgtgagtatctccttaagctgataagcaacttcagcaaagtctcaggatattttctccata
tcttgttaggaatatatttctgcatgtgtataactgtactaagaaaatatcttcattgtgccggacacggtggctcacacctg
taatcccagcaatttaggaagccaaggtgggtggattacctgaggtctagaggtcgagaccagcttgaccagtatggtgaaac
gccgtctctaccaaaaatacaaaaattagcctggcatggtggcaggtgcctgtaatcccaggcttctcagaaggctgagacag
gagaatagcttgaaccctgaacccgcgaggcagaggtggcagtgagccaagattgcaccactgcactccagcctgggcaacag
actgagactccatctaaaaaacaaacaaacaaacaaaaatatattaattgttttcattgaatttgttttcttttttatcatgtg
tcacaagatttattgacttcctatcagcatttaaatgttgttaactatatagtggtatgtatgtaggttaaggattagtgc
actttcagttgtatgaaggatagctgtattatgttaggcataattatgaccttattattgtctttatttggagttcaagcatg
attgcagctagatgtgtaggggtgctaagttgacaagaggtgggcttttgatgcttgatactaggtgtcaacttgattggatt
aaaggatgcctacgtggctgggaagtattgtttcttggtgtgtctctgggggtttttgccagaggaggctgacatttgagtcaa
tggactggaaatttgagtttgtcatgttgcatgatccttttaaagtcttatagaacttagttgactattattttggtgtagtt
catttgtataaatatttctttgaagtttaattttcttcctttgcgtttgtctgtcactggcaacacggtaattgtagccttt
agaaatagcttagaaggttggcgactcatcattttttaaaaaagttagagaacagttggcatgactttttttaaattctgagag
ccatttttttatctaacatatatagctatcatgaagaatatttatagtgtgcttgagaagcatgcgtattacactgcgcttggtt
ggaatgttctgtagatgtctattaggtcagtttgttcaatagtgttgtttaagtccatgggcttcctaagaattttttatgg
gtgttctatacattattgagggtgaggtgttgaagtctcctcctttcttattgttttctatttctcacttcatatctcttaaa
ctcttgttaatgcggttatatttctatttttataactatgtaaaatagaaataaaataataattgcttagtaattttaatggg
aaaatcacataataagaaattatatttcccaaatgctgccatcaccactaaactcctcaggagtctcacatctgctctggg
ctctgctctctcctaaggggtcccacatcagagtttgctacagaggaggagacaagaaaatagggccctccctctcctgatga
aaaccagccctgccctgaccctgcaactctgggagaagatctctagtccagaattaccaggagtttggatttgatgatcagct
ctgtacaaacatggctcaccatagagttagggctgagctgggtttccttgtcattatttttaaaaggcgaataatggagaact
tgagatatggagtgtgagtggatatcagtgaaaaaacagtgattctgtgtggcaggttctgactcagatgtctctgtgcttgt
aggtgtctagtgtggggtgcagatggtggagtcttggggagagttggcacaagctgaatgtgcctgagactctgccgtgcatc
ctctgaatccaccttctgtagctactagatcagctgaatctgccaggctccaggaaagggctgcagtgagtagtagatataa
tgtacgatggaagtcagacataatatgcagactctgtgaaggtcagattcaccatctccaaagacaatgccaagcacaggttg
tatctgcaaatgaacagtctgagagctgagaatatggctctgtattattgagtcaaaggtaccaaatgaagggacatcagtgt
gaacccagacacaaaatttcctgcagggaggagggaggaggctgggctgcagtgggcactcagcacacacaaaggcagggac
agttccaggggcaggtacaggtgcaggtgaaggcaaaggtctactttccttccagatctgtggattcctctgcatccaacagt
tcgcctgggcctctgtctttatggatctgcgcctaccactgatgtctctgggttagtaaagtttgctactataggaggaaaca
ttgtcatttgtcagaaaggcgaataatggagaacaaaagatattgagtgtgagtggatatgagtgaaaaaacagtgattatgt
gtggcaggttctgaccaaaatgtctctgtgtttgtaagtgtctagtgtgaggtgcaggtggtggagtgtaggggagaggcaag
aggcagaaaagcgcgcaggaggccgggtgaggctgtagacattgtcagctcactatgccaatctcacacagtgctggagaag
gtgggagtctgatggagcttcccaacaaccctgtggtctaagtcaagtccattaaggccgctggttcctcctggaacatagct
gtccatcaggaatccccatgtgcccagcagcagccacgcgttagcatcttcactgtgcacagtcattgtttgggaggagctc
caggatgggtctctttgtcaaaaaccgggtgatggtgtcagagagctgtgccgggtgcctggtccaggggctccctgacgttg
gaggtataggaggtgcgttctcagggtgggaacaccttttatggaaatgtacagaagaaaacatgattttcttggtcctctc
agatgacatggagaagaaagcgcgcagcttgcaaacaattgtaatgtccttgtaatttcctactttatcccaagttcattgat
tcttgtaaaccttggtttctgtccaagtacagagatattgattagagtgagtttggttctttccacacactaaccctcacctc
cccagataaagagcacattgtccttactctgagtctgagggaggagctgttcctgtacaactaagggcctgcagagaccccc
atgtacagctttgcagagtcagatctttccacatgtgaggcgacctccacggcccatgattgctgctcaggtctaattgtgga
ttcaggattaggacatccttaggctatcacaggtcaatcagattctgaaaaatcactgttatcatagacagaggtaataatt
caataccactccccctgacagcagattctctttcttatttggttgaaagtttgaagaaaataagtgaccattattattctta
ttctaactttagtatccactatttgttctaggggattcacaaatttcaaaacactgagtctttcattctcatgaaaatgtgca
tatttgtgaatttcaacgtgttgttcagaacctgtgcatgccgacatctgtatttctcgtgcgttcttggcctggcgaagccc
tcacagaccctctccctcatctgtgctgtctctgcttctccatcacaaccagtgcttcctgctggagctggatccctcagctc
cccagggaagggactggagtgaatcaggtgcacaggtcatgagggagaacacaacgcaacccacgcctcaagagtccagtcac
catctctcagatccacatccaaaacacagtttcttctacagctgagctacctgagcaacgagtacaaccatgaatttttaca
caaaagatacagcaaggggaagtcattgtgagcccagaaacaaacctccctgcagggaagctcaggaactgcgggaggccctc
gggacaccaggggcgctcaggacacacatcaaggcaggtgcaagaggaaaaggtgctggagatggggtttggcatcatcatc
atatttcactgacacccgccactgtgtttattctcatgtacgtgattctttgtattattagaaaatggcgtttatgtaaataa
ataaccatatgtaggtgcatcaagtcgtcctctccttttttttttttttttttttttggagtcctgctctgtcacccaggtt
ggagtcagtggcgcgatctcggttcactccaacctccgcctcccgagttcaagcgattctcctgactcagcctcccgagtag
ctggaattacaggtgtgcaccaccgcgcccggctaagttttgtattttttagtagagaccggttcgccatattgccaggct
ggcctcaaactcatgatctcaggttgatccgcccaggcctcccacagtgctgggattacaggtgtgagccaccgcgcccg
gcccgtcctctccatcttatgtggaacttttccattaagactctgagtccctggatttatttgagaacctcataaatcatggt
caattatgtctctttctcctctttctcccttcttcactcctctctagctcacaaactgaaacacacacagaatttttctaactt
caattacctgatgtgttgaagacaattgattaaagcgcagcttttccagttcagccactgttcatattgttgtaagaataaga
acgttgtgtttctcagctgcgtgcttctctaagatgagtagcagcttttttaaataatacccagaggctgaaagcaatctgaa
```

```
taccaatcatcagcttaatcagtaaacacaaggtggtaaattcgctcactggaaaaacaccgattgttacaatcaggtaaggc
tggatactctcaacagcaagtgtaaattcacaagtatatatgctgattaaaataagacaaacaaatacaagtacatacatact
gttccacttttacaaattctataaaatgaatgctaatctaaagttacataaagaaaaccagtagctgactctggacctggtgt
gaggagggaagggttaggaaccagaaattgtaggaaatgaagaagaaatgctgaaggtagtggagttttttctatgttgatga
aggtaatagttatgtcactattaatcaaatcgtacacattatgggatgcctattatttgtgaatttcacctattaaaatatt
acaagttaaaacaagtataattttgtagaaaattagttagacatagatgaataaaatgtatgataaataaaaaaagaaaatca
cagaacaatagcataaggacttcactcatcaaactgaagaaattttaaattctcaacacagaattaaagatttaattagata
tacataagaaatcaaagactcctggatatacacacaaataaaccctaagtccacctgtatttttagggaaacgctagaataca
agaaaataatgtcatgatttcattacataacgggggttaatgaaaccacatcaggcatgtccagctgtgtcctggggctggtt
cagggaacgggtgtgtcctgtggttaggagacgtggcaacaagctcacagcatcagttctagctgacaccataaaaaggccaa
gagatcacaattaaaatgtcatgcggatgtcacatctgtgggtgcggcacactccccatgtgaatacggaaaggttaactac
actcttcaggtgtctgctgagagtagagctgtctctcaggaatgtccaaaatggctcaatagagcaagaaaggagactggctc
agggttcctgtagtgccttggtggtgtgggcagagtgagggttctcactcaagaaaggagtttgtggcgtttgaacatctaca
tggcttcaaatagggtaactcctgtgattcctaactagattcacctcgtgtgggaaagaaaggagatgatgaaggaatgagcc
ttaagttatcagcagtcagacatcaaaacaatagtctgatgacttattctatgtagcacctataaaaatcgttccgggcgcgg
tggcccaaacctgtcatcccagcctttgggaggctgaggcgggcggtggatcatgaggtcaggagttcaagaccagcctgaccaa
tatggtgaaacccgtctctactaaaaatatttaagaaaaaaaatagttgggttatggtggtgggcgcctgtaatcccagcta
ctcaggaggctgaggcaggagaatagcttgatcccaggggcgtaggttgtagtgagctgagatcacaccactgcactgcagc
ctgggtgacagagcaagactccgtctcaaaaaaaaaaaaagagtaaaaaaatatcagcccaagatgggtggacaacaaccagg
cctacaaaaaggagaagactccttataagaataagcaaatcataatgaaaattaggaggaaaacaaggagagtgaggtgaaa
ggcatggggcaggggattagacaagggtcctgttccaatgtcttgtgtggagacttttcactatctaaaatcatccacctatt
ctgaatgtcttaggtgaactgtctgctccaaaacatcagaaccaccagaggattttgaggatactcagtttaatatcttata
tttgaggtgccttacaactgtgtaaaatgcttagttattatcagtgtaattagagatagggcctcactgtgtcacacaggttg
gggttcagtggcacaatcatagctcactgttaccttgaacttctggcccacataatccttctgtctcagcctcctgagtagca
tggactagagaggtgcaccaccacacacagctgatttaaaaaaaattgtttcatagaaatgggtctctctatgttgcccagg
ctggtcttgaactcctggtctcacgtgattcccctggttttgtttctcaaagtggtggaattaaaggcatgagccaccgtat
ctgctcagaaatgattattttgttgcaaaatactaacccaagaattgactccctgaattttctctgcagcattttggttaata
gtgtctgataagatttatttcaatagtttcaacagcagagtgttctcctgatgtttcctccaatagtgataattcatggttg
aagatcacaaactactattaaaagatgacataaaaaggcaaccttaaacttttggtgatggagtgagtataataaaaaattac
tttcaatattgtgtaacacacgcctgcagtaggaggaaggtgagcaatgagggtaaaatttctaaacgtatgaatcttccagc
tccccagtcatagggcagtaactgatgagtcctgagagagggaacgtaatgccgtagtgcttgtgggataactcttggccaag
agagtttccatatttattaaagtggttataattttttaaatttaaagatgccatttttcaacatatccagaatattgtgagc
gggattgattctgtatgatacgagcaatggcgatgccttctgtttggataatattacaaaccaggttaagactgagtggtgta
acgatgcaccagaacattattctagcttccatactagattttgttttctcttttgtttgcattagtttcaaatttatatgtaa
ggtctctagaatgtaggagtttatttgaaagtgtcttttcttgttggccatttttgatggggcttccaggagatttaaaaacct
cctctgcctgcagcacagtttaaaattctgcgttacagtagaacatctgtatttaatcctggtctttggttgattgacaagct
ctaatacatgcaataacttctgccttctgggctggttttacatcaggtagaggaatatatactaagtgaaaatttgcactagt
aatatatattattaaccaccacttgtattatttaagtgttattaatcaagaattaatgttaaatcaagggtctcaatggc
aatattacctaagggatatacaagatatttgctaatctaggtaaaatagatgtgaacacactcttagtatccagccatgtct
cctgtctatcacattattaaccacacagtaaattcacttgggacttgttctaattatctaattagtcacttacttatctcaaa
gcctctggattatatgtgtgactattttagcagagagtgaagaaagacaacccaggctgaccaaacaatgaggaaaatcaca
acctgatgaaaccagaaacctggatgtgagtggctccaggattgaataaatttgacagctcatgtgcccaggctgtttcttgtc
tcagttttccacactgatacatccagaaaggcagcttcacccccagaggactccatcatgctgtgacatggtgacaacatt
cccaaagctcacacacatatgttaaatattggctgaaaaggggcagagacatttctggaattctcttctgaaggaccatgaa
tgcctcaaccaaccatctcccctgcctccatgactagaaatgcaccacgtgcccacacggatattcatccctcatggggataa
gactccattgatgaggctgactattttatcatataaaattactaaagactgatttaagggtttcaaaaactaattgaactctg
ttgttctatgtccaccagagattacaaatcttccaatgatgccttcttgtttttttgtctgcttgactttgtctcttcaactt
gttctgtaccccagagaatctctttcagctccctcaggtgcattcaattgttttatttaactgacaatttctaaatcagttaa
agacattacgctaaagactccatatgtccatattcctttttccatattcctaggaaggcattgtgacccagagtctg
ggcatgacccttgtgagtgttcctgaccctcctccatatgaggatgctggtgctcttgccccttccctggggtagagt
cctcctgttttccccaggtgctccctccacagctctagtgttctcaatcagtgtcatcaccttccagatcttctgccctgcc
ctgcagactaaggctctgattccataagcaagatagggagctgctcctcaatagatctttggtgaggatctctgttcccatc
tcaattcctgtagggtgaaccagtgttcctaggattctggtttcagtagcttgtccctgcagagtaaattcttagttctgta
ggggattaagggagttgggtctgaatacatttagatgtcgaggatcttgttctctcccagaaagacacttcgggaaagtaa
gactttggtaactgtcccctttcttggggaagggattcaagaggataggttgcttttgggcatgtggtcccttaaaatttca
cactaaaaagcgtttcccacactcaatttcaagcagcccaatatatatttgtattttttcttggaacagacaatatttatat
tccagactctgccttaggtaatttcaaacctggctttgttactctctacaagaaattgcttctccataagcttcagatttgt
tgtgtgttttgaaattttatcagaaatattaaagaaaattggcaaaattccatcctccatgtttatctgttattgttgatgca
gttgtaaaaaataagaaaaatatattcctttttctgtacatttccaagcttagtagcaaatttttagtaacaccagaataa
taaaaaattcaaatattgtttagctgcttaataggaaaacaaattatagtaaatttgtttgctagaatgctacccagcattta
taataagtaaacatttgatataccccaactacaaggtaaaatatcccatttatgctaactaaaataagccaaacaaatgagaata
tatactgttatttcattttttataaattctgaaaaattaaaatgaatttgcagcaatgtaaagatcagtagttgccagggaaat
ggtagaagaaagaaaggaaaggagaaagaatacagaagaacaaaggaaatgttaagaattctcttgtccaacttgataagg
atgacggttacatcattttttatcaactgtaatctttaaatatgtgaaagtttattatctgtaaactaaacgttataaacttta
ttacaagcaaaaattgaaagttagacaagaaggagtgatagaaagagaaaatgtatattaaatttcagaaatatttaagaatg
tatctgcctgaacccctagttctcaccatatctttaggtgaatgctaaaatgcagcaaaatcacgcatgttctcactacagaaa
```

```
gtgggttctacaaaccacactcggcacatttagctttgtcctggagttggtgcagggagttattggggccagtgatgaggagc
acaggccaagataccagcgattacttatcccaaacatgagctctaacatacacacttagtcccttttccgtgtgtggtttact
tccacatctgtacatggagagaccactgactgacaaaatataatttatacaaatatgtaaaattaaataggggtgatcagttca
aggtgtttatcacagcataattttacaataagacagcatatttcccaaataccatcattgtcaccaaactccttcaaggcaca
gtcatcttatctgggcccgtcctctcctcaggtgtcccaccccagagcttggtatatagtaggagacatgcaaataaggccc
tccctctgctgataaaatgagcccagccctgaccctgcagctctgggagaggagcccagccgtgagattcccaggagtttc
cacttggtgatcagcactgaacacagaccaccaaccatggagtttgggcttagctgggttttccttgttgctattttaaaagg
taattcatggtgtactagagatactgagtgtgaggggacatgagtggtagaaacagtggatatgtgtggcagtttctgaccttt
ggtgtttctgtgtttgcaggtgtccaatgtgaagtgcagctggtggagtctggggaggcttggtacagccagggcggtccct
gagactctcctgtacagttctggattcaccttggtgattatgctatgagctggttccgccaggctccagggaaggggctgg
agtgggtaggttttattagaagcaaagcttatggtgggacaacagaatacgcgcgtctgtgaaaggcagattcaccatctca
agagatgattccaaagcatcgctatctgcaaatgaacagcctgaaaaccgaggacacagccgtgtattactgtactagaga
cacagtgaggggaggtcaatgtgagcccagacacaaacctccctgcaggggcgcacagagccaccagggggcgctagggaccg
cctgagtacgggacaggtcccaggagcaggtgcaggggggaggtttccttttttccttggctggaaaagtcacctttatcttccc
agggctcgagccttctaggctgtgatattttattacttgtatttactgttcattattatcattagtttttaaattttggtaa
ttttacaactctatggatatattttaagtgtatactttcaagaaataaacattcctaattatttgcactgattctcccaga
gttttattaacatttgttgacatcagcaactacatagctataggggacaaacactttaacgatagacattgttttaggcctga
aaccccgtttatactaaaaattttacaaaaattagcctggcgtggtgaagggcgcctgtaatcccagctactcgggaggctgag
caaggagaattgcttgaatccgggaagcggaagtcacagtgagtggagtggactgccactacactccagcctggcgacagagc
gagactttgtatgaaagaaagaaaagaaaaggaagaaaggaaggaaaggaaggaaggaaggaaggaaggaaggaaggaaggaag
gaaggaaggaaggaaaagagagaaagagagagggaaggaaggaaggaaggaaggaaggaaggaaggaaggaaggaaaagagaga
aagaaagagaggaaggaaggaaggaagaaaggaaggaaggaagaaaagaaggaaagaaagaaaaaagatatataaacacgc
agacctatgcatataaccatagggattttatattaaacattacaataaaataattctaaaaatgtgtcctaaggaatcaaacat
aatgatgaagtaaatataaatgttagagtaatttataattgatttgttattttaatcgtttacatgaatttatttctatttg
ttcatttaaaagtagtatattggtcatttcaagagagctaacagtaaatttcagatgttgttgttacgatatatgataagaat
ttgaggtggtgaatgataattatcttatttctcaattattcagttattccatattgtattcacaaatcataacattgcttct
taccttataaatataaaccataattttgtgaaattacaataattttctttattttaattttttaatttatcccagatcatt
atcttttttcttcgcttccagatctcactggatcatctcgaggccccatcctcaccctgtctcccgaagacttctggagagc
tgcaggacgggcagaaggaggagccccgtgtgagtccacacgacctggagcctccctctcttggattaggccatctcctcgg
gatcacagggctcttcattatccttacccgctgttgtaccaaacaagcaacatcacacttcaattcatcagggtttgcttta
attttctaaatcatcgtgaaggtgataatttttaacagtaacgtatcacaaccaaataggataagcccttttccatggaacagg
gtttcttatcaggatatacatgtattatggattctcaatttatttgtagatgagatgctattatctccatattgtagatgatt
ctgctaagtcatctcttaaaattaattttttccaaagactcaaacaaataaatgatataattacaaattttcaggtgtaatagct
gagccaacattgagattatattaacatttagaacatgaacttgcaaatattgttattttcctgtcggctgtccccaattgtga
ttttatacagaatattagaaatttatcctgataaatcaggttaaaatattatatcactagtttattaactttttataactaata
atataaaatgttccacatattttttagccatgttttacttacccgtgatatgtgtatttattaatttttcattttaagatgcc
accttttatctttcttatttctgggattttattctagtagatagagctgaatgcattttaataattatcataataatcacattt
acattttgcatttaattttcatatacattttattaatattttaatttcaatataaaatattttcctacaaatgtcaattttt
gattttttatgagataaaattaacctatacaaaatacatatattttcaatgtacagtttgagggtttctggcaaatgtgcacac
atttgtctccagcatctaagttatgatgaggagcaggtccatctccacaacaagtgtcctcttcggtgcttccagtcagctct
cacataaggaattttttttcaaatttaatatagatacagagggtaaatgtttggatttgtcacgggggattattgagtgatgc
tgaggtttggaatacagattcccaccgacctctccctcccactctcagcagtccacagtgtctatcattctcataattatgt
ccatgtgtgctcaatgctgaggtcttactaggagaatatgtggtattcagttttctgctcctacattaatttgtttaggatt
aagggcccagcttcttttcatttactgcaaaggacatgatttcattcttttttcatggctgtgtagtattatacattgtagat
gtaccgcattttgtatattcagtctaccaatgatgtgcatctggtttgatctatgtcgttgccactgtgaatagcacagcaat
gaacatagatgtggatgtgtcttttttggtagaattatttgcttactttttcagtgtatacccgtggtggggattgctgtgtaaa
atgatatctctgttttaagttctttgagaaatctccagtctgatttccaaagtggaaacaccaatttatattcccctcatcag
tgtatgtgttctcttttctccacagtcccagcagcatccattgtttttttgacttttagtgataaccattctgagtggtgcgt
ggctgcacacctacagtcatctcatctttgataaggctgatgaaaacaagcaatgaggaagggactccctgttcaataaatgg
tgctgggacaactggctaggcatatgatgaagattgaagctgatctacttccaacatgtataaaattaacacaaaattca
ttaaagttttaaatgtaagacctcaaaccataaaaatccttgaagacaacctaggaaatactcttcttgacatcaggtttgac
aaaaaaatgttggctgagtatccaaaaccaattgcaacaaaagaaaaatagacaagtggggcctaattaactgaggagctcc
tgctcagcaaaacaaacaaagaagcaaacaaaactaacagcacagtactcagacaacctacagaatgtggaagatattcaca
aacgttccatccaacaaagccgtaatatccagaatctataggggaatttaaacaaatcaagaagcaaaaataataataataat
aacccccattaaaaatgggctgatatggtttgctgtgtccccacccaaatatcaacttgaattgtatctcccagaattcccatg
tgttgtgagacggacccaggggggaggtaattgaaccatggggggcctgtctttcccgtgctattctcttggtagtgaataagtc
tcaccagatctaatgagacttatcaggggtttatctgatgggtttatcaggggtttccgcttttgcttcttcctcttttctc
ttgccatcaccaggtaaggagtgccttttacctgccaccgtgttttggaggccttcacagccatgtggaactgtaattccaat
taaacctcttttttgttcccagtttttgggtgtgtcttgttagcagtttgaaaatggactaatgcgtgggcaaatgacacagac
acttctcaaaggaatacatacaagtgaccagcaaatatattttaaaatgtttaacatcactaatcatcagagaaatgtaaat
agaaaaatgttctgatttctgtcactataggtccatttcttgttttgaatttcatatacatggaatacatacatggaataatattatagctca
tttttgtaagaagcttttactatctgtgaggttcattcatgtgatagcatctatcaaggttttgtcaacatatgtatataaatat
gtatgtactcatacacatatagatatttcatatctgaatcagtccattgcattaaataaatgacagattattaaatcaatcagt
tcattaagtgaataagtgacaatatgtatatctattttcctgttgatggaatttaaattgtttccaatataaatatcataaa
caaaactgtcatacatatctttgtacaagttcttctgtttatattcacatatttttattgataaaatatgttgaaatataagt
atgcattatacctttcagctttatggagctatcactgacaaataaaattttctgtatttaaggtacaccaattgatgtattg
```

FIG. 7 (Cont. 7)

```
atattcttggggaaatgctcataatgatcaaggtaattggcatgcctatcatctcagagagttaacattttatgcctttaatt
tattgtgtatgtgtgatgaaatcacctaatatctacttgtctggcaaaagatatgtttataatgcaacattcattagtatagt
cacattgctgtaggtttgatctccagaactatttcaacctgtgtattagtccattctcaccctaatgtaaggaactacctgag
actgggaaatttatggagaaaagtggtttagttgactcacagttctgcaggcttaacagcaagtattactaggaggtatcagg
aaacttacagtcatcacagaaagtgaaggggaagcaaggaccgcttcacatgctggcaggagagagagaaagagcaagggag
atgcaccacccttttaaaccttgagatcttgtgagaactctgtcacaagaacagcaaaagggaagaccgccgcatgatccaa
tcactcccatcagacacctgctacaacacttggggattaaaatttgacatgagatgtgggtgaaaacacagagccaaaccat
atcattccacccatggtctatcagaaatctcatgtccttctcacattgcaaaatatcattatgccttctcaacagtcttccag
gcttaactcatttcagcattatcacaaaaatctatagtctaaagtcacctctgagacaaggtaaatttcttcccctataaac
ctgtaaaattaaaagaagttagttatttccaagacacaatggagatgcatgtactgggtaaatgctcccattccaaatgggt
gtcattggccacagaaaaggggctacaggccccatgcaagtccaaacaccagtagggcagccattaaatgttaaagctacagc
ataatttccttttaccccaagtctcacatccaggacacactgatacaaggggtgggctcccaaggccttaggaagctccaccc
tgtggctcaacgtggtacagtccccatgactgctttgataagctggcattgagtttctatggctttacaggcacaccatgcaa
gctgttggtggatctaccattccggggtctggaggaaggtgccctcttctcacagatccactaggcatctagtgcctagtgc
ccagtgggtactctgtgtgggagatccaacaccacatttttccttccacactggcctagtagaggtactccattagggctcagc
cctgcataagactctgcctgaataccagacattttcatacgtcatctgaaatctaaggaggaagctcccaaacctcaactct
tgccttatgtgcaccccgcagactcaacaccacgtggaagcaaccaaagcttagggcttgcaccctctgaagcaatggcctgag
ctggaccttggcccctttagccatggctggcaggagagggacagggatgtccaaggctgcacagagcagtcgggtcctgggc
ccggaccatgaaaccattttttctctactgggcttctgggcctgtgacgggagggaccgcagcaaagatctctgaaatgctctc
aagatgtttttcccatcgggttcctcattacttatgcaaatttctgcagcccgcttgaattcttcccaggaaatggattctt
cttgtctaccacatggtcaggctgcaattttttcaaccttttatgatctgcttccctttaaacataagttcaaatttcaga
ccatctcttaatgaatgcatatgacttacattttcagaaacagccagggcaaacattgaatgctttgctacttagaaatttt
tctgctagataccttaagtcatctctccctagttcaacattgcacagatctctagggcaggggcaaaatgccactagtccttt
tgctaaagcatagcaagtgtgagctttactccagttcacaagaagttcttcatcttagcatctgagaccacctcagcctggac
tttattgtccatatcactatctgcatttgttcaaaaccattcagtaagcctctagaaagtttcaaacttttccacagcttcc
tgtcttcttgtgagccctccaagctttaccagcctctgtccattacccagttacaaagtcacttccacagttttaggtatctt
aatagcagtgccactcctagtgcaaattttctgtattagttgattctcacactgctgtaaagaactacctgagactgggtaa
tttatgaagaaaagagtttagtagactcacagttcttcaggctaaacaggaagcattactggggaggcatcaggacacacaatg
atggccgaaggtgaaggggattcaaaaatcttctttgcaagatggcaggagagagacagcaagggagacgggaggtgccacac
ttttaaaccatcagatctcttgagaactttatcaggagaacagcaaagaggaaggccacccattacccaatcactttatatt
aggcccttccttcaacatgtagggattacaatttggcatgagatttgagtgggaacacagagccaaactgtatcaacctgcat
aactgaaagttataacctctgaccaacatcacccaatttttcctcctcccagcccctgggaactactattctactttgcttc
caagaacatgaatattttagattctacatataaatgtgttcatgcaacatttgactctctgtgtctcactccacttagcaaag
tgtcctctatgtgttgtaaatgttagaatttcctcgttttttaaaggcagaataatattcacttttaggtaggaataagccaca
ttttatctgttgattcatagatggacattgacctatttctatatctaggctattatgaataatctcacaataaacatatatt
tgtcacactcactttattttctctagatgtatactcagaagtgggtatattctatgttcaattcattgagtaatcttcatgct
gttttttcataatggctgtactaatttgcattttgttccaaaccatacatggataaactttgtaccacatattcaggtctttgt
ttaagtcttaaatccattttagctgatttatatgtattgtgtgagataaggtcaattttttttcttccgcatatggatgccc
agttttcacagcacttgttgaagagactgtttcttctctattgtgtgttcttggcagttcatcaaagatcagtttattgggaa
gaaattggtggacttccagattgtctgtaatgttctgttggattctatgtctgtttaaatgtcagcattatactgttttgatt
tacatagatttgattttgaaattatagaatatgatatattcagttatatttacccaaaattattttggctatttaaagcttt
tgtattttttacataaattggagaactttttaatatttttgtaaaaccatgccatggagattatatatttatttttataggcata
taatagatatacctaatttatgggaacatgtaatatattgatgcatttataaacgtgtaaagatcagatcaggattggtatat
ctatcacattaaacgtgtatattttcttatgctaggcacatttgaacgactctcttctggccatttaacgtatacattaga
ttatcgttaactatagtcaccttactcatctgtcaaacatttaggttgtatttctcctatataactgtatatctgtcttcagt
aatcatcttctctttatctcttctctcttgtatccaaccaggcttctggtaaacaacaatctactctctgtcttcaggaaat
ccaatgttttagttgtgacataaaagtaagaagatgcaatatttgtcttctgtgtttggtttattaacttaacattatggc
ttccacttccattcatattgttgcaaatgacaagatatcaacattatggctgaataatattctattgcctacatcgattata
tttttatatccatttctccacctacagacactgaggttgctttcatatctgggctattgtgaatagagctgaaagaacttgga
gtgcacatgcctttatgaggcagtgattttatcttcttttagaacatactcagaataggattttgctgagtcatcagttatttct
attttttctttttattttggagtcttcatacaactttgcacaatagtggaaatacaaacggaaaaaccattataaaaagcagttt
cagttttgaggtatgatccaaaaacacacaacatttcatcatgattctcattgggagtctctaatgaatctggtggaaaggca
ggaagttttctaaccttgttaagaaaattatgagtttgcaccttttcttttgaggctggaaattggcatgattcaagatgc
gtaatgttagcaggtttcagaatgatacagcgaaaatcataatgagaaggcaagagagagaataagagaaagacaggaaaaca
aagaaacaaataaatttcacaagagaagaaactgctggatgtcagtgttgggttttgttcctagacatatctgtactgagtga
gaaaccatgaagccaagggaagagtctagaacttgttcaagtgaagcatcagcatatttctccaaggcacctattgtcacccc
atcacaagggtgatgagttttgaataccattaaatatgagttcctagtaagtaatcatgtttccatgaaattcagttaaaat
gcaaagggtgtgtccagatcactcacgcacaaaaatacaaaatttgcctttgcatttatggctgcatagaggtaaagtccatt
gagacttcagcaggttacagagatctgttaagttttggattcccataggagagtgcctcttagtgaaggttggactattaatt
aagtatgtacaaattccctctatgggagtagtgttccatttgtgtggaatttttaattccttattgaattgcaaaacaaatcc
caaggactgactctctgtgagttttactgtagtgttcataaaaatatttaataagattccttccagtgttccagttcaaggaaagttt
tctctaaaattttttctaatacataaattttcctgcctaaaatttgaaacaggctgttgttaaaaagacatactggaatggcag
ctttaatctattggtgataggaatgagcattaatacatgaatctctttgagtgttctgcctcatccaaatactgtatgcaaag
gctagtactgaggtaaaatctctaaatgtatttgttccagccatcaagtcatggggcaataacagatacatccttgaggcag
aggaccataatgccacagtgctagtaggagtacatgtcgccaagggagttcaagggttccttaaaattgtgataatttaatg
taagaacaccttattagagacagggtttcagcatgttgaccaggcttggtctagaactcttgacctcttgatctgcccgcctt
```

FIG. 7 (Cont. 8)

```
ggcctcccaaactgctgatattacaggagtgagtcactgtgtctagccagtccatttatttttcttctgcacatggatacccat
aaacttatgtggaagattgtgggaggttataacagtgtcatactttagtatcagccatacctcacagaatcattttataatag
ttcctttcatgggtgtacttcactcagttcatgcaaaacctggcaggtgacaggctaaaaacacaaaataccgaagcgtttaa
ccaactgaaagggctgtagccttttgtcaatgaattatttcaagacacggagaacacatatagattataaataaaatactttc
acatcccttaaaggtggaaattgaggaaattttacctaaatgtgtccaaaggcgcctgtggcttggtttctgtctaggtccc
aatgatagggttctcccaggattttgtggctgtcttgttacacttcatcaagaattaacctctgctgtttcctcaaagtgttt
aattggataatgaatttgtctataaattgaagagttgaaatacatcaaatattaatttgtaataatctggcacaaattatcta
agcaaattcataactagatgttttttcattttatttttatttaaaatcaggatctaagcactgatatgctttaataacatctg
tgaccctctcagcagttttctcttctgagtatatgatctgctgtggcagttttcttagcttcaatgttacctcttttggcaat
gactaccgtctttatatttgccaggaatctgggataaaggagtgcttctaagagttccctaacttgcccatttggtgggtgt
tccagaacatatgagatgctctgttgttaacaaagcatcccaaagccatgcactgccctaaaatgtgtttgtttcctagtttg
acaaattggaagttctaataaatacaatcacttctgccatctgggctgattttacatcagatagagggctgtattccaaagaa
aagcttacattagtaatagcaattctagtcagaaacctagagttttatcattgaggtgcaattcataacaaataatattaggt
cgaggttctcagtggcagtgtctaaatctcttaggtgtacaggctcttcctgttaacatgaagcatttataagcacagtcat
agtttccagctatgcttctccctgtctcattatccaccaaaactatggcctccacctggaacttggttaatttccaaataagt
aatttttttagtgttttatgcctctagattattatgtgagaaagttaacattcagtagaaagttaaaaagaacatttgaactgac
taaacaacacagacaatcaagaataaaattcaaagcctagatgtgagaggctccaggcctggataatgcaatagttcatgtat
gcaggcagtttctttgcccagttctacactgatacacccagaatgtcagcttcatgccagatttgactcctattatgtagaga
catggcaatacattctcaagggtcacatgaaataatatgaaaattggtgggaataggggaggagacaactctgcaattctcat
ctgaaggaccaggaaagcctggacagaccatctccccagcctcgtgactgcaccacgtgcccacatggacactcatcctga
tagggtaagaagactccattgatgggctgagcattttatgatagaaattactagagactgacgtggaggtttcaacaactaa
tatttataaccaaatttaattaccccacattgttaccattttcttcagtgaaaaattgcttgccatgattaagttttaagt
agatttccaatgttcacaactgagcttccaagagagtcttgagaacaaaaacaatgagggcagagaaatctacctttctgta
ttcaccactaaactcaagtggactcagcactgcctttgatcactgctacttctctgcagagttcaggtttctacttctcacaa
ttctgacacacattctacctctcctcaaatgtttggcctctgcttcttgtaaggtcaccctctgttcttaacttcttctctga
gtcatttttgtgaggtggtcatgagccattaaatggatattttatattttcccaacatgaatcacatgagtggtcatgaattat
acttctgattatggcagttgattttttcttggcatgttcatgactagtaatattttgaagccattcattcaaatcttcgggct
tcgttttttgttgctatgacattttttcttctattgagtctttccactagtattataacatgacctagtatccaggctcagttg
tcattaataataaccacatatgtcaaaaatcatgcattctttttcacagcagacataatttcctcttttctgcagatgaagaca
cactgctgagctaccccacttacaagaatatatgcacaattatgatatcttcatttatttgactaataagctatatcattct
cccttcaaattctttaccccccagaagtcctggacaaatttctgcatctgctcaaacgataaactcagaactacatggtgagt
aaaagtcacctggttctggatattgggtccatctcttccctccaatgtcccagagcacctcagcacacctgtccaggttcta
tcaagaaagagtagctcctgcacactgaaggaaacaattgagttaagagaggacctgcagatgatagacaatattgaaaacta
ttaatatgacaaaggattactaccaagcatgtgaaataagctcaacgggtgcggtggttcatgtctgtagtaccagcaatttg
ggaggcaagttgcgcagatcacctgaggttaggagctcgacaccagcctgaccaacataaagaacaccctgtctctactaaaa
gtacaaaattagccgggcatggtggcatgcgcctgtaatcccagctactcgggaggctgaggcaggagcatcacttgaacctg
ggaagtggaggttgcggtgagctgagatggcaccattgcactccagcctgggcaacaagagggaaactccatctcaaaaaaaa
aattacaaaaaattagctgagcgtggtggtgggcgcctgtataccagctgctagggagctgaggcaggagaatggcttgaa
cccaggaggtgaaggttgcagtgagctgagattgcgccattgcactccatcctgggcaacaagagtgaaactccatctcaaaa
aaaaaaaagagacttgcaaaggcaaatagatcatagacagacagatagatagatagacctattagtatacatacatacata
tatatacactaatattcaggaaaatgcaaattcataatgagatgtcttttcacccttcatctctgctagaaagtttgttatct
gaaaaacaaatacatacatacatacttattaaaagctggccaggatgcctagaaagtaaaactcatagaccactggtggaaat
gtaaattagtgcagccatcaagggaaaaaaatagaactaccatatattccagcaatccaactgctaagtatatatctatttaa
atatttaaaagaaaaaactaatattgaagagatacctgtacacccatgtttattgcagcactaatcacaatttctaagatatg
aaatcaacatatgtgtccatcaacagatgaatggatacataaaatgtgatatatttacacaatggaatattattcagccttaa
caatgaaattctgccgtttgaagcaacatggatggaatgggacaccactatgttgagtgaaatgagtcagacacagaaaaata
aataccgcatttctcagcgttacttctagaagtaaatagtagagtagtggtgatgagatgccaggaatgagagaaggctgaga
taagaagaggtttgttaacaaacacacaattacaggtagacaggagggatgtgctctagtgttctacagcacagtagggtgac
tacagttaacaatatattgtacgttttctgtttacaagaagccagaagagagaattttctatgctaccaacacaaataaatgt
tagtgtctgaactgacgaatttgctcattgttctgattttggtcatacaagtgtgcacatgtattcaaatatcacactgta
tcccataaacataagcagttattatgtgccaaatttgaaaaatcctttaattaaaaagaattatattggcgtacattacaaat
gattcaacacagagacaggaataaataccattttttctttgaaatagttaattaactaacaatgtagttacattcatttgcacc
aaatcgtgtatttgataatggtatgcatagacagatttatgcataggataatatcttttaattttagactactacttaatact
ataaatataaataattttaaaacaactaagtaaaagaataaagctgagaaaatgtgtgtgtggtgtgtgatgtgtgagcttt
ttcttgtgcaccactgtgtccttggtggatgtgtggttcatgtgtttgtttttatttactctgtttggggttctctttgcttc
taggatctgtagttcagtttctttcacaaaattgggaacattcttcgctattatcttttcaaatagtttctgtgtatttata
atttctccttctcagatttaaaatatacacatactataattttgatattaatgtttagtttctttcttcactctcttttcgtt
tgcaatttactttgtgaaatttctagtgacatactaatcacatggtttattgaaaagctgagccagctctactgaggtgtgt
gccaaaagattgctcgatgtttatacagcattgcttttgatttcttatgcattccatttgatttattcttagtatttcata
tttcagttccctatctatgtccacgatttctttaagagattcttgcgtgtgaattatagttactttacatatcttgtttaatt
agatatttataatatctgtttctactacaaatctcatgctgatcatttgtttattacaactttgttgtacttctcattaatgtat
gtaataattgttgatagccacagatactgggatggtgacgtggatactggccttatttttcattttatgcatttctgcctgta
tttgaccacactttaccttgccaggcctttactgtggaagtatctgtgaatcttctcagaactatatttgacattcactttt
gcagtggacatcaaagttgaagtctgttcttctgtgtccaccagagacttcagttcctccagtgataccttgtttttctttcc
tgcttggctttgtctcttcacctgttccctcctccagagaatcatgttcagctccctcaggtggattaaaatgttatttaact
gacaattgtgaaattggtggaaagcaatagaataaagggagattttctgacctttcttgggttcatattgtgaacatgagtct
```

FIG. 7 (Cont. 9)

```
gggtgtgaccttcccaatgtttctgaacttcctccagatgagatgttggtctgtgtgttcttgctcttttccctgctgtggag
tcctcttgttttccccagttgttccctcccgcagctccaatgttctcttttgtgttatcaccttacagatttgctgactaga
actgcagattaaggctctgattaaataagaaggaggggagatacttctcaatggaacttaggtgaagacctcttttcccatct
cagttcctaaggattgcccagtgccctaagatactggttggtggcttgcccctccagaataattcttgttctccagtggg
gatatggaagtgggtctgaacacttttcagaaggtgggcactttttctctcctagacagacacaatgggacagaacaattt
tggtgactgtccccattttgggaaaaaggattcaataggataggaaaactcttcagtctgtggtcccttagaaattcaccct
acaacacatttaccacacttgacttcaagaaatccaatatatatgtgtgttttcatcttgtaatagcctacattttacatgcc
atactctgcctcagttcagctcataccccagctttgttactctttacaagaacttgcctctccctagatttcacatttgctgt
ttatcttaaaacttcaagtatctaaagtattatttttaaaaaatggccagttgtggtggctcacacctgtaatcccaacgctt
tgggaggctgaggtatgtggatcacctgaggtcaggagtttgagaccacctggccaacatggtaaaacctgtctctactaaa
aatacaaaaaaaaaaatagcttgggcatggtggcaggcacctgtaatcccagctactcgggaggctgatactggagaatagc
ttgaacccacgaggcagagtttgcaagtcgtaccattgcactccagcctgggcgacagagtgagactctgtctcaaaaaaaaa
aattccaaaattccagctcctctgtttatctattttgttgatactgttgttgtaaaacataagtaaatatattattcatct
atgtacatttccaagctgtgtagaagaatttttaataagaccagagtaaaaaaagaatgcaaatatgtaggggccagccta
cagggtctgtggatctttctccccatgtgcagagatgagagatcatagaaataaaggcacaagacaaagagatagaagaaaa
acagccgggccagggaccactaccaccaagacacagactagaagtggccccaaatgcctggctctgctgttattattgga
tacaaggcaaaaggggaagggtaaggagtgtgagtcatctgcaatgattgataaggtcatgtgggtcacgtgtccaccagaca
gagggcacttccctgtttggcagccgaggcggagagagagagaggacagcttaggtcattatttcttccattctcttctcaga
aagatcaaagactttaatactttcactaattctgctactgctatctagagggcggagcaggtgtacagagtggaacatgaaag
tgaaacaggagtgtgaccgctgaagcacagcatcacagagagacgtttaggcctctgagggctgcgggcaggtttgactgat
gtcaggccttccacaagaggtggtggagcagagtcttctctaactcccccggggaaagggagactccctttccaggtcttcta
agtaatgggtgccttccaggcactgcgctaccactagactgaggagccctctagtggcctgtccggggcgtgacagaggct
cacactcctgtcttctggtcacttctcaccgtgtcccttcagctcctattgctgtatggcctggttttcctaggttataatt
gtagagcaaggattattataatgttggaataaagagtaatgctacagactgatgattaatgatattcatatataaacatatct
ataacctattactagtacaactattcttatttacatattctcttcattacactagaacagcttgtgccctcagtctcttgcc
tcagcacctgggtggcttgccgcccagacaaatattgttaagcttcttaatagaaaaacaaattatggtaaatgtgttcactg
gaatactacccgtcatttataataaattaatgcctgatacacagagcaacaaggtaaaatatctaagtatttatgttgagtga
aataagctaaacaaataagaatatatactatgtaatttcattttttataaattctgataaataaaaatgcatctgaagtaaaat
aatgaagataagtagttgcctgggaaatggtagaagaagggaggggagaggaggaggaatacagcagaacaaggggcaaat
gttgagaagaattcacttgtccactttcttgataatgatagcagttacatcattttattagttgtacatttaaatatgtga
agtttatcatctttcaattaagcctcataaaatgtcttacaagcaaacaatggaaacttagacaaggaaagagtaatagaaa
gatagaaaaataagttcaatgtcagaagtacctgaaaattaatgtgcctggatcctagttctctccatattttcagaagagt
gctggagggcagcaaaaccacacatgctcttattacggaaagtgggttctgataaaaacactagacacatccagctttgtcct
ggagttggtttaggggggatgtcagagacagtgatgaagagcacagggccagataccggggttcactcatcccagacatgagct
cctagatgcatacagagccccccatgtgtgggtttacttccacttctgtaaatggagaaaatattgtctcctacagaacata
gtttacatgaatatttaaaatgaaataggggtgattagtgcaaagtgtttatcacagcacaatttcataataagacagcatatt
ttccaaatgcaatcattgccagcaaacttctacagggcaccgtcgtcttatctgggtacagcctactcctcaagggtcccacc
ctagagcttgctatataggagatatgcaaataggggccctcctctactgatgaaaaccaaccccaaccctgaccctgcagc
tctcagagaggtgccttagcccctggattccaaggcattcccacttggtgatcagcactgaacacagaggactcaccatggagt
tggggctgtgctgggttttccttgttgctattttagaaggtgattcatggaaaactagagagatttagtgtgtgtggatatga
gtgagagaaacagtggatatgtgtggcagtttctgaccttggtgtctctttgtttgcaggtgtccagtgt{aggtgcagtgg
tggagtctggggaggcttggtacagcctggggtccctgagactctcctgtgcagcctctggattcaccttcagtagctat
accatgaactgggtccgccaggctccaggaaggggctggagtgggtttcatacattagtagtagtagtaccatatacta
cgcagactctgtgaagggccgattcaccatctccagagacaatgccaagaactcactgtatctgcaaatgaacagcgagag
actgaggacacggctgtgtattactgtgcgagaga}cacagtgaggggaggtcagtgtgagcccagacacaaacctccctgcagg
ggtccgcaggaccaccagggggcgacaggacactgagcacagggctgtctccagggcaggtgcaggtgctgctgagggctggc
ttcctgtcatggctggggcggcctcattgtcaaatttccccagggaacttctccagatttacaatcctgtactaatatttga
tgtctctaaatgcaacctttttttttccttttgtgtctgtttttttttttaaaaacaggaggacacatcctcacctccaca
gaagccacagtgtcactttgggggcagaaataatccttcgtggtcaacagggtgagagttttgaggaatcccagggaaacct
gggaatgttttccaattagactcagggcagagacctccatggaatctctgattagaacaggcttttgagttctgatggggag
caaaagagaggctcaccccagggtcagggttcttaaaacctgatggttttcacagcaatccccttcatcttgtgaaactgggc
acatctgactcagactgattcagttgaccctctttctgctaatccattttccttcccagtagacttgattctcacagatccct
ttcttcttctctttcctgaaaacagaggatgtgttttctgtagtctaaattccaaggctcaggtctgcaggagctgggtaggc
tgaggggtcttcctcactcactattgcctggaaaatcctgctgtcttctgtgcatggaggcatttggaaaatgaagcaggcat
tagtcatgaagggaataatactagttttctccaatgggatgttgatgtagagctgatcttatgcttctcacactgtcacaaag
tttggactctcacctgtgactttgaggagagcttgtgataccttatcttgttttaatatgaatagactctcccttagctcagg
aagctgaacagactccatttggctccttcatttgtaagacatcaagggctcctcacccaccccttcctcaaggacttaact
tgtttaagctgactcccagcatctcaaagagtgcgattaactgataaggtactgtggcaagctgtgtccgtagttcccaggaa
tttggccaggtgatggtaccctaaagcccctgcatttctgtctgcagataacacccagagccccacacctatcatcttgtg
atgaatttaaagcccctgcacctggaactgtttgcctgtaaccatttgtcctttcaactttttgcctgttttacttctgtta
gaatgctacagttaggctccccctcccctctctaaaccaaagtataaagaaaatctagcaccttcttcgggctgagagaat
ttccagcttagccatctctcagttgccagctaataaaagactcctgaattcatctcaaagtgcggcgttctctctaactcg
ctcggttacaacaagctgaggatggacactccattgtgcagtgagctctggtgacagtaatcgtagggtctcccggggcagc
ctaaggtcaatactgctggccgtcggaaagacaggctgaattcctgggaagacctgcatctgccatctaccacggagtcct
atggtcttctgttacactctctttgaatcagcaccacctagattatctaaaacactctttgtgacttcatgactgggaaaaa
taatggcagtctctactaacacctgtgttaagccatgggagcaacacctaggctagtgtgtgattgagtagttgagactgtgg
```

```
tctagtcaaggtgacacataaaattgattgttgccattatgatatttatttatatttgacaatataatcatgctcatatta
taaatatttctgttacattatttgtgtcagaggctttggaaccagaacaacttcatcttgaataaggggtaggaaaaataaga
ctgagacctgctgggctacattcccagtaagctaaggcgttcttagtcacaggatgagataggaggtctgcacaagatccagg
tcataaagaccttgctaataaagtttacagtaaagaaactggctgaagcccaccaaaaccaagatggtgacaaaagtgacctc
tgtttgtcctcattgctcattatatgctaagtattatgcttttaacattctaaaagacactcccccacagagccatgacagttta
caaatgccatagcaacatcaggaagtttccctagaaactaaagagtggaggaaacctcagctttgggaattgcccgggggaatt
catgaataatccttcttttgtttaacgtataatcaagaaataaccataaaaatggacaaccagcagcccataccacttctctg
cctatatagtagccattcttttattctcttactttcctaataaacttgctttcctttttattctgtagatttgcccccaattggga
tcccttttccagtaacatttgtgttattattggttttctaagcagaaaactctgagaggaggtgtcagccgggcttcctgggtt
gagtagaggctcagaaagcagtgaaactcactcatttcctgcatcaggacttactttggtcctggatgaataatattgaagat
atatgcttaaaatattcctaacatcacaatttgtgcatgtgttttcttccctaagaaagctataaacagtgaaaattttgctg
taagcttccctgtgtcttctctccctctctccattcccctccctgaaactaaaaggaatgttttaacattatgggcttta
agtctgtatttctgtgaccagcagaccttatctatgctcccaattcaaattccttgtaaacacaatttgtaaatcctgcgag
atcctgtctccttggccacgccactgcaaggtcataaagtagatcaaacttaagttacaattctgattttcctcaagatctga
gacatgttaattgtctttgtttcttgctcaggtaacatctcttttgctcttttttatctcttttgcacttaaatctaagtt
tacattagtcatgtatctagaatgtagaaatatgtcttaaagttacttttaaaaaattatggggtttccagaagat
gtgagaacctcctttattataaaatagctgattgcacgttgctcaataatttcctcttaatttatctctctcctgtcacat
tatactatgataagcaaaaagaaatgaaggcataccatcaacagtttacttagatatctcctcagctaaatttctaaggtata
atttactaattctaatttatccaatttaacataattaagataaattatataacaaggtacacatatgttccagttctaacac
catgtttgtgacagaaataaaacagagcttctctctgtaatgtggtcatctgagcctgaggtgatgggtcacataggtattt
ttatgatatttaagggtttggtcaagaacagtgataacaagtctgaacaagactggtcatacttgaaaggttacaggtaaagt
tactgctgttatttatattaacgccttattagaataaagctcagaggaagaggccacatcctaggtcacagtaggaggagga
atggagctgtgctctgctctccacactactttttcacatcccaggcacaagcccaggttccatgacgcacggcatctagagggc
agttctcaggggatgatctcagggcacctgcttcctcgggcagggcgcttcttctctcaattgcagacttgtccttctgca
aggtctgaagtcagcacttgtattcccatgattttacaggttctcttcctaatatggcaaaaatcttttattaaatttc
aatttatttctctgaagcacactgcattagcagaaacgaatatatcacattccttatccgcccacacagccaaagattcct
gaagacagagctgatgtgacgtactcataggtggatctctgcccctcagaggtggccttggtcttcaagtttcagcaatttct
aggaagccaaagacacctccatctactcctccctgctcgacagctcacctgagaacagctttctcattggaatgtctgtgct
taagaaataaaagttgctgtttgaggttagggagcccaggtgcacctaccagatccagcccaggattggagatactttcaga
agacaacatcacctgagacacgaccagtcccactgtttcactttcacaatttcagcttcttcagaagaaaattaaaattgttg
agacttgttcataagcgttgtgccatgtcctttctctgttttcttgcctgttcattgatgtcatgccaggtgccacttctatg
taataggatcagaattctgcctctagtaacacatcagaggtgaggtttgattgtacttttggtttatgctccaaaacgtagat
tataaaattcatcaccctcattttatgtcaaaagtaatctgcataatctggatgtcaatacttttggaatctatgaaataa
cagaaattgcaagaaatattaccccactccaaacctggagagacaggcatgtgcagaatggcaattgacacctgcttaactgga
gcagaagctgcagaagccacaagctgttgagggcacttacatggtaagcactacagacgtctgaagacagatgtggactcagt
aaatgtaacagttccagagggtcttatacttctaagttttctggaatttcttttccagaaacctcaagattctaaaatgtacat
tccaaagacatttcctatagatcaaaattgcagatattaattactgagaaacataccacgagccttcttcaaaagcttctaca
ggaaaggacttttccgaaccttatcctatgtgaaggaagacaataatccccactgcagatttctctctcccattcttccataatt
gtagaaatgagtaaagttagccaatagaggtaagatataagtaaataatccagggatgctgaaaacaaaaaagggagtaatcg
cccaaaatgagctttcccctggagacgcctggtcaagatcataggccagaagaggaagctgactgtgtctctaggtttccac
tgtcagaacaggcagtgcttacctgcactgcacaatccattctaaccaggatgatggctctggattaaaggtgaaagtgtggc
aatgcacagactctatctgaggagaacacaggaaaactaaggacaacggcagagggtgagacaagaacagtagagcaatctg
aagcctctgacatcatgattttaagaccaatgtcttaaacactccttcattgacctcagcttcttcatcatgaagcctttg
cagtgactctatctgagaaaagaaaataacctcctgcatgcacttctcaagtctctgcttgtatcctgtttgctttaggtct
ctaggggaaaaagtcagatacctggacctagtgtcagtgtaggaggcacatcctaaaagctacaaactaggaagaagggaaga
tgggtgttattggaatagtggatatggagtgggctttcttctgaaagtatatgcacctgctggtattctcagatgcaacattc
aactgcaagagcccattgaaagaaacaaggcactcccaaatctcctgtaagattctgtattcatttcagataagcccacatgtc
cccgcattaactttttcttcagacaagcacatacatctgaaactgaacagctatgtggcaaaataagctcaggatagaagtaa
ttgtggactccagctctgacaatttgtagatctgcatttttaaaattctaactgaagacttttgctttattgtagagacagtg
gtttacagctcgaattgcacagcctacaggcagatgtccattcctctggccaaggtttattttattgtttactgtactta
tttgttgacaaacattgatactataaagataccctaacagcgtccacatgaaagaaaaagaaagagcaatggacacatcaacc
ctgaacatccagtcccaggaatcctttgaccctgccctcttgcaacccagagatatagattggatgagccctgctgagcaga
acacacatgtccccaggagaaagacatggaaatgaggcccctccctgctaatgaaaagcagctcttcccctcttctcctgcag
gtcctggtgaggagccacccaatatctgtgcccttcctcagtgtccacaccatcgggtctatgatgatctgggcttcacttgt
catcactctcaatattgaggttccccgttaaacagactgagtgaactgtggctgctccacgtgggggctgttctcagtctgtt
gcttctgtgcttgcagaggtccctgtgaagttaattactggagtctctcagagaaatactacagaccaagaattctcagact
tttctgaaacctgtggattcactttcactgaaaacagcataagcttggtccagcaggcttcatgacagggggggtgtagg
tgataacatcagtaattcaagtggaagttctcagtgggactctcttgagtacaaagaagattaacagtcctcagagacacgc
ttttcagatgattctctcttaagatgattaacctgagagctcaggaaaattccgtttattactgtgagggacacggtgagggg
acatctgtgtgagctcagacacaaacctgcctgcagggagacacaaacctccctgcatggtagatgcttctcagaaccaccag
ggggtgcacaggaaaccagaaggtgctcaggacaccaggggggctgcagaaccaccatgactgctcaagacgccaggggcgc
tcagaaccaccgtggggcactcaggacaccaggggacaattcagagccaccaggggtggctcaggaaacctaggggggtgctca
ggacaccaggggggactcaggaaactaggggggtactcagaaccaccaggtggtgctcaggacaccagggagctctcagaaccat
ctggggcactgaggaaaccaggggggactcaaacactagggtgtgctctgaagcaccagcggaccctcaggactgcaggggcg
ctcaggacactaggggaacactcagaaccaccaggaagcgctcagaaccaccaggggcccctcaggacatcagagcgtgctgag
gacctccggggcgctcaggaccttcagagagtgatcagaacaccagagggcgctcagaacaccaggaggtgctcaggacagc
```

FIG. 7 (Cont. 11)

```
aagggctctcaggacactagggtgtgctcagtaaaccaggggtccctcacaaccaccaggggggcactcaggacaccagggga
tgctcaggacaccaggggccactgaggacaccaccgctccctagcaggcagctccacatcaggccctgggttggggcagga
agggtgttttccttttggatcttgccactaaactcttggggagttttttctccttcctttgtggtttcaagaaacattggtagat
tcttctcaggtataaagctctgctttcttgtattatgtaatgttttttggtttcggatgttaccagaattacactgcactgtga
gaggattcattcctcgtgtgtgcaatagtgaatgaaagctcaatgttagggggtggctttgaaagctacgttagggggtggcta
agggcagttagcaggaaatgatcatcactatagaaggctactcatttctttgcacatttccataaataattgtagtttatgcc
ctaaaaactgcatgcttcttggcccttttttcttaaatgcctccaatccaagaccagtcatctaattaagctgtatgtcaaag
accaccaatcaagttaagtctgtttaatgaaacactttgtaaacaaaaaagtacatctgtgtttgtatagtcagctttaaatt
ttacattgctttacaaatattaattttgtaaatttagtctcataattatcgtcagtatttaaaatcttaaagtcatgctatgt
taaattaagtaatcttagctttctcactatgaattagagttactaagaattagaatagtaagagcatgtaataagcttttggt
gaagtttataaagaaagatgaagatacgttttttgctttaaaatattttgttttccagtttacaggaccttctactggtttt
aagataacaatcactgtttacatctaaccctttttttaaacacctgctgtttaagattataaaattataaaattaaaaaccta
gttaaaccagattgatcttgtaatttaacaagatgttcagtattgttgttttaataaaaaaaaataggtaaatacttagct
actagaaaaataatcatctacttaatcataaggttttacttaggtaaacacctaaatttcatgggttataaacatggttaata
ggtgaaaaacttttaatggacaagtattacagttttcataaatattctaggtaagctatttaaaaaaataaattaggtaaatgaa
ataaaataaaccatttaaataaacttgttctacaatttaaaaatctaaagtttaattaaataatatatattatataaatgttt
atgcattactaattgtttaaaatatatatactataaggaaaacttttttaaaaatacatattataagaaaatattttttgaaaa
catttgttttttagaaaaataattttatttaattcaaaggttaattataaaatgtcgtaaacataccccagttagtaagagaggtt
taaagaaagttctagacatagagaagtactttttggtaagaaaggttaaaataaaaaaaaaattatatgagaaggaattttgtag
gataactttttatatataaaagtgactatttatgaaagaataatgtttagaataaaacaagatgttcaagtatgccataaatg
gttcgtgtaagtcaaaataaggtttatagaaagctaacttattaaaaaaaacttcatgttatcgagttgactataattgaaagg
gaagaatttattatagtctttatagggatctggctttcatatgaaaatactaacacactgaagattggttagaatgacaaa
attgtcttaaagtattgatttattcaataaaattataaggtattataatttttaacccaaaatttttaacttttgttgcatct
tgccattttttattttttttccatttgagaaggcttgagaggatctcaactttttcatcagctcctttaacattgtttcttactt
acagcagttagcctctgagttaacttctaactgttgttagtttctgactgctattatttcctgatgttaaaatcctctatctt
aaagttctaaataaaatgttttcttcaatataatattcagtgtccttggcttttctttaactgtctaaatttttctatgaaa
ccaaatcttcacttgtaaagacacatcttcctaggtctgattaattcaaatactttttcattagagttgacttgcaggtt
atgtacatggagttccccatagggaaaaacagtcacagtgcagaaggctttatttttgctatttggtaactgggcatgagaca
aattttaaattttcattgaaataattcctatgtaagtgttattaagtttttcaactacttagtaatactgagagtttaagacaa
tagaaattaatgttatgacattcatgtaactatctgtataactttaaagtccttgtgctgctactttactgagcttgaatc
ctaggtctaaaaaggacacacaacactttgggaggctaaggtgggcaaatcacctgaggtcagaagttagagaccagcctggc
caccatgacaaaaccccgtctttactaaaaaatacaaaaattagctgggcatggtggcaggtgcctgtaatcccagctacttg
ggagcctgaggcagagagaattgcttgaactcagggaggtggacgttgcagtgagcagatattgcactactgcactccagcct
gggtgacagagtgagactccatctcagaaaaaataaataaataaaataaaaaataaaaaggacaccaagtccagctaaatctt
aaacaccgacagcaattaaagcccccatctacagacctggaagaaaatgacaagaaaaattgatcacactctcaagacacaagc
ccagaaattgaaactacttaaccaccccagcccagggactattacagaagaagtggctttgtaagattgtaaaagctaattt
tgagagatgaaatcagttcagagtttctttataaattaaacattaatgcaaggctagcatctgggcccctgtgccagattgac
cagggtttcttgaagaattaatccacatttaaattaaaaacagataaagactgtataaaagatctatgcaaattattttat
ggtaaaagtaattataattaatagatttatttttcagaattgatagttttaactttttctcatgctgttcttctaagggtta
tattttagaaaatcaattctactctttcaaaaatatttttttttcttttttttagaaatcactgagttttcatgtggctaaata
aataacttattttacaataatctgtaatcctatttgtaatatcaagtgttgtaaactttttgatatttgacaaagttcacaaa
ataaaattctaaattcagtcatttgaacaccctgaaaagaaacacatttagcttatttggtacagttaaattatacaggaagt
aatgtcaaatttgcaatggttattaactttggactatatttatataaatgtggactatataatttgaatatacttatgtaaag
agtatatgttccaaaattctattagattcaagtgattttttatatgtcttagtatcagtagtacttatgattataatttaaaat
ttttgtttatcacagaaataaccaaattttctcctcaattctgtctttaaccaggggtattctaaaaggtcggtcattcacaa
ttgttgtttttactttgattctttatcaggtggcttataataatctatagaactttgagtagtactcttaaatatacaatatac
aattttgacaattttataaattgtgccattggtatagagagaaaaacttccatgagtctcatgagacctgaagcatttatgat
gattgttaatctaatatcaagcaggacaggatgtaattgcatgaactgaatgaaaaggagactgaaataattttttataactta
ttctttaaagcatttgctatttacttatgttttattgttcagaattcagaaaactttgtcttttaagctattcacagttttta
acaattttaactatactctattgagaaaaattgaaaaaataatttctttcttctctacataattctctccaaaatttggaaactg
taggtattcttatatcaaaatagttatttgcataggttcgataaaaatctgctttcttccataacagagcacaattagagaca
atggtcactttaccaaggctttaacttgaatgacatattttctgatttactttataaaatgaagagctgtacagctgatataa
gcccctttggaaaactggcatttacctttttttttttttttaacagggccctgagctgtagtaagtaaataattttgctttc
tgacaggcccaggaaacccaagttttcttggatacttgaaaaaataaaaagtaaaccaatccatatagctatctgatggcaca
gataaaatattggctgggcttgaggcttttaaagatcttacccttagattccttataaaaaatagcaaaagcaatgtatgaat
aaaacagcctatgtacaacaaacaacaacaaaaacaaaaacaataaaaagagagctaatatgttaagtgattattttttgctgc
atcttatacaaaaaatcaggccaagtataataagcctaaaatttattttacaaataaattagtcctattatgatttttgtctc
caataaaattggggaattataggagaaatattctttcaaaataaactatagtgcatctgttattaggttctaacctgtcca
cttgttttttcaatttacaatatttccacaatttggactcaatttaaaatatttcttccacaagtctccaaaataacatttt
tcagtgattttctttttaaatatttttttcctatttgaaatctccagaaggtaaactgtgctttcttacagctagtcaactta
aactctaaaataaaataaaatcaatgatatggtttgtctctgtgttcccaccaaatctcagttttgtatagtaataatttcca
catgtcaagggtggaaggaggtgaagataattgaatcacggacgtgttttctccatgcttttatcctattagtgagtgagtt
ctcacaagacctgatggttatataaagggcctccctcttcacatgacacttctctctcctgcagccatgtgaagaggtacgtg
tttgctgcccttttccatcatgactgtaagtttcttggggcctcccagccatgtagatctgtgagacaattaaacctttttt
aaataaattatccagcatcaggtatgtccttatagcagcatgaaaattgtctaataccagcaacttaattatatacaaaaatt
ccttttataccctcctactgtgaagggaaaataaatcttgagaccccaaaattactaagctaaagagaagagtcaatgtggtg
```

```
ttacaggagatagaaagaaattatttaggtagatagttgggatgagagagtctctggcaaataacttttcttctaacaaaaa
tcagctcagaaataacttcttctctaattacacacagttcaaagaaatcacttctaacaaaaagcagactaaataatcaggct
gtgaaatatagataagcaactctgccacagagagggtgtttctgggtgtaatcaccaaacctcacatatataggatgggtccc
agtaaaaacagtgagccttaataagcacattccttttcttttctgggagtacactaagatagaaaagctggaagcttgcacgg
ggtttgcgacgccggcacctgtgaggaagtacctgggaccaggcaagaaaacccttctggcctttcttagcacatgcacggtg
gaagaagataagcagtgtggaggagatcaagcaaagtgcccgcctgcccaatgaaagcatgaggtgggggttgccagagacttt
gctctatgcagatggcacacattgtcctaactgttttttgcacccctatgctgataagacaccgtctcccccacgagcacattat
aaaaatccttacatttttactgcagcacgataacccatttgggaccctctctgtgacagacagcttttttttatttaccta
ttaaacttgtgctctaacctcacccttagcatgtctgcgaccttgatattcacggccgtgagacaaagaagttcgggtggtat
tccagacaacgaggctgccatactggaaagtgctttgggcaaatctgcctccccttctgtttaaagtgattcctctgaggcta
acctgagaccaatacacagctgattgcttcctcttcactatcatttatgtaaaaacgaagatccactgagtcagactaaattg
tgcattcagtggtaggctaataaagtactcaaaagaacgcaacctattgtctcttatctacttctaaactgcagtccgtgctt
ttgattcgtcctgccttacaggaaaaatccaaagtacattttacatatattgattgatgtctcatgtctctctaaaatgtata
aaagcaagctgtacttcaatcgccttgggcacatgtctcaggacttcctgaggatggtcatgggtgagttcctaactttggca
agataaacgtattagtctgttctcctgctgctaataaaacataacaaagaccgggtaattgataaaggaaagaggtttaattg
actcacagtttcacatggctggggacacttcacaatcttgtcagaaaagcaagcgacatcttacacggtggcagactagagag
agcttgctcagggcaactcctccttacagaaccatcagatctaatgagaagtatttactatcatgagaacagcatgggaaaga
cctgccctgtgattcaattatctctcattgggtccttcccatgacacatgggaactgcaggactagaattcaaggttagatt
tggatggcgacacagacaaaccacattagtaaacttcctaaattgactgagacctgtctcagatatttgtcgtttacctaatt
catgttcagccttcagagttccaaggcctatatcagttttccaggattgtttccccttttttgttgtttgttatttcctccttt
atttatatgttttacttctcttttttctcccactatttttcttattaatggatgtgaaacttcacaacatttgaaatataggta
acaatgaactataataacaacttgggaccctatttatctagaaataatccgtcctacccatgaaagaaaaaaacaaaaacaaaa
acagaagcccagaaacttatttgtggtaaaatgcttcctctgaaatattttggaaaggaaaaagttgggaagatatgaaatg
aaaataaaaacttctgatgtcaattcattatgtcatgagggggaaaaaaactaaacgatgatccacgcaagaaactgattttc
ctttcattcctgagaaaatagccacagacagataaaatgttagatatcttcacagatagctacaatttgttcatctttgaaat
acttagtgcaggagaaccacttgatatctcatttccctatgtgcttcttttttcattactacatgtaagtttttcatgcaattcc
tccttcccctctagccagcttttccctttatatattgaaagccctaaaaaatgtcttttgggaatggcactaaccacgcatt
gtttctgtgattacttttcttccaagcatgccataactttgaaaaattaattttaatttgattgagagctctctcagaaacct
ttggttacactaggcaaaatccaaatcaggagccaattattgtaaaaatcagccatagtacactgtgcgtctgtgtgtgtgt
gtgtgtgtgtgtgtgtgtgtgtgtacatgtgtgttttaattttttgtgagctttgagccatgtagttctctctgtgggaga
tactatttggcgtgactttgaatagagaattctaaaagaaataagaagctcctatgagttctctgaaagtttctggactcacc
atggatcttgactgtgtcattgcatcagacagtcccagggaacagactctctggtggtttcatagaatctatgcttgggctct
ccctgcagtttactgggtatagtaatgacaaatcactgtttcaagagacaatttcaaaagcattagatgctgctgagagagga
ttgtgaaccaggggactgccccttcttcttggagagcgacattgggagaatatgctctgtgagcccaaacagcatcctcccc
tgcagggtgagggcagagttgcagggcaggcccagaacccactccacacagatgtcagccctggagctgctgcagaggagtct
gaggagaaattttttccagcacctgaattacacttatttcaaaacaaaaatgcaattaaaaagttaaaacaagtaattaatgt
ccaggcacagtggcttacacctataatcccagaaatttgagaagctgaggtggaagatttattgaacccaggagtttgagat
cagtctgtgaaaaatagtgaggcttcatctttatttttgaaaataaaaatatcatttagcaaaaactac
gatgcgtctttacatacccccatcatacttgaagcatttacctaacccaatgaggtgatgaggacccaatttgaaaggagaaaa
ttttagactttttcatatatcttaatagttggaagatgtagaagaaatatatttatatcaattaaatgtgtgcaaatattgaca
gacacaccataccaggagttcaacttgcaaagggtaaaaccaaaaaagtttgagattgttaatgtgccatttgaaggtgagat
cgtttgaggaccatgtcctgtgagagtttgtttctctattagaggagttctgtactcataaagttctggacatgccaggaga
caagtatcagtaaacaaatatcagaacttgaacttcagcttcccactcttgcattctccatgtgtcatctctctactatttct
cattctagatcaggtctttagctatgaaatattccacctaattaacatgtaaatagattgaagtccacagagttaaatatgta
tatttctcctgttttttcccaattgttccctcccacagctccaatattctccactgttaccatcaccttctagatctgctgcc
atgccctgcagattaaggatttgattccatgacagagaggaggtgcatttcaatggaactttggtgagaacctcggttttat
cccatttcctctggggctccaccagtgcatctggaataatgggttcagtggctggccctgcagggtgattccttagttctgt
agtgaagatgagggaggtgggtctgaatgcatttcagaagtatggctctcctctctcagacagacactttgggaaaataaga
ttttctgactgcacccattctagaacaaaggaattcaattggataagaatgctgataaaaaaacctcaaaccaaattaaat
ttaaaggagtttaattgacaatggatgattcatgaattgggcagccccggaatcacagcagattgaaagagacttcagtgc
agccatgtggttgaagaagatttatacatttttttaaattatgtacagaaatcagaagtgaggtacagaaacagctggattgg
ttacaggctgatgtttgtcttatttaaacacagtttgcacactcaagagtgtatgagtggttgaggtatggctgctgaaattg
gccaacgctcagctgttggtgaggtgctcaggtacatactcctgagttaggttttcaatctcgtccacctattcaggtaggtt
accgtttgtccacaaggactcaaacatagaagtacggagtcctcctcaggcccatatttaattcactttatcagtgcccttcag
catatggttcctgagaatttcacacggcaacatgtttaccacctagaatttaagcaatccaatacatgtaataggctgtatt
tcacatggcaacttctgcctcagtttagctaacactatggctttgtttctctctacaagaactcatttctcccaagatttcca
ttttcctgaaaggaaaataaatctttgggacccccatatcactaagccaaagggaaaagccaagctgaaaactgtttgggca
aacccaccttccattctttccctaaaatgatagctgttaaggtgtttacaagctacatatctccttcaaaatttgaccgcaca
gaaaatccttgtagaccaaggacattgtagaccaagcagagtcacttctctgctcacgtaagtcaaatgcatatctgattg
ctcccttgctctattgtttcactaagccagactaaggcctatgtgactattcctgtaaactgtgcattcagttaaaggctaa
tcggaaactcaaatagtcaaccattctctctcatactacctatgtctggtagctctccccccaacttcaatttgtcctgcc
ttttgaactaaataaatatacccttacatatttaattaatgtctcatgtctccctaaattgtataaaaccaagctgtgtccc
accacactgggcacgtatcatcaggactccctgaggctgtgtcacaggcatgtccttagtcctggaaaaatgaacttcctaaa
tctattgagattagtctcagatactctttggtttataagtatgttttctatctcataacttcaattatctgaaatactaaagg
aaatctgccaaataacacattatcttgttatctgttattgttgttgcaaaaataaatatatttatataattttatgtataatt
gatcatctttgtacattaccaaactgagtagcagatttgttagtaagacccaatgtaataaaaaattcaaatatcaattaaca
```

FIG. 7 (Cont. 13)

```
acttaatagaaaaacaaattacgctacatttgtttgccgaaatgctaccaattttttataaaaaataaacacatataacataa
atggtttaattctcagtatttctattgagaaaaataagccaaatacataagcgaatatactatattatttcattcttataaat
tctaccaaataaatactagtctaaagaaatatgaaaacatcagtagtttataaagaaatggtagaaaaaggggaaggggaaaaa
acaaataatataaaagatcaagaggaatgctgaggggagttgacttgttacctcattgaaaatagagattatttttttcaaagt
ttactattgcacatgttaaatatgtgaatttttatcatctgtcagttaaaactcataaaatttattacaagtaaacagccgaca
ttttatacaaaaaagggatgataggaagaaacaaataaatacattaaatgtcagatacgccaaaaacttatctgcctgaccc
tagttgtctccgtaattttttggatgaaaaccagcccaccctgaccctgctgctctgggagaggagcccagcttgggattc
ccaagtgtttgcattcagtgatcaggactgaacacacaggactcaccagggagtttgtgctaagctgggttttccttgttgct
atattaaaatgtgattcatggagaactagagagattgagtgtgagttacatgagtgagagaaacagtggatatgtttggcaat
ttctgacttttgtgtctctgtgtttgcaggtgtccagtgtgaggatcagctggtggagtctggggaggcttggtacagcctg
ggggtccctgagaccctcctgtgcagcctctggattcgccttcagtagctatgttctgcactgggttcgccgggctccaggg
aagggtccggagtgggtatcagctattggtactggtggtgatacatactatgcagactccgtgatggccgattcaccatctc
cagagacaacgccaagaagtccttgtatcttcaaatgaacagcctgatagctgaggacatggctgtgtattattgtgcaagag
acacagtgaggggaagtcaatgtgagcccagatacaaacttccctgcaggaacgctggaggaaatcagctgcagggggcgctc
aggagccactgatcagagtcagcccaagaggcaggtgcacacagaggctgatttcctgtcagggtgtggacttcgtcttttt
accatttctctagggaacctctctaagttcagaattctgtgcttaccaatgtcatctctacatgtttttttaatgattatttttg
agaacctattcttacatgcacaaaatgcagatggatgcttacagagatgaaaagtcctcaaccatggtcaccaggatcagcct
tgaggaaactcagggtgcctggtgaatcttctccagtcagactcaggacagaaacctctgtgagattcctgactagatcag
tcttcaggaatttttgataccagccaatagagaggctgggccagggtcagtgtcatgtagaacctcacaggtttcacgtctgac
ccttctccttctcctgacactaaagtatgcaaatcagtatcagcactgatctgggtcccttttgctcttaaaccattctatt
tcttttttatttgttgttgttcttgcttttcctcgtacttctcttgctccctgtaaaatggggaggtgtttcttgctgcaaaag
ccccaagcctcaagcccattccctgcagctcaggcggggctcaggctgtggctcctgcagccacatgggagtggctgttgggg
cttttctcttctcccattgctcagcaccctccagtgtgttgtgtgagactatctgggaacgaatgtggacaacaggagtgaag
gggatgagcttgcgtggacagaatggggatgtggatgtgaaatttatcctgtgctgtacaaacaaccacagattcaacttcctc
accagtagtattagaaagagggtgtgaaagttgtcagaataaaaatggaaacacttgtgttaacaccctgacaaatggaacta
ggaatgaccatgaagaagtttctcatgcatatactccagaaaacaagaactaccgtaaatggattctgcttaaccacagcctt
ggatagaagaaaccaaccttacaaaaatcacttctacaaggatatcttcccagcaactccctgtttaacctacagtgatg
ccacccttagtcctacaaaaatcacttctacaagaatatcttcccagcaactccctgtttaaccctacagtgatgccacctt
agtcctgattctaggagcacaggataatcctctcaaaacgacttatgtaacccacctcattttcactgtgtaaacctatggat
tcacatcctggagtcactgctgcatttgttcttaatggtcattagcccctttcacaatatttgaggctgttttctctgatgt
ctcttctaaaataaagaatttccaagtggacagcagtaaagaagctatttaggaagatgtaatgggaaggcatctttaacatt
ctgttgaatgtttccacatggcacttcaatcccctaaaatactttgctgtatcagcatgtgatgaatcggagtataattga
aggtaaaatgggaaatacatggccttttgatgaatcaagtcataggatgagaatgtctgtgtccttgaggaaggagaccatgg
gttgtaagttctagtggaggtacctttggcaaagggagttcatgagtttctgaaccttatgctacttttaatttaaggacgca
atttatgatgtatgtttacttaaatctttccagagacatttgtcagtaaggacagggtagcatttgtgtaatagtgatgactt
agagagttattttgtaattgctcctgtaaggtatgcacattgctcacttgatacagaagttcaaatgtcacaggtggaaaaac
aggaataaaggtgggcagatcacaaggtaaggagatggagaccatcctggctaacacggtgaaacccatcgctactaaaaaa
tacaaaaaattagccaggcatggtggcgggcacctgtagtcccagctactcaggaggctgaggcgggagaatagcgtgaaccc
gggaggcagagcttgcagtgagccgagatcgcaccactgaacttcagcctgggcaacagagggagactccatctcaaaaaaaa
aaaaaaaaagaaaacaggaataaagcaaattttatgaactgtcatgactgtagtttttggcaaggacattatcatgtcaacct
gtaaataaacagacaacaataaaacatatcaaatccatggggagtctgacctatgtccctctgtcttataagcacaaggcttt
gccacatccaaaatattattcaggctccagggtataaaatgcttttggactgtggaaggtaacagctctcccctcaggcaggg
gtaaggtatctggggaatgcagagttgtgttcataaggaagatgtcattatcgtgtcttctcctgtgcctggtagcaggtcct
gaaggtgaacgtctcagatgtcagacatggtctatcgggttaggataggtacatgtgactgacagggactgattctccatgt
aatcacatgccctgtccaggagcagctgcaggagtcagccctggacctgaatagcacacacttaccctctgcctcacctaca
ctgttactggccactccgtcacaaccagtccttactagtggacctggatctgccggctctcagggaggggctgcaatggataa
aatccattgctagtggtggtgggagtccatttgtcttgtggaaaatggcagcatttccttattttataaggcataataatgct
atgttgtgtacacataccacattgtctttatccatttgcccattgacagacacttagtttccatatcttggctgttgtgaata
cagctgcaataatcacaggagcgcaggtatcttcacaaggcggtaattttcatctctttgggtatatttccataagctgcatca
ctggtcatatgtgtattctgttttaattcattaggagccacacactgttttgcctaatggtaatgatgagaatacagaatg
tcatagccgctacgaagaacagttttagatttgaggtataatccaaaagcaaataatgtttgatcagggttctcatatgaggc
tctaataaataagtccagaaagttttcccatcttgggcaaggatgagtttgcccctaattgtctttgaggaagaagattggca
gaacgtgagatggagtctgttggcaggattcaggattcagtaataactagtaatggcacagaaaaatagagagatagagacat
acagagaaagagagagagaatatgaatctcataagaggaaaatttgctaaatatcagcattgggttttcagtcatagacacat
ttgtatgagccaggaaccatggagtcaagtgaggagtggagaatatgttcagtccaaaaatcagcatattctcagaggcaccc
attgccccatcacacaggtggagaattttggaaaccagtgaagtgcgagttcacattaggtgattaagctaccatgtttcgat
aaactttcattaacatgcaaagtacttccatagataactgatgcacaaatacgagatgcctttttgcgtttatggatgtct
agagaaaaataagtgagaaatttttccaggttgcagagatctgtttaagttgcagattccataggagagtgtctttgaatga
atactgttctattaattaaataggtcaaaattccctctgttggagcagccttccaattatatagatttctttatagcttcttg
agttgtgaaacataaacccaaggattgacttactggaatatgactgctgtgttgattaaatttctgataaggtttcttccaat
gatttgagaatagcttttcctgtttttttactcaaggaaatgaattttcacaaggtctcaggacatcacgtttcaggtgcttta
gttaaagagactcttcttggggggcagtcagctttcttccaaccatgagctcatttcttcagcaaaccattcgctttgtgcctc
tattaagaattatgaagcttttgtacttcaatgcactgaaaatcatgccccttgaattaaatgttgattggcactgacatgaa
ttggccactcttgtatatgtgtccatgttatgggctcaacataacagtggactgagaatcgtccattagctgcctctgattg
tggcactgaccagattgagaatcctcagagtcatccatgaaaagagagtccttaggttcatgaggttcttggagacattcag
gtaagtggaggagagaaacaggattggggctgccagccatttcaacaagactgggaacaattatcatctatgtttaaaggtc
```

```
tacatcattccaaacaccctccaggtttctctgagttcattgtgatgattacattcagctgcttctccagtgagtttaaatga
gcatgtggcaattcagatgagcctggctgtgggtttattatatgtaaatctgaactacataaacaagagggcatgtctgac
cgtatgagggtgcaaaatcctggagaccccacaccccacactcttgtgcttttcttttctccagcaacctccaggttttttttgt
atgagaattgtaatagattatctcatggctaagtcatcaagagacgtaaactctgagaaatacaagcagaaaattctccagat
agaagatccaggggaagaacatttctagcaccttatctatgtaggggaaggcagtccatctccattacagaccctcacagca
gccttcctttataaggaaaatgggtcaaattagccaataggtaagaatcctataatgttccagccagaaaagggaaagcatc
aatttgacttctggagactctgtatataggtcacattccatagaaagaagagcactaaattattaagattcaattgtaactac
atatgatacttccgggatgcacaaattaaagatgaaagtgtgacaatgcacaggctctgtcagagaaggagaacgtagggaaa
ctgaaagagaatggcagagagtaagacaaggacagaagagcaatatgaagcctctgacatcaactctgtaaggacaaggtctt
ggcaactcccgcattgaccacagattctgttaccatgggccatttgcagggttcctagctaaggaaaaagaaaaaaaaaactg
catgcacttcccaagtctccacttgtatcctgttttcttagatctctaggacaaaaaaatggcataaacctagacctagtg
tcagtgtaggaggtactttcttataggcaagacactaggaagaagggaaatgtgtgttattggactaggagatacagagat
ggctttaatctgaatagatctacaccgcaggtattctcgaatgcaacattcaactacaagagcctaatgaagaaacacgacc
ctccccaaaccctgcaagctcttgtattcactgtgtctccactgatttagtgcacctggagcttcagagcactggctccctc
ctgtgtcctagaatcttttcttgggctctttctgcagaattcaataggattagttaggctaatcaattgtttcaagagatggt
gttggcagcatatattgtcgctggaagagtattctaagccaggacacaggcactttatgccggactaaagactctggagaaaa
tgttttgtgagccctgacagaaacctccttgaaaggtaaggctgggcaggaggggcactgaggagccacgcagcacacggt
ccagccctagaacaggaggctgggaggaggttcctctcagggcctcggttttccttcgtcagaaaaaaaaaatctaaaat
aaccgttcaacaagttgctgatatgccttcaaatatcctgctacaatggaacaattcatataacttcaggcaatgagaactat
tttttaaattgggcttctaggattataagtatcttaatagtgaaaatgtgaagaataggtatgatttactatttcaatggat
acagaattgtgggagtcactatattcctatgaacaaaaaattcagatttcagtgttaagtaatgttgcctacattgtgtgagt
gacggggcagtggtggatccgagagtgtggtgggtgcacggacataatgattcagaaagcaatatggaaagatgagtatctat
ggatacgaactgaaagtatgtaaatacttcacaaaatactaataaacggagttgaatataaaacccataattatccaaaacac
aaatttcttggaagttattttgggaacatgatttcttaaagaactccaaactcttgtttcaacttctgactcctcgtttctgt
gatataagaaaaccatttccaattatgcatctcagggcaattctgtaaacccagagcgtttctgctgaagatcctgggaatc
aagacaccgggcaggtgatggagacactgtctcaggtgcgcccaacgaatctcagaggaacctgctggagagtcacgtggaac
atctacagtcagtttctcagagtcaacagtgagctgtgttggtgcctgagggaccatgatgggccaaggcacgtgcccagt
gtcgtggacagtgatggtccagaaatgatctagatggtcttgacgctaatgaaatatgggttcagagtgaggagcataatctg
tggggacttgttcttcagtgaaaggatcctgtccgcaaacagaaatggagcaggacatgcatttcttcaagcaggattagggc
ttggaccatcagcatccactcctgtgtggcagatgggacatctatcttctttctcaacctcgatcaggctttgaggtatgaa
ataatctgtctcatgaatatgcaaataaccttagatctactgaggtaaatatggatacatctgggccctgaaagcatcatcca
acaaccacatcccttctctacagaagcctctgagaggaaagttcttcaccatggactggacctggagggtcttctgcttgctg
gctgtagctccaggtaaaggccaactggttccagggctgaggaagggattttttccagtttagaggactgtcattctctact
gtgtcctctccgcaggtgctcactccaggtgcagctggtgcagtctgggctgaggtgaagaagcctggggcctcagtgaag
gtttcctgcaaggcatctggatacaccttcaccagctactatatgcactgggtgcgacaggcccctggacaagggcttgagtg
gatgggaataatcaaccctagtggtgtagcacaagctacgcacagaagttccagggcagagtcaccatgaccaggagacacgt
ccacgagcacagtctacatggagctgagcagcctgagatctgaggacacggccgtgtattactgtgcgagagacacagtgtga
gaaaccacatcctcagagtgtcagaaaccctgagggaggagtcagctgtgctgagctgagaaaatgacaggggttattcagtt
taagactgtttagaaaacgggttatatatttgagaacaaagaacaataagaaacacaatctaattgtaagagaaatattccatt
caagagccaccacataagccaaactgacagagtgggaaaggccacactcagtaaagttgatacaaacataccataaaggtgct
actatgaacaagttttttgaattagatgaataaatcatttggagcaaggttatttggtcatatgttaagagtaagcatgattct
tacaaagtgggaaaattgtctttcaaatgtttctgtcacttcttaccataaagttcattttagaggttttaggattacagtga
aattgcacagaaggtgtgagaattcccatgaatccctgccccgcacggacaccgcctcctccactacagccatcctgccccac
agtcacaaataagtcacaatggatgaatctacaagaactcttggttcttctttttctggtgatccctaatataacaagcct
aaattatcttggaacacccaggtattttcaatggctttctagaagtgatattagtcagagggaaagtgagtgaggctattact
atttgagcactttcttccaaaatccacaaaatatatgttaatttggagtttttctaacttctggtttacaatgtcccttccca
gagagtaagattttttaagcttttagtgaggctgaaaaaaaaattttaaaaaagagaaataagcttcctgtattaggctga
cttatcccagcggcagcaacaagcacagcccagacccaggaaaagtcttaataatattatctaatgtgctctggagactcttt
cagcactccctcaacataggggagaagaaaacaaattttccttttgtcttatgatatgagtttatagagtcttgttctctgtaa
ctagtaacttcaagtattctgttttatctaagaagcacatgagaagcctagcaggccagaactacagctgtct
aggtaccggagtgagtgttatgagatcaaccagtgcaaggctctttagaacaaaacctagataacagacatctgggttgcata
gcaatggtcatgtgtaatcctgagttatgaacctgttacaatttgattaactgtctctgtcctgcctccgtatccctgctttt
gtgcactctaagcttgcttcaagctagcccaccccatttttgggaagtgtgtataaaagtcaagcgctctctttgttctgtgcc
cagtctttggtcattgagtctgctgggtctggtgtactcagtaataaaaatatcctcctgtatacaccccaagatctctctc
tggtcctccggattctgcaacatttcaggcagattcacatctctaaaaggccagcaagttctggtcaatcccataatgaaaat
cctttaatgagacttggcacacgtgacaataagagactccttgtataatgccctagagttggattagacacactgtgagctct
tgggtggtggttctgaataaggcagtttgtgcagcaaatgcaaacacatgcatgggatccaggcaggaacaaaagcttccctt
tacaaagtgggtgggcatctggagggagccctcagaggtgggcagtggtcgtccttgctgactgcacattagccagaggcgtg
accataattggtcttgcagggaaagagcaccactgaggtcataggttatgaaaatgtttgtcatcctccagtgagcaagtcca
tcctgcttcttgtgggtgtcaactccatggtgatacactctgggagatgacaagatgcacacaaacctcctctcactaatt
atccactaccacactcaagaccaaccttgctccagaaaggacgtgtctgtggaaataacagagcgttaagtattttg
taacctggtgaacatactgtgcaaaaccaaacgtttcaggaagattagctcagaaatgttttatcaagtgactgaagggcagtg
gcgggtgaggtgatgggacagcctcagggctgcacatgaggagggctccctccccatgcaggcttttcctccaggagctgca
ccaggaactcaaggaagatcagggagaattctgagaacaccctgctgtggagctgcctagaagaagaataaatgatgaaaa
atacaactctgagtaatgcatgggttttttgttcatgaaaactctctctctgaaagcttgtgaaggtcttgaaatacccctgat
tagctgaagacaaacatttaaaccctccttccacagggagttcaagcaggctggatgtgtccttctatggatgatcttcctca
```

FIG. 7 (Cont. 15)

```
gccccttcctcttcccagctcatccctggctctctgtgtaaaaagttctcatcagcggaatgtggttgatgaagtgacgtctt
caatttcctcatcttctatgtggtcatgttattttcctcatctgaagtttaaaaactcacctgcatgcagcacatgacaggct
aaaatctcttgtggacaaaacagtaacaaaggcacccaccatggttgagcaccgtgttgctgacaacgaccaccagggtca
acgtcctcttcacaatcctgtgtcagagcagcacttgagtgatttcaataacaacttcccaggagaatcagctgaaaactact
tgtcccattttccatacagatataaccccctctattttcctgaagaaatagaaagagctgaatgctgaatacactgaatgtctg
ctggttttgcaagtttgtgactatatcactttctaatttctgacctgtgcagaccactgtacagacttttctcactggtggga
ccaggcttccagatgtcaaatataaatgagcttcttcatataaaagtcaacacaagctcctcatggtttcagtgctcactgaa
tggagttggaaataaaacccacaattatccataacacaaattccttggaagttattttgggataatgagttcataacctgtag
accaagagtccaagagtgtttctattgaagagcctgggggatcaagacaccaggcaggtgatgcagacactgtctaaagagtg
cccagcggctctcagagggacctactggatactcacgtgggacatcagcaatcactttctcagagtcaccagtgagctgtgct
ggttcctgaagggtccaggatagggccaaggcacctgctctgtgtcggggagagtgattgttccagaaatcatagaggtggtc
tctatgcttataaaatctatgttcacagtgagaagtctgttctgagagggcttattcttcagtgaaaggacctctgcccacaa
atgttcataaatggagcagggcattcatttcctcaagcaggatcagggcttgagtcatcagcatctcactcttgcaaggctga
tgtgtcgtttgtcttcccttcttatcatcgaccaggctttgagctatgaaatgccctgtctcatcaatatgcaaataacctg
agatcgactgaggtaaatatggatatgtctgtgccctgagagcatcacccaacaaccacatccctcctctagagaatcccctg
aaagcacagctcctccaccatggactggaccctggagaatcctcttcttggtggcagcagccacaggtaagggggtcccaagtcc
cagtgatgaggagggggattgagtccagtcaaggtggcttttatccactcctgtgtccccctccacagatgcctactcccagatg
cagctggtgcagtctgggctgaggtgaagaagactgggcctcagtgaaggttcctgcaaggcttcggatacaccttcac
ctaccgctacctgcactgggtgcgacaggcccccggacaagcgcttgagtggaggatggatcacacctttcaatggtaaca
ccaactacgcacagaaattccaggacagagtcaccattaccagggacaggtctatgagcacagcctacatggagctgagcagc
ctgagatctgaggacacagccatgtattactgtgcaagatacacagtgtgaaaacccacatcctgagaccgtcagaaacccca
aggaggaggcagcttcactgaatgaggaggttacagggcttacgatgtttaaagttgttcagaaaataggctaagcaattgag
gaatatgagtaatagaaatatgtacgcactctatacaggaaatatttctaataactgtcaccctatatgcaaaattcgcagag
aggtaaaagcagaaatcagtcaagctgatgcaaagttccccacgtaggctttgtgcagatgtaagttctaaaatcagatagat
aaataatttggagcaagattgcttgataacatggctaatgctgaatatgattcctaaaaactggccaaaatatattccaattt
gtctctgccacctctcttacataaaatgtattaaaaagtagttttaagaccacagcaaaattgaacagaaggtgcagagattt
cctatgtgccctgcttcacacatgcacagccttccccactgtcaccatcctgcccagagtcatcaataagttacaatggat
gaacttacatggatggattggttctttcctcttccggcggtcccttggcataccaagtctaaactatcttgaagcacaacagg
ttcttcgagtgggttcctgggaatgaagccagttagaggaaaagtgggtggggctattcctattaggagtcttttttagaaga
ctcataaaatgtatatgttcctatagattctgtgactcctgacttagtatcccttcccagacggtaagcttcctaaatgttta
gaggcagatccatatctatggaaagaaagcaagttctagtgaatcccataaggaatgtcctttaatgagaagtggagaccttg
gtcatgaggcacatcatgtatgattttctataattccttagattcactgtaagcttttgagggtgtttctggatgaggccct
ttgtacagaaaatgaaaactcaggcatgagttccaggcacaaccaaccaacttccttccaaagtgggagggaatagaagaaac
cctctcctgtgtgggcgctggtcccctccattgctggctgcacattagccagaggcatgagcccaattagtcttggagggtg
acagccccactggggttgctggctatagaaatgcctgtcctcttccagctgagtgagtcaacctgctcgcttgttggagtcaa
ctgcatggcaggtgcactctggaagatgacaagatgcacacaaaccttctgtaaagtatcaattactacacactcaaaaccaa
actgtattccagagacaggtgtctgcagggataaacagaatttaagcattttttgaatagggaagacactgccaaatgccata
tgtttcaggaagtttaactcagaaatgttgatgacataactcagaaacgtgaggtgacatgacagcttcaggggctgcacatg
aggaggctcacttccccatgcaggcttttcttcccaggaactctaccaggaactcacagaagatgagggagattctgaaaca
tcattctgtggtgctcccaggggaggaaaaataagatatgggaaaaaaactatataaattattagatttgttaatacaaact
atttctgaagccttgtggaggtcctgacataagccatcattagctgtgaacaaatatctacaccctcctttcctggggagttc
agttaggttgcgtctcttcttttatggacagtatccccaaccccttatttcctgcacacctgctgctctccatgggacgag
ttctcatcagtgaaatgtggttgatgtagtgaggtcttcacttttctcattgtattagtcaggattatctagagggagaacta
acaggatagaggtctgtatttgacggggagttttaaggaggactgactcacacgatcacaagatgaagtctcatgataggcc
gtctgcaagctgaggagcaaggaagccagtccaagtcccaaaacctcgaaagtcaggtggaaaagtcgtttattgggatagta
cccactactacaatcagtaaatgttggatacgatcaacagcatggttcaattcacaagtacatatgatgagtatagtgagcca
aagcacatacatatgattccgttttataaactgtacaaagtgaatactcattggaaattacataacaaagatcactaactgac
ttctccatagtaagagaagcgaaggtataggagggagaaattgtgagagacaaagagaaaattgagaggcgaattgatttgtt
ttctctgtgaatggtcattaggtcaatgtttgtcaaatggtgaacatattgtgtgaagattcatgtctgtattacttcatta
agctattataaatcaaatctaatgtggtagaaaaaatgaagaagaaataaaaataatacaaaaaagtcatgaactcct
gaatgaattaaccccttagtttttctctattacttataaaaacaccaagatacagccaaataatatcacgatatcattataaga
agagtgttttgtaaacctcactgggaatttatagctcttcctagagttaattttgggaacagttggatccaattgtgagaaa
tgcaggctggacactgagactggctcttatgagatgtgagctcttgtctatgtcacatggtccttccatacttgggggtttac
attcacatctgtaaatgaaggaaacattgactctcaaagaacatatttcatgtgcatgtaaaagtatgaatgctagtgagaat
taattacttatgaagtataatcacccacatccactcttggacacagccactctgaggcatctgttacagaactcattatata
gtaggagacatgcaaatagggtcctccctctgctgataaaaccagcccagccctgacctgcagctctgggagaggagcccc
agccctgagattcccaggtgtttccattcggtgatcagcactgaacacagagaacgcacctggagcttgaatgagctgga
gggtgacttaaaagtgattcatgataaaagatcttagtgtagtgaacagagttagagaaacaggg
atatgtgaactgacagactgtatgttgcaagtgtcagtgaagtgcagcttgagtcgaggaat
cctggtcagctcagggcttgaactcctgcagactcagatttcaactttgatgatataccatgactggtc
aaaagtgagaaagttgatacaggtttctctatcagttgctgtgtactacatcagcagattgtgaag
aaaggccagcgagttgaagcaggggtcttgtctcctatcagttggtgtgaactacatcagcagctctgtgaag
gattactgcaaaagatacacagtgaggggaagtcagcgagagcccagacaaaacctcgctgcaggaagacaggaggggc
ctgggctgcagaggccactcaagacacactgagcataggttaactctgggacaagttgctcaggaaggttaagagctggttt
cctttcagagtcttcacaatttctccatctaacagtttccccaggaaccctgtcgcaatgtcctgcagcacctcagaccacct
gtcctggttctatcaaggaagtttacctccagcacagtaaagaaaacaattgaaggaggagagaacctgcagatgatagacaa
```

```
tattcaaaactattcatatgacaagggattactatcaagcacataaactcaactgaactgcaaataacaatatgattaataat
gggcgaataacatggataaacgtctctcagaggaagacatgcaaaggatagatagatagatcgatagggatatatacatacat
atattgctagaaataactaatatcaggaaaatgcaaattcacaatgagctatctttccttaatctttgctggaaagtctgtta
gcagaaagacaacataaggaaaacaaaagctggccaggcttcatggaatgaacactttttatagaccacttgtggaaatgtaa
attagtacagccatcatgggaaaaaaagacaactaccatataaatcagcaatgcaactgctgagtgtgtgtgtgtatata
tatatatataaaattaaaagaaaaaactaatattgaagagatacctgtcgacccatatttattgcagccctaaacacaatt
acgatatgaaattaatgtatgtgtccatcaaaacgtgaatgggtaaataaaacggggtatatttacacaatggaatattattc
agccttaaaaatgaaattccgctgtttgaaacaacatggatgtaactgggaaccgttgtgttgagtgaaacaagccagacaca
gaaaaaaaaatacctcatttctcaatgttatgtagaagtttaagaaagttcatcttctagaaggaaatagtagagtagtggt
tatgaaatatcagaaatgggtggaggccgagagataagaagtggtttgttaacaaatgcacaattacaggtagacaggtggga
tacgctctagtgccctacagtgcagaagggtgactacagttaacaatatattgtacacttatgtttacaagtagccagaaga
gagaattttgtatgctaccaagcaaagaaatgttaatgtctgagctgatgaattagctcgttgttctgatttggtcaaaccac
attgcacagatgtattgaaatatcacactgtaccccataaatataaacaatcattatctgccaacttaaaaaatcctttaatt
aaaaagatttatttgcatacattacaaatgattcaacacagagccaggaaaatataacatttttatttgaaatagttaaat
tcctaacaaaatagttacattctttggcaccaaactgtgtatttgatcatggtaagtatagacagacttatgcaaagaataat
atattttaaacttagacttctacttaatactataaaataaattttagaacagctaagtaaaaggaataaagttgaggaa
atgtgtgtggtgtgtgatgtgtgagcttttcttgtaaccacactgtccatggtggatgtgtggtgtgtgtgtcttgtgtc
ttgtttgtgtttcctctgctaggggttctctgtgattctaggatctgtagctccagtgtgtttcaaaaaattgggaacattct
tagccattacttttcaaatacttctctttatctgcaatttctccttttcagaattaaaatatacatatactacactttttga
tattaatgtttagtttcttcagtctctgttccttcaatttacattgtgaattttctagagacaatttaagtgcatggttc
atttaaaagctgagccagctctactgaggggtatgcccaagtttgctcaatgttatactgcattgcttttggttcttatg
cacttccattcgattctttcttaatatttatatctctcagttccctatctagtcctgcattatgtccacagtttcttgaagag
attctcacatgaattacaggtactatacatatcttgtttaatcagatatttctaatatctgtatcatttacaaatctcatt
ctgaacatttgtttattgtgactttagtatttctcattaatataggtaataattgttgttgataaccagacatgttgggtcag
acaggggatatatcttattatttcattttatccattttctgcctgtatgtgaccacactttatctgtgccaggcctttaatg
tggaaatgtctgaatcttctcagagctacatgtgacatttacttgtggagtggacgtcagagttgaagtctgctcttctgtgc
ccgacagagacttcagatcctccagtgataccttgttttttctttcctgcttggctgtgtctctacacctgttccctcctccag
agaatctccttcagttccttcaggggggttaagatgttatattcaactgacaattgtaaaattgtcatagaataaaggggatat
ttagaataaagggatattttctgacctttcatgggtccatattgtgatcctgagtctgggtgtgacctttccattgtttctga
acttcctccagatgagatgttggtctgtgtgttcttgctgttttccctgggtgagagtcctcttgttttcccagttgttccc
tcccacagctccaatgttctcttttggtgttatcatcttccagatttgctgacctgacccatagattaaggctctgattcagt
atgaaaggggggaggtacttctcaatggaacttaagtaaagacctcttttttccatctcatttttctaagggattgtcccagtgcc
cctaagatcctggttttggtggcttcccctgcagagtaatttcttagttcctgcaatggggataaaggaggtgagtctgaat
gcatttcaaagtgtgggttcttttttctctcacagacagacacattggcacggaaagatttttgtgactctccacattattggg
aaaactgattcaagaggataggaaagctcttcagtatgtggtccctgagaaattcatacaacacctttaccacacttgactt
caagcaatccaatatatatgtgtgttttctcttgtagtagcctacattttacatgccagactctgcccagttcagctcat
atcctggccttgttactgcctacaagaacttgcctctccctgcatttcagatttgatgttttcttaaaacttcaagtattta
aagtattttaaaacttgcaaaatcccattttgctctgtttacctgatattgttgatgttgttattgtaaaaagtaagtaga
atatattcctcatctatgtacgtttcaaaactgagttgcagcttttttggtaagaccccagagtcataaaagactgcaaatac
tgttaagctgcttaacagaaaaacaaatgctggtaaatgtgttcactggaatactaccgtcatttataataaataaatgcct
gacacacagaacaacataaaatatctaagtatttataccgagtaaaatatgccaaacaaataagaatatatactatgtcattt
catttttttataaatgctgatgaataaaaaatgcatctgaagtaaaataatgaggatccagtagttgctgggggaaatggtaga
agggaaggggagaggaggaggaatacagcagaataagaggaagtgttgagaagaattcacttgtccactttcttgataatgac
gacagttacatcacgtttattaattgcacattttaaaatatgtgaagtttattatctttcaattaagccacataaaatgtatta
caagcaaatggaaatttagacaagcacggagtaatagaaagatccaaacatatgttaaatgtcagaagtatctgaaaattagt
gtgtctggaccctagttctctccatattttcaggtgagtgctggtggcaacatcacacatgctcttactacagaaagtgggtt
ctgaaaccacaccaggcacgtccagctttgtcctggagttggtttaggggatgtcacagccagtgacggaggagcacaggg
ccagataccagcgttcacttatcccagacatgaactcctggatgcatacagagcccctccacttgtgggtttacttccactt
ctgtaaaaggagaaatattgactcctacagaactaataattacacaaatatttacagatgaaataggggtgatcagggcaaagt
gtttatcacagcacaattcataagacagcatatttttccaaataccatcgtcagcaaacatctgcagggcaccgtcttattat
ctgggtacagcctattcctccagcgtccacccctagagcttgttatatagtaggagatatgcaaatagggacctccctctact
gatgaaaaccaaccgaaccctgaccctgcagctctgagagaggagccttagccctggattccaaggcctatccacttggtgat
cagcactgagcaccgaggattcaccatggaactggggctccgctgggttttccttgttgctattttagaaggtgaatcatgga
aaagtagagagatttagtgtgtgtggatatgagtgagagaaacggtggatgtgtgtgacagtttctgaccaatgtctctctgt
ttgcaggtgtccagtgtgaagtgcactgtggagtctgggaagctgtcaagctgaggatcctgagactctgtg
gcagcctggattcacttcagtagctatagcatgaactgggtcgccaggcccaggaaggggctggagtgggtctcatc
cattagtagtagtagtagttacatatactacgcagactcagtgaaggccgatcaccatctccagagacaacgccaagaact
cactgtatctgcaaatgaacagcctgagcgaggacacggctgtattacgtgcgagagacacagtgagggaagtcag
tgtgagcccagacacaaacctccctgcagggtcccaggaccaccagggcgcccgggacactgtgcacgggctgtctccag
ggcaggtgcagttcctgctgagggctggcttcctgtcatggcctgcggcccctcattgtcaaatttccccaggaacttctc
cagatttacaaattctgtactgacatttcatgtctctaaatgtaaattttttgtcctttttgttttttgtaacag
gaggacacaccctcacctccacagaaaccacagtgtcacttggggggcagatgatccttctgtggtcagcaggatgaaagttc
cgaggaatctcagggaacccgaagagtgtttgccagttagactcaggcagcgacctccacgggaatctctgattagaacag
gctttgagttctgataggagccaagagagacgctcacacagggtcagggtccttaaagcctgatggttttcacagctatcccc
cctggtcttgtaaaactgtgtacatatgactcagactgattcacttgacccccttcctgctaatccattttccttctctgcat
acttgattctcacaattcccttctttctcttccccgaaaactgaggatgtgttttctgtagtctaaattccagggctcaggtc
```

FIG. 7 (Cont. 17)

```
tgcaggacctgggtaggctacggggactttctcactcaccattgtctggactctcctgttgtcgtctgtgaacagagatgttt
ggaagatgaagtggacattagtcatgaagggaataatactagttttctccaatgggatactgatgtagagctggatcttgtgc
ttctcacactgtcacagagtttggactctcacccgtgactttgaggagagctgaggatggacactccattgtgctgtgagctc
tgggtaacaatagtagggccctggctaggcagcctaaggtcaatactgctggccttcaggaaagacaggctggaattcctggg
aagacctgcatctgccgtccaccatggagtcccatcgtcttctattatgccctgattgaatcagcccaccctaggttatctag
aacactcttcgtgacttacgaaaaaataatggggagctctactaacacctgtgttatgccatgggagcaacacctaagctagt
gtgtgattgagtagatgagactgtggtctagtcaaggtgacacataaaattaattgttgccattataatattttattatatat
ttggcaatatagtcgtgctcatattataaatacttttgctacgttgttgttatgtcagaagcttttgaataagaacagcttca
tcttgaataggggctaggaaaaataagactgagacctgctgggctacgttcccagtaagctaaggcgttcttagtcacaggat
gagataggaggtctgcacaggatccaggtcataaagacctgctgatgaaggttacagtaaagaagctggccacagcccacca
aaaccaagacagtcacgaaagtgatctctattcatcctcactactcattatatgcttattgtattgccttaacatgctaaaag
acactccccctagtgcatgaccgtttacacatgtcatggtaacatcaggaagtttccctgcatggtctacaaaggaggggagg
aaacctcagcttcaggaattgcccaggggactcatgaataatccatccgttgtgagaaatacattcatccctttgagagaaa
tgcacagggggtggaatgaggctggaagctgatggcacatggtggaagcctgtccctgagtgaaggagaggggaagctgga
ttgggtggaaggtctctatatttgtgtgctgtgcaaggaagtgcaaaatataattgagtttttgtgcaagtcagtgctgcctct
caggtgatccccatgactcccagaaatggctctgcttaggaatccctgggagtcagtcatttcattagagtagaccacagga
catgggcttcagcacacgccatgccacagatgtcagaaagcagctgctgggaacctgacccacctgcattttgctgcctgtag
gaaaaggcagggaggtgcatcctcagggacaacacactgttttggatttctataaagaacgctgcttttactgtgttttattg
gaaaatacatgaacaaatgtgagcctgcaaacaattgtaattttcagttatttttaattgcattcatttgtaattctgcatgat
atgctgacacagagtcgcatttttcatagatattgttcaatgaatcaagaacatgcatttccactttcactggttttttctcc
gtgtgcagagaccttgagtagagcctgtctggcccttatccacactatctcttgtgtccccgggaaaaagcagagatttgcct
gactgcagaatctggggtaggagtctgctcagctcacagcctgcagagaagcccagtgaagtttatggagtcagagagcttt
cccatgtggggaacctctagcttacccatgccagagattactggtcagctgtaattgagagtttaacaattagagcactcag
aagcctatctcatcgcagcttcattatgtaacttaccaccattagactgcggtaataactcaatcttgattttctgacccca
ttttctcatcttattcatttgtaaattgggttatagaaaatgttatgttttagactctgattcaaatctcagaagtttatgaa
ctcatcaggaataatacaaaatgtgtctagttttggggaaatgtaaatgaatgtccatgcagtgtgtgtgtttgttgtgtggg
gatatgtcagtcacaccccaatgaacatgatttctgaattacatcatcaaactacaattagatttgctgaaaattgcctgcag
taatgtctgtgatgatgaacctgtccaccttgttgtgaggatgctcagtgcacaggcgaggttgcacaggagacatccaaggag
cagcccccaggcttggcagaattcctggccaggagccagacataggactgggtgtctcaaaagcagattccccaacccatcc
ctttatttggactgcatgggcatcatgaggaccagcaggagatgctcagaactcactcaaggcagagcaccattaggagcag
gtgcagcgaggaaacagccagagaacctctgactagaagcttgggttgttttcttttgcttaagagcatccaagcctaagtat
atcaaccactatatgtatatatataagtagactatccactatatatagagagagatagatataatctgtatatatatacagat
tatatctatctatatacattatatatacagattatatatatatataatctgtatatataagaaagttatgagttacagattat
atatatacattatatatatacatttatatatatttatatacatttatatatatacattttatatatatattatatatatacaga
gcaaaacgaggttaatatgactctgccattaactccttgaacctgggtcatttttctgagaatgccgtcatctacagcatga
tggttctcatgtcaaaatcaacacgcatagttagtcaccatgaagactgttttatctcatggtagaaatgtttatttaattaa
aaaattacatttcatacgaaaggggtctgtattatttctttctcacactgctgtaaagacatcacctgagaccgggtaattcgt
aaaggaaagaggttaatggactcacagttctgcatggctggggagcctcaggaaacttacaattatggtggaaggtgaaggg
gaagcaagtcccttcttcacaaggcagcaggatggagagagagagagagagagaaggagagaaggcaggataaagagccggaaa
cttatcagacaaaccaatctcctgagaactctatcaggagaacagcgtggaggaaaccactcccacaatctaatcacctctca
ccagacccctcgcctgacacttgggggtttacaattcagtattagctttgggtgaaaacacagagccaaaccatgtcagaattt
ctaggtgagaattggtcaattcataagttattagtgaagtatcagaaaaataaatagcaccagtgttgttgttatccagttaa
tttataaaaccatgtcaatatccattttatgagaggtgtaggaaaagtgtgagatggatagatagatagatagatagatagata
gatagatctaccaaatacaatatatataactatattatatatattactatgtatataatatgtagtaagtgatatatggtata
tatatgacattaattctaccaaatacttcacatatgtatgtgcatatatataatattaggtatgatatatatatgaaat
atcaggacatatatatatatatattttataatgtctcctgggatttagtgttgaattttttaatatctacatgtattccag
gataaatgttggtggacttcataaaatatattctaatttttatgtgcaagatgatcactttcaaataaggtttagctacagaa
accagatgtatctttctaccagaaattactggaaagcacagtgaaatttcttaatcaggattttaagatgcttgacaccactc
aacaaagacagtgattactaagagagagaggaaataagcataaggagccctccggtgaatgcaggctcagatacttcctcaaa
ggtgttgccaggctacagtgctgagctggaaaccatgtggagcattaataaaatggagctggaaacccatgtaggccaa
gaagtgtggataccacaggatagcaagtggattgcagaaaactgtcagagagtgaacccatagatggcaggaggaacaccca
gacttgacagagtgcagatcagtgtgtagaaagcagggaaggttgtacgtgagaacacacctgctgcaggaagctctcccta
aaatccagagccatggtaaatatatgaatatacacttacaaactttaaaacatacggaaaggcaccataataaagtcaaataa
aggaaaggtggggttggctacattaaaatataaaagagtatttctgagcaaataataatacttatgaggggaacaatttttatt
ctaccatggcaaatgatttcagagaacaacattcgaaatgcttatgccataatgaggaagcttcaaacaagtatacgaatag
aattattaccagagtggtagtaccagagccctcagctttctgatgaaaactgattcttatgaaagctaattattattata
agcttattattattaacactaattattattaattataatattataattattataatattattatgaaagcttattattatt
atgaaactgatattactagagccctaagctaagtgttattaccagagtcctcagctttcgatgaaacaacaacgtctgataa
aaattgtaataacccaaacatataaaatcaattcaaattattctaaggatgcacagtaaataaaaatcattgattgataaagt
gtgctgctatagactgaatgtttatttccgccctcagacatttgttggaattctaacccccaatgtgatggtgttacgaggttg
ggccgttggtaagtgaatgggtcaccttttggaagatgactaggccccatccaccctcatgaatggaatcagtgcccttgttag
agactccagaaagctccctctcctcttccaccaggtgaaggaaaagtgaagaatggttcaactatgaaggaggaagcaggttc
tcaccagataccagtttcaaagcatgttggccttgcacttgctgaccttcagaattgtgacaaatacatttatgcttgatctg
aaccacccagactattctcttacagcagctaaaacatcaagtctcagctagggcagtgagggcccacaatacttgagagacga
gcatcaccctctccttttccagttcaggatgacagaagcttgatctcgggctgaactgacaagcagagagtccttcctctccc
cagatcgcagttgaggccgtggtgtcagatctctgtggttgagagtgaattccagtctgtgatttcatggatgccttccttca
```

```
tctagttccacttatgagacagagattccatgctatgagttataggccaagaatagaggaaccccaattattcccacccagct
cacctgtagggcagaggatctggagagctttctgggtgaggcacaaagagactgtatgagtccaccoctcccatgcagtttcc
tgtacttaaagcagaggtgtccctctgacacagatgaaccctttcttccgcaccaaggcagaggcggttatatttttacagtg
gcagacagagggcataaaaacagaaatgcagagctctctctaatggatgtgactttatttgcagtaaaaggagaataatttca
acccctaggttttttctaaaatattataaatattttatggtaagttattaatagaaagctggtggcttcatgagagcaacacatt
aaacaggaatccactcatttcagcggacagaaggagaaaaaccataatttaggaataatgagctgggcactgtggcactgcct
gtggttccatccacttgggagtctgatgtgagaataacacttgagcccaggatttcaaggccaacctgaaaacgtagctagac
cccatttagtaaaataaataacattttgggggtcaggacaaagttcaaaaactgcccctgaaatgaagcccaaatttaattgtg
taacactgtggattaatggatgacacaacagtgtcaccatgcctgctgtgagtgcagtgtaacacttggatgacatatgaaga
gatacagacacccaaacagagacatcagacagtgaagctgtcaaaggctgcactgccgagcgtcaggcttttatggaaaccg
tgtgtacatctggaactgcacctgggaatgacgacatcaaccctttaatagtgtcggggaaagagacgtcactgaaatagaca
aactaagggactcaagaaataaatagagcgattggttttaccaatacaccagagcgttttgggtgatcactattcagagtttc
tgaattgtgttacctaactgtcattcagaaaataattatgagatacacaaagaaaaaaataacgtcacgaatgtacaggaaaa
tttccagaaaacacaaactgtctttgagttggtacagattttggacttaacaaatggagacttcaaaacaattattataaaaa
tgcacaaatcacaaaggaatactatcctagaaaagttaaggaaggtatgatgacagtatctcaccaaaagttaatatcaataa
tgagagagggttttttgaaagaaagttatagacacgctaaaattaaaaaccacgtaattcaaaactatatgtcagaggtgataa
gcagtatacttgaacctaaaaagaaaaaaaaagcacacttagatatatattagtagatatgctatattcaaagaatagtgaaaa
ttgcaataaaatgaaataagcttaacataaaaggtggacccagctagacaaatcaacatatgtttagtgtgaacattagcatg
agaagagagaaagaaatatgtcacaaaaatatgtcataatataatgacagataattccatgatttttatgataaatactaata
tacacattgaagtatgaatagctcaacaaactcaaggtaaaataagttataagagatcctcaacaaaacacattataataaaa
tatttttacagaaaaactactgagaaaatcttgaaggcagtgagagaaaaacaacttctcatatacaagataattctatcaaca
gctgatttctcatcaataacagctaatgctaaaaggcagcaggatgacatattttcccttgtatcccatttatcctcaaag
gccacctgcatacaaagtagaccagtcttacaagaaaatcacagccctagtgttcttctctcaaggagcccggctatggacct
aatggtgccctccccaaagtcataagtataattcccaacctgcaatgttacagtatttggaaatgagacttttgaaagtgata
gagtttgaatatttgtcctctcccaaggtcatgttgaaatgtaatcaccaatgctggagggggggcctggtgggaggtattgg
ataatagaggcagatccctcaagaatggcctatgcaatccatgtggtgatgagtgaatttctgttagttcgcatgaaatctg
gttgtttagaaaagtctggagcctcctccatctcttcttcttggcccccatctcttccttgccccttctcttgt
catgtaatgcacctgtgtgcctgctgcctctttgccttccacaatggttataaacttctgaggccctcacaaagcagatgct
ggcaccacgcttattgtaaagcctagcaaatggaaagccaaatgaaacctgtttttattataaattttccagcctcaggtac
tcttcctagcaatgcaaggacacagcaacacagaaaattggtatcaagaagtggagcattgctattaaaaatatgtgaaaat
atggacgcagctttggaacaggataaccgtcagggatttggaaggtttggagggctcagaaaaagtcaggaagataaagaaca
gttgggaaagttttagagactggttaaatggtttgaccaaaatgatgaaataaatatggacagtgaagtcaaggcagagaatg
cctcaaatgtaaatgagaaagttatagggaagtgaagtaaagatcgcctgtcaagcaaatcacttgactgcattatgttcatg
tcctggggatctgtgcaagtttgaacttacgagtgacgacttagggtatctgacagaaaaaaaattgtcagtagcaaagcatt
caagatggagtctgcctgcttctaacagtctaaaatcaggtgcagaagtgaataaatgacttaaagttggaacttctatttaa
aagagaagtggaacatggaagtttagaaaatgtacagcctggttctctggtaaagaaataatccagttacactgtgaagcaac
cgcttgctagaaagattagcttgactaaaaaggagctgactgtggtaatacgaaacaataggaaaatagtcttgaagtcaatt
cagaaatctttgaggccaattctctcattacaggcttaggtataggagcagagaatgttttgggggtgagaccagctagggc
tcaaaggtacagctcggttcaccacgtctgatggcgcaagctgtgatccttggtggcttccatgtggcataagcctgggtct
gcacagtatgcaagagtcaacatggcttggtgactggcctctagatttcagaggatgtgtgagaaaggctaggtgccagaaat
gagcctacctcagggtcagagtacacacagagtaatttttccagggcaatgctgaggtgaaatgaagagttaaatcccccaaa
agagatccccaggagaacactgtgtagtggagctgtggagagaaggtcactggccctctagaacccagaatgggagatccaat
agcagcatgtgccccaagcctagaaacgctgaaggcactcagctctaaactgtgacagcagccgtgttggctgcactgagaaa
agtcacataagcggttttgctctcagacttgcgagcccataattgcaccggctgcaagatgtggagtcactggtcactttgga
ggcttaagatcgagcgcctgtcctgctaggttttaggcttgcatagagcctgttactcattcatttggcaagttcctctctt
taaaatggagatgtttaccaatgtccgcaccaacattgtacctttgaagtaaataagttctttctaatttacaggctcaca
gatggaagaaatgtgggcatgaatcttagacaagactttggactttaatggtgaaacaagttcagatttaaggggcagattc
gaggggtgggtattgggaagaaaatgatcccatttgcagttgagaaagatataagattttgggtgataagagttatgtggct
tccatatatgtccattcaaaaatctcatgtttgactgttatcccaatgttcgttggggttttgcgttacggggcggattcc
tcctgggtggcttacgcgccatccacttggtgacgagtgagttctcacatagttagatcactcaggatctgattgtttaaggga
gacgtggatctccccctttccttctttccctgctcaccatgtgacactcctgcttccctgtgcctttaccagaaatataa
ggttttttgaagccctcaccagaagcagatagcagaaccacacttcctgtacagccttcaaagcagtcagccaaattagaattt
atttttttataaatttctcatccccaggaatactttatagcagttaaggaatttctataagaaagaaagtactgaatttaaag
gagacgatgagggtgaaacatcagaatgaaattactgacctcaggagtaaagacaccagacagtctctctctctctacttctc
tctctctatttctctctctctctctctctctcacacacacacacacacacacatgccctaaatgaaaagatcatatg
atcaagtaacaatatgatggctgctctgagccaaaagtagaagcctcaaactaaacctatcttgtcagcatcttgatcttgga
gttcacagcactgataaatggaataaaattaatgttgcacgagtcaccaagtatgacagtttgtaatggcagcttaaactgac
gaaagaaaatttgggggttaagaagaggaaatctgatgttacaattatttgaacattgtgaaagtagcttggaatttgggttatg
tgtaacaggatggatacctttgacatatatgaagaaatttgcatattgagggtcatgctgatagacagaaatgagtggttttg
gaaaatggagcaacagtcatccttatcataaagttttttaaaaaaaacttggctgggcagtgatataatatttagtgaaagag
aagtttgtgagtagtgagaaattgtgagtagctgagaatagttctaagtgttgaagatattttgcttgattcctcctgagtgct
taaaataagtgaggtagtaaattaaaatcagaaaaaataaaagaaaaagaatacaaaagctgagggcttagaaaattcaca
acctatccatattgcaaaaatcagaaactgtattctacaaagaacactgagtatatggctcaaatatcactcagtaagaagct
taagatactctatgaaaagaaatattcaggttttaaagaatgagaattgacctgagacaaatttgatgaatactgttagatt
tttcagatttaatggcctgaataatagagctacttggctgcaaatgtacacaattcttccagaagagagaaaataagcttt
aaatttatttagaaaccatcagaccactgcctctatttcaacagaccagaaagcctgtttctaaaatcttgaggaagaaacca
```

FIG. 7 (Cont. 19)

```
cccaacagaggcttgggttgggagcacccagcaagccctgtgtgtagggctgcatgaggcccttgacatgggagctggccta
gcagtgcctcaggagcggtgcctctgcctgcagctttggagctgattctgctgctcgaataagctgagaaggaaaaagaatgt
ttcagagaagattacagtggaggcttaaagcatatggaaatttgtttccctatgcattgtatttgctggagacaaaccaccca
ttttaccccctattttttttctttggcaatgaagctttctattctatgcctaattcaacaggacacagcagcggctgtatccag
tttgacaagattcagcatgaaaggttcctattacctgtgccggatgcatcactgatatgcggccaccagttcttaggttcat
atcactttaagggaccaaatacaaatgtcaatagcatatgtcattcttaaactgcagaaatggtgtcaaagaagaatgtggag
ataagagagcaggaggaattatgaaaatccagatagcatcttctcttctagagtggaaggtacactagtaatttcatgaaaca
ataaaatagatgaaatgtgtcatcatcatggagtgtctcacagtggcagtgcacaaataaatttctaaaaattccataaggta
ggtgtgatggatgaggcttatttccacacagggagcccataaatacccagataagtaaaaaatccaacacctggaacgaaaaa
tgcctcatcttgacatcacaaacccatctcagtaagtccgaggagtaatgtggaaatgaaacggaaaattcacaaacacattt
attgtgaaattttttagcacatgtttgaacattaaaacagaattgtccacaatttttaggaaaaccactccatgacaatgagtca
ctacactcatagaaacaccactgagtcaacagagttctaactgtcagcaggtcagtactgaggcctcaggagaatcaaggctc
tagggtacattttacagaacccagaattgagccacacaatctatagccaatgatctttgacaaacttaacaaaaattaacaa
aaatatacaccagaaaaggacacccccattcaataaatggtgctggggaaatgaaatgaacatgcagaagaacaaaactaga
cccctaccctcaacacatacatactcaacacaaaatgaattaaagacttagatataagacctcaaactataaatgtactcaaa
taaaataccaggacaactcttctgggcattggctgaggtaaagaatttatgactaacacccccaaaagcacacccaagagaaaa
atagacaaatgagacttaattaacctaaagagatatttcgcagcaacagagtgaacaggcaagttgcaaaatgacagaaaatt
ttcgcacaccttgcctttgacaaggaactaacatgaagaaattacaaggaattaaactatacaacgacaacaacaggaagaag
aaccaaataaccctattaaaatgagcaaaggacatgagtagacatttccaaagaacacatacaaatggataataaaatacataa
acaatgctcaacatcactaaccattagggaaatgcaaattaaaactacaataagatattatcttacaaaagccacagtggcta
ttattaaaaactcaaaagtatcagatgttggtgaggatggaaggtaacaggaactcatctacactgtagatgaggatgtggac
gaggacaacctctatggaaaatagtatggagtctgcccaaaaaactggaaatagaactgccatttgatgcagcaatcccacca
ctgggtaactactcaaaggaaaataaatcattacttcaaaaagatatccatgcttctatgtttaccacaaaactattcttaat
aacacacatgtcaacctgagtgtccaccaacagatgattttataaaagaacatagcacgtatacacaattcaatactagtcaa
ccacaataaaatgaaactgtcttttgcagcaagatgcctagaactgggaacaacataattagtgaactaactcacaaacag
agagtcacatgtcacacattattatttataagtggaaggtaacaacgtgtccacaaggatatggagagagaaatgatggacac
cggagacttagaaggatgggaggtggaaggtggcatgaggcatgaggagacattacctagtgggtacaatgtacattatttgggtga
gagtacactaaaagccaagaccactgtggaatatatccatgtgcaaaagttgcactcatagcctttaaatttatataaataaa
tgtacaaacaaaaaaattaaaaatataaaataattaacagttgaccaatgatcttaaagttaaaatttagaccaggcgtggtg
gctcacgcttgtaatcccagcactttgggaggtcgaagcaggtggatcatgaggtcgggagtttcagaccagcctggccaaca
tggtgaaaccccatctactaaaaacacaaaaattgaccagatgcggtggcaggcacctgtaatcccagctactcgggaggctg
aggcaggagaattgcttgaacccaggaggcggaggttgcaatgagccgagatcatgccactgcactctagcctgggcgacaga
gcaagactccatctcaaataaaataaaataaatgtaaaaaatgatcaataaatgaaattactatcagttgaaactcattaaa
tttaaagacattttctactcaagtaactataagaacatgaatgtcaagtttcagatgggaaactattttcaaatcagataacc
accaatttaattataataagaactctcaggactcaactgtgaaaaaaaaaaggaaggaaggaaggaaacaccccatggtta
aaataggaaagggttggtgcagacatttcatcaaataggatgtgcaggtgacataagcatttaaacaggctcttaacaggatt
tcccattaagggaatccaaatcaggcccacaatgagaaaccactatacacttttttagaatggctgaaattaggaggaaataca
ggtaataccaatgctgatgagcataccaagttcctagtgtctacagcattgttaatgggactgcaaaatgaaacagctactct
ggaagataatttttagttttttttctgcaatcaaacatgccccttaacacatgacctaaatatcccactcttgaattttgcttcag
agaaatataatcttatattcacacaaaacctctattcaaatattcaagatattgcgtgtgtgtgtgttagaaactaaaaataa
cataaatatctcaaaatctgaataggtgaaaaaactaggaagcaactataaattgaataccatcagcaataaaaaatatcaaa
tgatcgattcacaaaccattacaggtggaactccaggcattacgctaagtgagaggaagccagtctcgactatcaaagggaca
cagctgtaagcagcacggtcatcctcaggtgtcagtggtttgggctgggcttctttgtctctttcctgaccagacccagatg
ttgagctctgccacttggagatggaaaattctactattttcaaccatgcactgaggtgtgaattacttcacagactgaccaaa
caaacatgggctccactgaagagtgtctggcatttgtttcaaccacaagagaacttttcccagctcttccatgtccttggttc
tctcctgcaagccaggagccctggagtgtagcctgcatctcccatgtatccaccagctccttccaagggtcttccaccacac
cctccactgtttgtgagagcactgggaggctttcaattttttccacattctgttgttactgaagttaggatgtttaggacttat
taagatcatatttatgactgaattcattgcccctctctcctgggacagagctcctaaacaaggttctgcaggtgtagaca
aagttgagctgttttattcctcagcctaggagctgagcgctcagtggagggtcggagaggagcttcccacctctcagcactt
cggttatggtggggagaaccctctgccataggacagagctaggaacaagagaccccaatgttcccagtggcgctggacccaggg
gagagcctccatccatgagtggggctctatggaaggagtgagtctctggctctcagtagctcttgtccagcactgaacctcag
catcatgtgctgtgggcagggtcagagggccaacgtactgcccctggggaagagtttcctctggtgggagttggtagaaggt
gccctgtcttcttggctgcatctgtccgcagtggagtttacatcatgctgagctgggatgtggaaggaaggaagagcaccttta
gatcaaatacgatgactggccttactgagttttctatattttcttaaataaatatttcttcacttgctttatgctgttagatc
ctttccaaaccctgtaatttttcaaaataattttcactggtctcatgagggcatggattcattgagcccctcatgctgttaa
agagaaatagaactgttttttttttttcacttttagcgaacatccatggttataaaataattagttgacatttcttccaaca
ctttacagataccatcaactttcctcttgcttgtgaggttttaaccagaagaatgctatcatcatcttttctgttcttttgga
aggaatgcccctctactcacctccacttgcctgcatatatttctatttgtcttgcttttcagcagttttaataagatttac
ctaaatgtgtgtggggggaagcagggggtgttattctgttgttctgtgttctctgagatgcatggattcaccatttactctgcc
tccatttttggggaacacagttagaaaaaatgtcagtgtgagcccagaaacaagcctccctgaaggggggaacaggaccacccgg
gggcgctcaggaccccactgagcacagagcccagcctcagggcaggtgcagacggggttaaggtctggtttcccgtcagccct
gtggcttcctctccataaaacagtttcctctggggcacttctctggattccttatcctgttcttcctattcttcctgaagaag
aaacatttgtcgtaacaagagaaaattttctcacatgcaccaaaggcagagtcacctacagtcacttattccggtttctcaa
tgtgaataaattatcaatgcttctgaatttaatcagctaaacctattaaaggtgcggtgtttaactcaacactgccgcagct
caacagaactccaagggtcagtgagcaggagggaggataaagggcatgctgggcactgggcagagggagttagcatccagtg
caagagaagaaaggcccgtggtggtcactgtcaggacttcaagcccatagttccaattgtaggtgaccacgttcaaaagaag
```

FIG. 7 (Cont. 20)

```
agagacctcatccatgattagtgtgatgtgtcaagtctgatagtgccacactcacacctcaggtgattatgaaaagatttacc
aactctactattgtctgctgagagcagcacaggcctctcaagaaattccaaactggaatttcctcaatggaacaggaaaggag
gctggcttagggctttataatgatttggtggtggggtcggggggtcatttattctcaggagaaggagcttgtgtgatttaaac
ctcacattggcatcagatgagggagcttctacgatttctgactagatttcccatatgtgggggacaagggagaagaagaataa
accttaattcatcagcagcaggcaccaaaataggacctgacactttattctcccctagcagcttaagaaaatgagtgaaaaga
gagatgagggtccactgtgtgtgaaaagcaaacagaaataaagaaaataaaaatttttattatggtaagcacataataaaaag
aaagagaagaaggaatgagacagacagtggtgctgaatcaatgtcctgggtggggccttttctattatccactgtcatcagtt
tattctgaaggtctcaggtcagcttcctgcttcaaactatcacaggcccttatagggtatataaaaatccttataggatatcc
acagtttgtcatactttactaaagtagtctaataattagatgaagttctgaatttaatattcagttataataaatattaaaaa
ataccacaatctacaaattaggaaaccgagactatattttcaagggttacagccatcccatatgctggaaagcatagttt
tggtaaagatgagagacagacactcccaagaagaaggagttgggcagaagatttatgctgaactgtttggctaaacagactta
gtcaacaggttacagagaggctactgatgttcatggaggtggtgctgacacatgcactgaacacacatgcatttaacatgt
gagtcctgttcaattgccagtggtgacttagcatttaaattcattacagtcaggccctatgtgcaaacagcagaagcagagac
acaaaggcactcagggtgcagcctctgtaaacagccagagccaggccatggtcagcggtctctgatcaggagaaaggtcctga
tatcaaatgttcaatcaaagctggggttatggcttgtggaacaggggtcagttcagcagggatgggctgcaattgtcttcat
agtgcttgtctcagtgccagtgcttactgagccaccagagaaacgaaactattggcagttagaacatagtttatctttt
aagtgtagaagtgagtggcaaaatcctcgtctagcaaggccttaggtcttgtttataatttgacatcttactgccactgttct
gtcagtcttatgatttctattttaacataagtgttggccattgctgcgtctaaaccacaaagggaagaaggtataacgaggcg
tgtctgatctcttgtttagacatggttggaaacagttttggatttttacgggtcctaggccaagagatggactatttaa
tcagtcgtgggttttagggattttatttttaggttacagtttataaatatgaacccaactattgactttctgcaatttcactgc
tgtgttgtggttaaaagtacctgataaaattccttccaaagtggttcaagagcaatattctaccctgatgtttcttacaatag
atataattccctgctttaatgttattagaggctattgaaaagatgtagggaaatgatggtttaatctgttgatgaatagtgtg
ggtaaaatgcagtcatcactttcaacactttgtcatgcatgcatgtaataggacagaggtgagcattgtgggtaaatctctaa
atgtatgggccttccagctaccaaataataggctaataactgatgtctcctgaggggattaactataaggctctcttgctag
ggagagaatctttggccaaggaagttcaagattttcttaaggtttggacaattttagtttaaggatgacaattttcttcaaca
ttttcagaagattgtggatgggatggatgctatgttgtatacataatgctaatgccttccatatttagataatattataaacc
cctgactgataagactgcttgcttggtgtgatgacccactacaatatgtatactttcagttggtatgctatgtcatttttcctt
caggttttttactttccaagttacattagtcaggtctctaaaatgcaggactgcatctaaaatgtgttatttttgttgtgcattt
tcacatgttccagaaggtgggagaaatttctttgtgtgaagagcatcccaaagtcaggcactcctctagaacacgtgtttaat
ccttgtctttggcttattgatgagctctgttgactgcaataacttctgccatccgggctgacttgacatcacatagaggaaca
aattctgaatgaaagtttgctctactcaattgagtgcataacctcatttcattactgatgtataatgcatcagagataatatt
agatcaaggattttcaatgggaatctaatctaaagatgtaaacaaatttttcataatttagataaaattactgtgagcacactg
ctgctattcagccatgtctcctatcacactgaatccacactaactttgacctaaaagttagcatttgttctaatgttcagaat
tgttattttatcataacgtctctagatgattacagagtgtggctatgttggccatcagtaaaggaaagctattttaactgaa
tgaaaatgagacaaagcacacaacctaatgtaatggaagtcaggacatgagtgtctccaggcttttgtgtttcaagagttcat
gcaccaggggatttctttttcttacttgtacacagagcaacacccaaaatgttcatttcctctcccatcgactcttatcatctg
tttctatgtcagttagctttgaattttttgacccagctgcattcaagtagctgcaaataagcgtgatttcattcttttttata
gctgcatagtattccactgtgtataagaaccactgttttcttatccagtctataacgatggacattttaggttgattccatgt
ctatggtactgtgaattgcacagtgatacacacgtgatgtggatgtgtttttttgttacaataatttgttttctttttgggcata
tacccagtaatgggattgctgaggggaattgtaggtctgttctaagttatttgagaaatctctagatcgattccacagtgct
ttggccaagttacattttcaccaaaagtatgtaagtggcgcttttctctatagccttgcctgcatctgttaatttctgatctt
ttagtgatagcaattctgacatgtgttagatagtatgtgattgggttttgatttgcacttatctgatgatttgaggatgctga
gtattttgtatgttagttggccacttctatgtctgtatttgaaaagtttctgtgcacgtcccttcccatttttaatggggt
tatctgatttatgctgctgatttaagttccatatagattactgacttgcacacacggagaaagccagtattcccaactaaata
gaaaacataatcacttgtaggtatagacatactgaatttggaatggtcatggcttgcatgttggtattgaaatgggacagca
actttggaaaatggtcttcactgaaaatctcatacacaagtgtacctggtgtcaccacttacagtagttgaatggagaataca
actcaagtgccatcgactgccacagggatgaagacgccggtgtgtctgtgtgtctctaacccacagggatgaagacgccg
cggcgtgtctatgtgtctataacccacagggatgaagacgccacggtgtgtctgtgtgtctgtaacccacagagatgaagacg
ccgcggtgtgtctgtgtgtctgtaaccacagagatgaagacgccgcggtgtgtctgtgtgtctctaacccacagggatgaag
gcgccggtgtgtctgtgtgtctctaacccacagagatgaagatgccgcggtgtgtctgtgtgtctgtaatgcagcgcttaaa
gaggagtgaagcactgacataggctgcaacttggatgagccttgaaaacattgggtgactgaactgagggagacacggaagtc
tacatccctaattgtcccattgacacgaagcacgcagagcaggaaaatcccagatcacaggaggtcaggggaagggaaacaca
gagtgaccgcttaatggaggtgaggtttcctttctgtgatgaaaatgttcccaaaccaaatagtggaaatggttgcacagca
ttgtgaatgtgtaaagtatcactgacccatacacttaccaagggctgaaatggtaagtttatgttatgtgtatctcaacaca
ataaaaatgagtgccacattttgtttagcatatcaatgacaataacagttcaggtgaatgctggattcctcatcacaaccagt
gcttcctgatggagctggattcagggagggactggagtgggttgggtgcacaggtcatgaaggcagcaaaaattccaaccca
ctcctcaagagtccagtcgccacctccagatctatgtccgccggggcagctcttcctatggctgagctacatgagcaacaagc
aaataaccatgttttttgttgttgttgttagtttgttttgctttgttttagacagagtctcgctgtgtcacccaggctgg
agtgcagtggtgcgatcagctcactgcaatctctgcctcctgagttcaagtgattctcctgcctcagcctgcctagtagc
tgagactacaggcactcactacgacgcccagctaatatttgtatttttagtagagacagggtttcactatgttggccaggctg
ttcttgaactcttgacttcgtgatccaccccgcctcagcctcccaaagtgccgggattacaggcgtgagccaccgcgctcagcc
acaaccctgtatttttaagcaaaagacacagtgaggggacatcagtgggcactcaggaaccagcaggaaacccagggggcgcttggcacttcatggggg
ctcaggaccattgtgggctcagtggtcaggcaggctcaaggctcagcctcagggcaggtgcagcaggcgggaaaggccctgg
agactgggtttagtgtcaccttctcattgcgccactggacacacctccactacatctattctaatgtgtatgagtacttatgag
tttagaaaataacattgatattataaatctatagccatatgtgggtgcatcaagttaccctcttcaacctatgtggaccctgt
```

FIG. 7 (Cont. 21)

```
tcatcaggaataagtccctgcatttgaggaccttataaatcaataattatgtagaatcactttcttttttcagtctcatttcct
ccctctttctctctctcacacacactgacaaacacgctgggtgctataactttaattacctgatgtgttaaaaaaaattgatt
catttggaacttaaccagtttagctgttgttcacgctgttatgtaaaaaagatccctaaatgacttctacctggtaagaggag
ggaaggcgttggaaggtgaaattgcaggagaaggagagaatcgtgaaacgggagtgagttgttttctctatgaatggtgattag
gtcaatattttcaaacggtgaacatattgtgtgaagattatttgtcaatattatctcattaaaactattgcaaataaaagtg
tataatttggtaaaaaaatgaagagagaaataaaaataatacaagaaaagtcatgaactcctgactccacacgtgagttaac
cctcagttttctatgttacttagaaaaacactgagatacagccaaataatatcatgatatctttataagaagagggttttgt
aaccctcactcgaaatttctagctctgtcctagagttaatttagggagcagtcagatccagctgtgagaaacacgggccagac
agtgagactggcttttaccagatgtgagctcttagacatgtcacatggcccttccgtgcttgggggtttaccttcacatctgt
aaatgaaggaaactttgactcccacagaacataattcatgtgcatctataagtagaaatgctaatgagaattaattatttatg
aagtataatcactcgcatccactctgggacacagcctactctgaggcatcccttccagaagtcactatatagtaggagacatg
caggtgggtcctccctctgccgatgaaaaccacccagccctgaccctgcagctctgggagaggaccccagccctgagattcc
cacgtgtttccattcagtgatcagcactgaacacagaggactcgccatggagtttgggctgagctgggttttccttgttgcta
ttttaaaaggtgattcatggatcaatagagatgttgagtgtgagtgaacacgagtgagagaaacagtggatttgtgtggcagt
ttctgaccaggtgtctctgtgtttgcaggtgtccagtgtgtgaggtgcagctggtggagtctggggaggtgtggtaggcctgg
ggggtccctgagactctctgtgcagcctctgtggatctcaacttttgagtattaggcatgagctgggtccgccaagctccaggga
aggggctggagtgggtctctggtattaattggtggtagcacaggttatgcagactctgtgaaggggccgattcaccatc
tccagagacaacgccaagaactcctgtatctgcaaataacagtctgagagccgaggacacggcctgtatactgtgcgag
aggcacagtgaggggaagccagtgagagcccagacacaaacgtccctgcaggaagacaggaggggcctgggctgcagagggcg
ctcaggacacattaagaacacagtaaactcagggaccaggtgcccagggaggttaagggctggtttcctttcagagacttagc
tgtttctccatctaacagtttccccagaaccctgcctagatttgtgatctgtatctgctcaaactatctgtgtcaccttcctc
acctgtgactttgaggaagcttagtgtggacattccagtgggtggagagatcttggtgacagcaattgtgtgttctgtctagg
catgtctatggctggccatcaggaacgacaggctggaattcttggaaagaggcacacctgccatccatcaggaaattttgttg
tcttctgttctgctagaattaaatcaggcacgccaggttaactactactatcttcctagcttgagaaaattaatggtgggct
tgaataacacctatatgaaatcatcagagcaacacctagattcgagtctcatttaataattgagactatgttctagccaagga
gacacataaaactggtgattgccgtggtcagttcatatcatatatttgtcagtagaatctggctggtattatgaacagctttg
ccaacacatgttagtgttggtcttcggagaagcacattctatgaactccattaggtttatgtacagtttcctaaggaaccgg
tccacgcttttgagaggaaacgcagagcgggtggaaagaggctgggaagctgaaggcatatgagggaagttggtccctgagt
gaaggagagagggaggataactcagtggaacttccttaaactgtgctgttctaggaaggtccagcaagtcactgtatctgagt
catgtcaaagtttcccatcggggaccccgtgactccagcagtggctctactcagatcagcgcggagctcattgttctcctg
agagtggagcacaggacgtggcccagcaccagccgtggcatgcacatcagagtgcagccccaggcgcatggctcaggtgcac
tgtgctccctgcaggtggagggagggaagacctgactcagaacccatatgatgtgggttccatacagaacacaacttttactt
aatttctgtagatgacatagaaataaacatacagtctgtaaacaatggtgattcctacatttaccttgagagctttattcttt
gattctgcagaatgtcctggcatggtgttgcctttctcatgtggaagtgtaacataagttgaggacatgtgttccccacttc
attgtttcctccatgtacagagatcctgagtggagtacagctgaccctccttccacactgttcctctcctcccacgggaac
agcagataattacctgaggctgaatctgaggtgggatatgtcctgtgcacctcagagcctgcagagaccccggctgcagatt
catggagtcaggtgtttgtgcatgtgggaatctcgagctgtgctgttgtcagtgaatgctgcttagaactaattgcaggattc
agaattaggagacccctgatctatcacacctcagctcattctgccatccatcatctcagaaattctgaatatggttcagtt
tacatttttgtgatgtactgttctcatttcattagtcatgagtttggtcagcagaaagtgctaccatttatgtgtcccaacc
tgatgaagctaatttgcttcacgagaagttaggaggctcctgaatcttatcctaagcctgtctctctgcactttccttaaaa
ttcagttttacctggaattctgttgtgttgatttagccagtttccccatactgagtgtctgattttcctggatatctgatca
gtttccttgtccttcaccataacttgggtgacatctgatcacctggtctaacttcaacaaaatcctggcaggctgccctaa
gcaggatttacctcactcctgatgttcttcttggtgattttccatctgtgccccaaccctgctgtatgcctataaatcctc
acgttctcattctgtatttggagttctgctgaatctctcccccactgcaaaatccactgccctggtccctacacctatcatg
agggccctggatgaagtcttccttactgtgctggaacaagtgtcttcatatatacattttttctttaacaaatcaacctttag
tatttcctaattgatcaaaggacctcaaacattgcatgaaagcgaggatctccattttactataaggggtgttgtgtgaattt
cagtttccatgtgtggtgtccagaagtcctgggcaccaacggttgtgcttctctgccaattctgtgattctgaaacccggga
gtcatctgaacatgagtaaataggtgacttttctcactatttagtgactgccttatttcatttaccctgaagcttcacgaaca
cattgatgaaaagtagatagagaacttgtttggaaatgcaagatttatagtagacgtaaccacctacatgattctggaggtct
tcttagtgttccaagaaccagatgttttttcccaccacaggacaaagatgagaacctccacgctgtgaggatagaggacaggca
gggcaaagatgagaacctccacgctgtgaggatagaggacaggcagggcggtgtgaggacaaaagggggctgtggtcacgtcca
gggtgttctctcctagcaacgcctccagctctttcctcactctgtggtatttgtcagatgggaaacatacctcaaatttatat
ttgacatattgatggaagtccaggcaagaggcatctgaaagcttatttctgaacctgcttctgtaaggaatgcccatatcct
tggtctcttcctctttcttaactccattggctcccttcccctcctgcacacacccactgacgtttatggccacttccccaca
cccttcactgtagtaccattttcttgggctcctgggaaacccaacagctttagttaaactcacagctatgtacaccataggc
ccctcaggaggttctcagtttcactcctacagtctcccaggctgctccttggggtcctaacctgaccatctctaccctctctc
ctgagtctggccatccattgaacgtccctgctgccctctaatctggatttgtgtacagtagaaggttaactcagcagacctgg
attgtttaaaccctgcacattcctgaaaaacattgttcatttatggctctcagttacctcctgatgagaactctgagcccta
aaatgctatgccagataacagtgtctgtggttgtctgcagccttgggacctgtagtacacatttaatcatagtgctttgtagt
gaatgccagctatttttttttcctgggtagcgggggagctgttgtctgagtattgtggtcagttgaaatgcctaaccttgttt
tcactctaactacttttgaatcttccctgtttgtctcttttaatcacctagccttgcttctcatgtaagtaagactctctc
tagctgggaaagctggacaaactccaattgaccccttaatttacaagacactaaggggctcctcacccaaccccccttccgtaag
gagttaacctgtgtaaacagattctcagcatttcaaaggagcccagttaactgataaggtactagcaccaacaatgtatgaag
ttcccaggattttctcaaggagataacaacataaagccttgagttcatgcccggcatagcccctatatctaattataatgaa
agatttagagccctgcacctggtactgttgctctttttgtaaccatttgtctttttaaattgtttatctctctgtaaccatttt
gcttcttttgattcttgcatgtttttacttccgtagaattattgcacttgagttccccctcccttcctaaacctaggtatgaa
```

FIG. 7 (Cont. 22)

```
agttaatcaagcccttcctcggggcccagagaattttgagcattagccgtctctttggccgctggcttaataaaggactctt
aattcgtctcaaagtgtggcgttttctctaactcgcctgggtacaacattttggaggccgcagcgagatattaacaccactg
ggcgagagccggtctcgctccgggctccccggaaggatggccagctcggaggagggacaccacctgaggaaagaattttcag
gtccgcaaagagtgaccgccttccagaggagagcggatcgaccactgtgtcagcgccctaaaagtcaacatctgagtcctcag
cttctgacccgggtcaggtaggtcggatgtgacttcgtttccggtgagaggggagcggccctgacgagggcgctgagtcct
cagcttctgaccccgggtcaggtaggtcggatgtgacttcgtttccggtgagaggggagcggccctgacgagggcgctgagt
cctcagcttctgaccccggggtcaggtaggtcggatgtgacttcgtttccggtgagaggggagcggccctgacgagggcgctg
agtcctcagcttctgaccccggggtcaggtaggtcggatgtgacttcgtttccggtgagaggggagcggccctgacgagggcg
tccctcttttgactcagccattactctaggatgctagtgggttgagccttcgttttccggtaggcgccttcgtatcttggtt
tgggtgggaagtggtcctgaccaggaccctcccttgacttagctcaagacccaggacgctggagagctaagccttggtttctg
gcagacctctctctctcttctatcttccatccttcttttggaaatctccgggaaaggaaaaaaaaaaaaaacctgttataaa
ctctgtgtaaatggtgtgtgaatgtgggaggacaaaggcttgcgtttgtcttccagtttgtagctccatggcgaaagctacgg
agtttgagtgggccctcacctgccgttctgtggtgacctcataaggcttaaggcagcatcgggcatagctcgatccgagctgg
gggtttatactggcctgccaatgctaagaggaacccaagtcccctcacggggagtggccaggcaggcatctaaatgatcccat
cacgggacccccttcccttgtctgtctaatagagaaggtaaaacaggaaaactgtcatcattgtttacatgccctagggtcaa
ttgtttgttttatgttttattgttttgttcggtgtctattgtcttgtttaatagttgtcaaggtgttacatgtcaggacatcga
tatagtccacgaggtctgggtaaaaattcttcaaggtccttagtgctgatttttttgtcacaagaggttaaatttctaatcaa
tcatttagactggccaccacagtcttgtcttttctgtcataaacaagtaagctgttgttacgaaaagagtgtggagaacatt
cacctgattggaatttctggcaccatgaaggttgcgggtatttagattgtcatacccacgtcctagtgattggtcccttct
aaactgaactggtggtgggttcaaaacagccacctgcagacctcttgctcacctcttctgtcattctgtaacttttcctgc
gcccttaaataggaccttgtgtaaagaaacctacgcccgtcatgcttacttcgtttagactcctattctgttccactgtggc
tactttctcatcttaaggacgatccgagtggtccttttcccctcgtccctgccccttacccgcacatctcgtttttccagtg
caacagcaagttcagcgtctccaagacttcgctctgctctcactccttgaaccctttaaaggaaaaagctgaatttgaactgtt
tgcctttgaatcgtggagacataaaaaacacttaggatataggtctagaagaagaagaagagggagaacgcctagatcgaact
ggcccaggagacctcagactggccaccaatccccctccctcaatcttaaagctacagcaatgtggcaagtggtattagctgtt
gtggttttttctgttctttctgatcatgttaattctgttttccgacactccagcccccagggaaagagtttctctgccggtg
ttggatctgatatctctgctcaagacttgctcaaattgtcttttaaataataataataataaacgggaaacacctcctcct
ggccccgtaagggttggagccctctccagtgtatgctggaaaattttttctcttggttttctcagaggactatggagtccgcctt
agaaaaggcaaggtctggacactctgtgaactagaatgaccaaagtttggagtcggatggccctgtgaagggtcattaaatcc
taccattgttcaagccgtgtgatggttgttaccggaactccggccaccctgatcagtttccctatatcgatcaatggctaa
gtttgattaggaatcctcctccatggctctgttcatgtgccattcgcaattccacctccaaagtcctcctgagccaggccgcg
ttttgcctcaaccctccgccagttcggctcccctgttttgcctccctctgaagaagaggagagtcttcctcacccagttcc
accgccttaccaccagcctgctcccttggcgccatcccgtgtctcttcgactgcgtccctgtgggctgtgaccgccattgc
cttccgctacgaccgcatgggaggaagcagccctctactcccactgagagaggcacgagtccgcggctgatgagcgctcag
ccccttcctggtttatgtccctttttctacttctgacttgtataattggaaaaacccataatcctcccttctctgaaaagcct
caggctttgacctcactgatggagtccgtgctccggacccatcgacccacctgggatgactgccaacagctccttttaactct
gtttacctctgaggagagggagcatatccgaagagaggccagaaagcacttccttgcatcagccggtgggcggaggaggaag
actagagaccctctggaggaggaggaagctagagactcctggaggaggaggaggtcttccctccacctggcctaattgggg
cccagattcctcaggtggaaggagggcttggacgattttcaccagtatctcctcgcggtattaaaggagccgcttggaagc
ccataaacttgtctgagacaactgaagttgtccgggggcctgatgagtcaccagggtgttttagaacctccaggagct
tatcgaattcacacacctttgacctggcgactcccgagaatagccgtgctcttaatttggcatttgtggctcaggcagcccc
agatattaggagaaaactccaaaaactggaaggatttactgggatgaatatcagtcagcttttagaaatagcccagaaggttt
ttgaaaaccgagaatttgaaaaacaaaaacaagcgacacaggcagctgaaaaagctgccgataaagcatataaagacaagca
aaaatcttggtaacagctatccaagagggcagaaaggaaaggcctgcattccgaaaaatggccaaggaacctcgggttccca
ccagaaaagtgaaagaggtgaacaggcccctctaggaaaacaccaatgtgcctattgcaaacagactgggcattggaaaaagg
agtgcccgttactgccaaaagaaaaatctgaaaacaaaaaggttctcacctggccgcaacagaggagcctgatgattgatgg
ggacagggctcccttgctctcggcccccaggagcccatggtaactgctacagtgggggggccagcctgtatgtttcctaggaga
cacgggggagagcactccgcactggagactcccctggggagtgtctcaaataaaaaaattgctgtacaaggggtaactggag
ctatacaagaatatcctgtcacacacacctgagaagtaatcttggacagaaaagagtgacacactctttcctagtagttcca
gagtgtcctattcctctccttggacggacctcatcataagttacaggcctcaatctccttttcagctcagcaggctcatct
cacactaggaaatgcaacttcccccactgcccaactcttgctaactaccctctgtcagaagaatacttctggtttcaccgt
cgtaatcaccggaggagaatactaatactcttttgttagatctacagacacttttcccccgagtttcggccgagtcaaaccct
cccggactggctaaacaccatccgccagtagtcatagaactcttggccactgccataccggtccaggcaaagcaatacccac
aagtcagcaggctagagaggggattaatccccacattcaacgactgttacaagctggcatacttaccccatgccagtcggcct
ggaacacgccattttgccggtccagaaacctggaacaaatgattactggccagtacaagacttaagggacgttaataaatgg
actgttgctgtccacccaaccattcctaatccctatactctactcagcctgctcccaccagaacatacagtatacactgtcct
tgacctgaaagatgctttctttgctatccctctggcccccaaaatccagccgattttgctttcaaatggacagatccaagat
caggagacactacccaactgacttggactcagttacctcagggttttaaaaattcccctaccctttttggagaggctcttcag
caagatcttataccttccgagccagtcacctaactgtactcttctccaatatgtagatgacattttaataacaactgaaact
atggatggttgtctacaacacacaagagacctgctctacctccttcaggagctcgggtatggagtctcagccaaaaaggccca
gctttgtcttccagagtgtctactgggtacaagataaacaaaggaaaaagggcactcactagtgccggaaagaagcca
tcctgcgaatcccactcccgccaccaagagacagagctacatgaattcctgcagccctggatattgtcgtctttggatatcg
gggtttgcagagattacaaagcctttgtatactgctacaaaaggtaatggcccactgatttggacagacaccgaggaacaggc
ttttcagaatctgaaaaaggctttaactgcagcccaggctttagccctcccaaatatctcaaagccttttcatctgtttgtcc
atgagagccagggagttgctaagagagtgcttactcagactttaggaacttggagaggccagtggcttatttatctaagaag
gtggatcctgtggcctcaggatggccaagttgtttggcagccatagtggctacagcaagcctagtccaagaaactgataaatt
```

FIG. 7 (Cont. 23)

```
aactctaggccagaatttaacccttacagttcctcatgctgtagagacttgactacgaagtgcttcaggtaaatggatgtcaa
atgctcgtattttacaatatcagagtttactgttggatcagccttgtttgactttctctcccacaaggtgtttaaatcctgct
actttactcccagatccagattctaatactcctgtccatgactgtcaggagctgttagaagctaccgaaactggcaggccaga
tcttcaagatgtgctcctgagaaaggcggacgccaccgtgttcaccgacggcagcagttttctcgaacagggggatacgcaaag
ctggtgcagctgttaccacagagacagatgtgttgtgggttcaggctttaccggcaagcacctcagcacaaaaagctgaattg
attgcccttactcaagctctccgatgggttaaagataaacgtattaacatttatactgacagcaggtatgctttcgctactgt
gcatgtacatggagccatctactaagaacgcggggttgctcaggtcagaaggaaaaataattaagaacaaagaggaaattttag
ccctgcttgaagctgtgtggctccctcaacaagtggctgtaatccattgtaaaggacatcaaaaagaaaacacggctgttgcc
cgcggtaacccaaaagcggtttcagcagctcgggaagtggcgctgtcttcagctccgtccataaacctgctaccggcagtttc
ttttccacagccagatctgcctgacaaccccgcgtactcaacagaagaagaaaactggctgcaaaccttagagcaaataaaa
atcaaaaaggttggtggattcttcctgactctagaatcttcgtaccccagctcttggagaaactttagtcagtcacctacat
tctaccacccatttggtgggacaaaattagctcagctcctccggagctgttttaagatccctcatctacaaagcctaacagat
caagcagttctctggtgcacagcctgcgcccaggtaaatgccaagcaaggtcctaaacccagcccaggtcaccgtctccgaag
aaactcgccaggagaaaagtgggaaattgactttacagaggtaaagccacaccgggctgtgtacaagtaccttttagtatcag
tagacaccttctccggatggactgaggcatttgctaccaagaacgagacagctaacacagtagttaagttcttactcaatgaa
atcatccctggtacgggttgcctgctgccataggtgtgataatggaccgtgcctcacctcgtccatagctcaatcagtcag
taaggcattaaacattcagtggaagctccattgtgcctatcaaccccagagctctggacaggtggaatgcatgaaccataccc
taaaaaatactcttaccaaattaattctagacaccagtgaaaattgggtaaaactccttccttttagccctacttagagtaagg
tgcacccttatcaggctgggttctcaccttttgaaattatatatgggcgggcaccacctatcttgcctaagctaaaagatgc
ccatttgcagaaatatcacaagctaatttattacagtacctgcagtctctccaacaggtacaagagatcattctgccacttg
tttgagaagcccatcccagtccagttcctgaccagatggggccctgccattcattccagctcagtgacctggtgttgttaaa
aagttccagagagagggcctaactcctgcttggaagggacctcacaccgtcatcctcacgacgccaacagctctgaaggtgga
cggaattcctgcttggattcatcactcccacatcaaaaagccaacaaagcccaaacagaaacatggctccccaagcctggat
caggaccccttaaaactacacctaagtcgggtgaaactgttaaattaactcttttttatttgcttcttttgtttatccttgcctg
taatgtcttctgtgccttcctactccttcccctcacctctctcacaacaggacgtgttttcgccaatactacttggaaggtg
gtactccagggcaagtcacctttgcagtcgacttgtgtatactgttcccggagccggctggtaccacgaagatcatcgcgac
ctgccagtcatgggagcaggaggtgtcgacttggacactctgggagccaagccagatgtggaagctccaa
aggtgctgaaaaaggactccaaaagcttgacttttacctctgtcctgaaaatcaccctgatgctagctgttgagatacctacc
agttcgtccgcccggattgggcatgtgtaactttagccacttactctggggatcaactagatctccaactctgtcaataagt
cgtgcttctcgtcccaaatcgtgttctaaaataattgtaacctcttaacatcattgtccatgaacctaattcagctcaatg
gtactatggtatgtcatggggattaagacttatgtcccaggggtcgatgttggaactatgttcaccatccaaaagaaaattt
tggtccctggagcccacccaagccaatcggaccttttaactgatctaggtgaccctatgttccaaaatcaccctgacaaagtt
aatttaactgtgcccccaccattctcagttcctaagacccagctacaaagacatcaactccaacccagtctgatgtctatact
tggtggagtacatcattttcttaacctcagccagcctacactagcccaagattgttggctatgtttaaaagcaaaaccccat
attatataggattaggagtagaagtcgcacttaaaggtagtccttttatcctgtcatgcacaacctcatgctttcacattagga
gatgtgtctggaagtgcttcttgtctaattagtactggatatgacttatctatttctccttttcaggctatctgtaatcagtc
tctgcttactcccatgagcatctcagtctcttaccaagcacctaacaatacctggttggcctgcacctcaggtctcactcgct
gccttaatgaactaaatcagaaccccctcttgtgtgttctagttcatgtccttccccaggtatacgagtacagtggatcagaa
ggacaactcctcattgctcccccggaattacatcccaggctacgcagagctgcccccactactggttctcttttagccggtct
tagcatagctgggtcagcagctattagtacagctgccctagttcgaggagaaactggactaatgtctttgtcccaacaggtag
atgctgatttaaataatcttcagtctgccatagatatactacattcccaggtagagtctctagctgaagtagtacttcaaaac
tgccgaggcttagatctgctgttcctctctcaaggaggattatgcgcagctctaggagaaagctgttgcttttacgccaatca
atctggagtcataaaagatacactccaaaagttcaaaaaaatctagataggagccaacaagaacgagaaaataacacagcct
ggtatcaaagcatgttcaattggaacccctggttaactactttaatcactggtttagctggaccatcatcatcatattattg
agtttaattttttggcccttgtatattaaattggttccttgattttgtaaaacaacgtattgcgtctgtcaaacttatgtatct
aagaactcaatataaccccctttgttgtaactgaagaatcaacgacttgattcccctaaaacacaagtggggaaatgaaatgcc
taacggtgttttttactttaactcgttactttgaattttgtcctgcttgtctctttaatcacctaaccttgcttctcatgtaaa
taagactctctctagctaggaaagccagacaaactccaattgacccccttagtttacaagacactaagggctcctcacccaacc
ccctttcgtgaggagttggcctgggtaaaaagatcctcagcatttcaaaggagcccaattaactgataaggtacccacaccaa
caatgtatgaagttctccaagagataacaacatgaaacctttgagtttgtgtccggcatagaccctatatct
aattataataaaagatttagaaccttgcacctggtaccgttgctcttcttgtaaccatttgtcttttaagttgtttatcactc
tgtaactattttgattattttgattcttgcatgtttttacttctgtaaaattattacatttgagtccctctcccccttcctaaa
cctaggtataaaatttactcgagccccttcctcgtggccgagagaattttgagcatgagctgtctcttttggcagccggcttaa
taaaggactcttaattcgtctcaaagtgtggcgttttcttaactcacctgggtacaacagtcagctggtggagtctggggga
ggcttggtagagcctggggggtccctgagactctcctgtgcagcctctggattcacctcagtaacagtgacatgaactgggt
ccgccaggctccaggaaaggggctggagtgggtatcggtgttagttggaatggcagtaggacgcactatgcagactctgtga
agggccgattcatcatctccagagacaattccaggaacttcctgtatcagcaaatgaacagcctgagggccgaggacatggct
gtgtattactgtgtgagaaacactgtgagaggacggaagtgtgagcccagacacaaacctcctgcaggaacgttgggggaaat
cagctgcagggggcgctcaagacccactcatcagagtcaaccccagagcaggtgcacatggaggctggggtttgttcctgtc
aggatttgggacttcctctgcttctgacagtttctctagggaaactcttaatttttagatttctgtcccaccaatgtcatct
ctacatttttttaatcattgtaatatgatagggacttattctcacatgcacaatatgtatattgccacatacgggaatgaa
aactcctcaaccatggtcaccagcatcagagtcgtgaggaagctcaggggtgcctggtgagtcttccccagtcagactcagga
cagtaacctcaaggggattcccttgtgagaactcacacactttcatgagaacagcaccaggagttggttctaaaccattcatg
aaagacccactccatgacccagtcacctcccaccaggtcaccccttcacaattgaggattataatacaacatgagatttgggg
caggacacaaatccaaaccatatcagatacacattgtgaaatgctcatgatggtcagggtaatttgtatttctatcacctcac
agcgctaccattttattattttttaaattaaatgcatgagtgagtgtctgatgagaacacctcagatatacccttttcagcaa
```

FIG. 7 (Cont. 24)

```
caatcattttttataatacagtattaactataggaccattgctgtacgttagatctccagaactcatccaacctgcacaactga
aactgtacaatttaacaaacatcacccgatttccctctcctcccaggtcctgagacctctattctgctctctactttcaaga
gcttgaatattttagatcccacatgtaaatgagatcatgcagcatttgtctttctgcatctggcttattccactcagcatcat
gtcctccaggcccatccgtgttgttgcaaatgtcagaatttccctcttttcaaagccaaataaaatacagatttatgtataca
cattttcttttatacattcatccatttacagtcattaaattattttgcaaatctacactattattaataatcttcaatgaacac
gtctttggcaaagtaattttatttccttttgcatatataataagaaatgggatcaccagattatatgatagctttattttcaac
ttatcgagtaaccaatcctaccacagtgtattcccttttccctcacattcttgccaatatttgtcatctattacatttctgata
ataaccatattaactagtgtgaggtgatatcgcattgtgcttttcatttgaattcctctgataattaggaatgttgagaacct
tttcgttttctgtttgccatgcatgtatcttctgaaaaaagttatccaggtttttgccctttttatcagttcatttgttatt
tgctattgaggtatatgggttatttatacatttagatagaccttcttgtcggatacataattacacatagttttcctgtgct
ttgttgttaaattcaagaaatcagttccgaattaatggcaggaattttttttgctccatgtgatttatgagtttatggcttc
aggtattatgtccaatattagctgatttttttatatgggagttagagaaggcctaattttatttcttttgaatatgaatgccag
ttttacaccattattgaaaagactgtcctttctctactgtgtgctcttggcacacaaaatcaggagagacataatgacaaag
aaaatatcagatgaatattcctgatgaacatagacctgaaagtcctcaacaaaatactatcaaatagaatcagaagcacttt
aaaatgtaatacatcatggtcaagtgggcttttacccctgggatgcaaggctcgttcaatatccacagtaactgtgattcacaa
tgtaaacagaataaaagcaaaaaccatatgattatgtcaatagatactgagaaagcctctggtaggttctaacatccactcat
gataaaaaccctcaacgactagacatcaaagaaacgtacctcagaataatagccatctacagcaaacccacagtcaacacca
tactaaatgagccaattaaaacacttgtctttataaattacccagtctgaggagttttctttatagtgtgagaattgactaata
cagcatccaaataggaaaggaagtcaatccgtccaccttcagcgatgatataattctatacctagaaaatcctaaaaagtctg
ccaaaataattctagaataaacaactttagtaaagtgtcaggatacaaaatcaatggacaaaaattaccagcatttctataag
ccaaccacatccaagctgagagtataatcaagaacaaaatcctatccaacttacagtatccacagagaaatgaaatgcctgg
gaacacagataacaaacaaggtgaaagatcactacgaggagaactataaagcacagcagaaataaataataaatgatacaaat
aaatgggaaacatttcatgctcatggattggaagaatcaatattgtaaacattgtcataatgcccaaaggaattcacagattc
aatgctatttacataaaactatcatcatcatcttcacagaatcagaaaaaaatctattctaaaatttatatggaaccaaaaa
agaccctgaatagcagaagcaatcctaagcaaaaagaacaatgccagaggcatcatgatactgaccttaaactacaccataat
gtcttgctaacaaaagcagcttggactggtacgatagcagacctgcagaaaaaaaaaatagatcaaaattgaaaacagaaat
aagttgcacacctgcaaccttttgatctttgacaaggctgacaaagcaattggaaaaaaaaaaatctctgtattcagtaaat
ggttctgggataactggattctgcaggtcttgcagaatgcaagagtgaaggagcctgtccagcttctacctagatttcagat
gttagagagccctgcatgcccaggaagaagcctgctgcagcagtggatccaccacacaaagcctctactagagcattgccaaa
gatgggaaagatggagttggagccccattcagagtccccactaggacgcttcatagtaaagctgtgggaatgtggccacaa
ccctcaagaccctagaatggtagagctacaggcaacttgcacctcagcctagaaaagcttccagcacttgactctcacttgt
gaaggcagcccgtggtctgtgcctagcaaacctatagggattggctgcctgaggttttggggaccccaccccttgttccagtg
tgccctggttgaagtacataaagtcaagagagattattttgtagtgttaggatttaatatctgcagtgctggttttatatgt
gtgtgaggcctgttggttgttccactggccaatttatccctttaggattggaattatttacccaatgcctgcaccatcattgc
accttggaagtaaacaactttcattttttaaacttgcaagctcacagctggagggacattgccttaagactcagatgagacttt
ggacattttagttggaggttgatcaacttaacattttgggaactattgaaaaaaggtgattatattttgcagtgtaagaagaa
tatgagaactttgggtctgagagtgcaatgatatcatttaggggttttccctccaaatgtcatggtgaaatgtgacccacaa
tgttggaggtggggccaactgggtggttttgggtcatgaggagattttcaggactggcttggcatccacccccatggtaatta
gtgaattcttgctgtatagctactgtgagattttattgttcaaaaaagtctggcaaccctcctacctctcatgtccccct
cctcaccatatgacacagcctcctccccctttgccttccaccatgactgtaagcttcctgaggccctcgcaagaagcagatgc
ttgtgccatgcttctcacacagcctgcagatctgtaagccaaataagcctcttgtctttgtaaatcacttggcctcaggtatt
aatctataccaatgtaaaatagactaatacactgcccaaagcaatatacagagtccatgcaatttatatcaagtaactaatat
aattgattacatatttttaaaaatcctaaaattcatatagaaccaaaaagggtctgaaaagcaaaagcaatcttgagcaaaa
agaacaaagctggaagtaccgcattcctgacttcaaattacacaacacaaagataacaagaaaggcagcgtggtaatggtag
aaaaaaatcaagagcccagacatacagccaaatatctacaaccaacggttctttgacaaaactgacaaaaatatacactgga
gaaacaaccctctattcaataagtagtgctgggagaattagatagccttatgcagaagaataaaatgagacttctgtatcatc
atagacacaaattaactgtgaatatggattcaatgtttaaatttataaactcataaaaattcctgaagaaatctaaaaaaa
tcctctagacatttgcctaagcaaataaaatatgactaagactgacttcaaaagcaaatgcaatgaaaacaaaattagacaaa
caggattaattgaaacacagattgtctgcatagcaaaagaaataaccaacatggtgaacagacaacctgtgaacagtaaaaaa
aaatttgcaatctattcatcaaagggctaatacatagaatctacaaggaactcaacaagaaaagtcaacaagaaataacaaataact
tcattaaagagtgagcaaaaaccagacatttctcaaaagaagacacagacgtggccaaaacaaataaaacatactcagcatca
ccaatcatctgataaatgtaaattacaaacaacatgatatagcatcttccaccagtcacaatggctgttattacaaataaaa
acagcaggtgtttggagagaagcataggaaaataatgcttttatatgcttggtgaaaatataaattagtacaacctctatg
aaaaacaatacagaagtttctcaaagaactaatattagaattaccgtttgtcccagtaatccctcccagtgggtatattcctc
ccaaaaggaaattttatatcagaaaagtcacctgcattcctagtgtcttcacagcaacgtgaatagagttgtaggacatt
agcctaaataaaataactcaaaagatcttctcttttataattggaaagtaaacaatgggtacacatgtacatacataaaaaa
caaaagacactggaactgcaaaagagggcaaggtgagaggaatgtgagggttaaaaaatcacctactggctccaatgttcac
tagtgggcgatagttacaccagaagcccaaacctcaccttatgaaatatattcatgttacaaaattgcacatgtacaccctg
attctactgaaaaaacagaaataaaacatgaacagaattgttagactgctagctagatttgtcaacaagaaaaatgcaaaa
ggagcaattctctgttttggaaccctttctcatttctggtacaattagaaattgtagactaatccctatattctcttctgaa
gcctcagcttagccattctcaaagacatgctggttccttttttttttttttttttgagacagggtccagactcactg
caacttccacctcctggttcaagcgattctcctgtctcagcctcccaagtagctgggattacaggcatgcgccactgtgcct
ggctaatttttgtatttttagtagagacagggtttcgctatgtgggccaggctggtccaaactcctgacctcaaagatctgc
ccacctcagcctcctaaagtgctggaattacaggtgttagccactgcacctggtcactggttttcttttatagaagaatagtat
taaaaactcaaatcttgattctgggtgtatttttattaatgtgcactcatttcttgtagaaattctcaggtaaaaatctag
gaagtatgtgttgtgtattaacccatatatacacagacatctaaactattttttatctaatatatgtacctatattatgctaaa
```

FIG. 7 (Cont. 25)

```
cttgcaaataaaatgacatgtccaccctaagttaataccacatggatgtttatcgcattccttctatgcctgacactaacctc
ccactccaaccacaaggaacccccatttccccatacgccgtccattctctttgtagtccaattccaagattcctgtggagtgta
acaagatgtgtaagttgtgctcttttgtggaacatcgtcaattggggtacaatgctgatgtgaagttttctttttttctttaatc
ttattgcctacaccatttctgaatctacttagtaccctcttttgaattcatacattttgtaattggaattagacattttctatgtt
atctgcattccatcctggaattcctaatcacctattttaaaaaaaattcttttgaagtaagattgtattagtcagggttccc
tagaggggcagaacaaacaggatatatatacgcacacaggatacacacacacacacacacacacacacacacacacaca
gagtttattaaggagtattaactcgtatgatcacaaggtcccacaataggccatttgcaagccgaggagcatggaagccagtc
cgagtcccaaagctgaagaacttggagtcccatgttcgagacaaggaagcatccagcacgggagaaagatgtaggctggaagg
ctaagccagtctaatcgtttcatgttcttctgttgttgttgttttttttttccctctggccacactggcagctaatgagattgt
accaccccagattaagagtgtgtctcccttttgagcccactggctcaaaagttaatctcctttgggcaacaccctcacagaccc
acccgggatcaatactttgccaccttcaatctaatcaagttgacactcagtatttagcattacaagtccaccccgtcaacttg
aaaccatacacatctcctgagattatacataatcttcaaacaaagacaataataaagtcataattacacctaatataatacaa
ctttattcgttcaactggaaatgcaccaatcccccaatccaaatgctattacatatggtccactccctcaaggacacagccagg
atcatcctatgacttggtgtctagaagactcatgcactttttaattttacctccaatattagactccactttatcacatgcaga
cactgcagaatattttaagacatcgatgtcttatgctgaaaaattcaacagtacataaaaattgccttcccaccacagccagtg
gttactactgaataaggatctgccatccccctagggaggtgctatagtggatggtgtgcactgttagtagctatggaaattgat
ccattgtggcaaatggcagcatctttcttttataacattaaaccatattatattgtatacacataccacattgtctttattca
tttgtctgtatgctgaccatcagatagtttccatatcttcgctgttattaacagtgttcaataaacataggatgcagatatg
tttacaaggtggtaatttcatctacttgggtatactcccagaaacaggattttctggtcatataatatctccagttttaattaa
tttaggacgctttatgttgcttccataattgtggaaatgtagaatggtatagccattatgaaaaacaattttggttttgagt
tatgatccataaacagcatttgcttatggctctcaatgagagtttctactaaatatgatggaaggccaggaaggattctcacc
ttaaagcttggatggattatgaatttacctcttatttcctaaaagcaaaagtttggaagcatacatgatggaggctgttggca
ggtttcaggatgatctcataaaaggagaatctgctggataaaaatgttgggttttcagttatagacacacctacactcaatat
gaaatgatgaagtcaactgaggatctagaacatgttcacttgaagcaacagcacattctcaaaggaacttattgctccatcac
aagggcgatgaacttctgaaaccagtaaagtgtgagtgcacagtaagtgataacgttatcacgtttacatgaagtttgtttaa
tgtgccaaaggctggtacagattaatcttacacaaatatgaaacatattttccatacatagatatctagaggataatcct
cttagcaaaacttcttcaggttacagaaatctgtgtaagttgtagatctcatggggaactgtctctttataaatactggtctg
ttttcaagtcaggaaaaattatctctgttggagtaggcttccaattgtgtagacttctgaattgcttcttgagttgtaacaa
atgaaccaaaaatttgactaattggagttttgtggctgtcttaataaaaatttcttataagctttctttcaattatttgaga
ccagttttcctgattttatttttctccaatagataaattttcacaagatctcaggaaaccacctctctggctctttagtttaa
aagactagcttcttaggaaaagaagcttcttttctaacattgaagagctcatttattctgcaaaccatgaagtttgagtctcat
tgtcaagaatcatgaaaattttttactccaatatactgaaagtcatgactcttgaattcaatatttattggcattcacaaaagt
gattcattctcagatgtgtcctatgttgctggcccaacatatcagtgaactgagtatcctcccttagctctctctgtctgtag
cactgagtctacaatcttcagagtcatccatgaaggggagtcctgaggttcatgggattcttgtaaacattcaggtcaacaga
agaaataagcaggattgagggctgccagccatttccacgccattaggaataattaccatctaagtataaaggtctacatcata
cagaatacccccacaggataggctgatgcaaaaaattccaaccccacagaggctccacagcaacccttacagttctttcaggga
aggaataatctccaagttaaatgagtcagtaaagctgctctgagctacaggaaaaattggatttggccaggtttgtctgagtt
caacgtgattattatactcagctcctgctccaatctggactgagtacggggaatttaaatgagcctggctgtgtggtttgtta
tatgaaaatctgaactatataaacataaatggcatgtctggactagcatgagggtgagagatccgggaactccaccccccat
actcttatcgcccttttcctccaggaacctccaggttctcaggtggagaatccacatagatcccttcatggctctatttctagg
aaaccaaatctctaataaatacacccagacttcttcagacacagaaaccatgggaaaggcatctctagatcctcatctatgt
ggggaaaggtaatccatcccccattacaagcccatactagcaggcttcctttatcatgaaaatgggtaaaattagccaatagat
gtaaatttaaagaaaattttcctgtgatgctccagccagaaaagagcaaaaatcagcttcacttctggagacttcccgtatagg
tcacagcccagagaagaagatcaccacagcattaaaattcagctgtaagaacatgtaatgcttccgtgttccacacattatg
tctcaccagtttagtcaatatggattaaatacgagagtgtggcaatgcacaaactctatctgaggagaaataggagaaaat
gttaaggaaatagaagaattcgacgcctctaataccaggaacttcagcacaaagaaaatgatttcacccttattggcctcaa
atttatttttcctgtggcatctgcagggttccaaagtgagaaaaattaattcactgtgcatgcacttccgaagtgtccacttg
cattctgatatctttacttctatttgcagaaagtagacacatattcagccttagtgccagtgtagggagtgctttccgtgaca
tggataccagaaaataggggtaaacataggggccattaatgtgaaaatcagacattgtgtgtgtgtgtttgtgtgtgtgtgcg
tgtgagttgaatagtagagttggagtggggcttctatccaccctacacctgcaggtgtattctcaggtgccataatcaactgcagga
ccctaaaggaaataagagtccccccaaaccctgaagagtttttgggttcaccgtgtgtccaatgattcagtgcctcttgagc
tctaggaaagggctcccccagtgatgcatgagatcttcttggggtctccctgcagagttcactgggattcctaaggccaattc
agtatttcaaaagatggtgtgagaagcacaggctgtcactaaggagaattctgagccagggcacagccactttatacttggc
tggggacactggtaggaatatactctgtgagatcagacaggaacctccttgcaggggcagggcagggctgcaggggcgctca
ggacacacagagcacaggcttccgcccagagcaggtgaaggaggctggggagggggttcctctcagggcctgggacttcctttt
aaaaaatctaaaataagtatttcacaaggactgccgatgtttatataaatatcctattcaattgtgagcatttatgaaactcg
atgttgtaatgagaaccacttttacaattggaatttcaaacttccctagacatcttaatagtaagcagctggaggtcaggagg
agatcctttcttataaataagtgcaatttgggagaaaacactcattcccaaaatagcacattcacatattaaggtctagaa
atgattcgagttgccctgagacagtcaaatgtgggttctaagtgaggtgcgtgtcctggggagcttgttctccagtgggg
aagctctgtcaacacagagttcagggatgggtaggggatgcgtggcctcaacaggattacggcttgaaccctcagcttctac
aattgtgtcgtccatgtgtcatgtattttgctctttctcatcctgggtcaggaattgggctattaaatagcatccttcatgaat
atgcaaataactgagtgaacatagatatctgtgccctgagagcatcaccaaaaaccacacccccttgggagaatccc
ctagatcacagctcctcaccatggactggacctggagcatccttttcttggtggcagcagcaacaggtaacggactccccagt
cccaggctgagagagaaaccaggccagtcatgtgagacttcacccactcctgtgtcctctccacaggtgcccactccaggt
tcagctggtcagtctgagctgagtgaagaagcctgggcctcagtgaaggctcctgcaaggcttctggttacaccttta
ccagctatggtatcagctgggtgcgacaaggccctggacaagggcttgagtggatgggatggatcagccgttacaatggtaa
``` acaaactatgcacagaagctccaggcagagtcaacatgaccacagacacatccacgagcacagctacatggagctgaggag
tgagatctgacgacaaggacgtgtattactgtgcgagacacagtgtgaaaacccacatcctgagggtttcagaaaccccc
agggaggaggcagctgcactgaatttgaggagattacagggcttacaatgtttaaagttgtttagaaaatgagctgagcaatt
gaggaatgtgagtaatggaaacatggatgcactctatataggaaatgtttctttcaacagtccacctatatgcaaaattcaga
atggtaaaggcagcaatcagtgaggctgacgcaaatattcccatggaggccttgtgcagacataccgtttttaaaatcagata
gataaataatttggaacaagattgctggtaacgtggctaagactaaatatgattcctaaaaactggccaaaatctattccaaa
ttgtctctgccactccttttacataaatgtattaaaaagtagttttaagaccacagcaaaattggacagaaggtgcagagagt
tctcatgtgccctgcttcaccatgcacaggctttcccactgtcaccatcctgcccagagtcatcaataagttacaatggat
gaacttacatgggcggattggttcttttcctcttctggtggtctcttggcataccaagcccaaattatcttgaagcaccatagg
ttctactgtaatgcctaaccttgttttttactctagtttgctactttaaatttttccctttttttgtctccttaattgccagcc
atgtttcccatatgaatagactctccctggctgggaaagctgggcaaactccatttgacctttttgatttataagacattaagg
gctccttacccaaccctcttcttcaaggaattaacctgtgtaagcagatcctcagcatttcaaaggagcccaattaactgata
aggtactggaacaaacaatgtatgaagttcccaggatttttctcaaagagataacaacataaagccttgagttcatgcccagc
atagcatcatatctaactataatgaaggatttagagccctgcacctggtaacgttgcttttgtaaccatttgtcttttaaat
tgtttatctctctgtaaccatttgcttcttttgattcttgcatgttttactctgtagaattattgtatttgagttcccctc
ccttcctaaaccaagatataaaagttaatcaagccccttcctcgggcgcgagagaattttgagcgttagccatctcttcggc
agccggcttaaataaaggactcttaatttgtctcaaagtgtggcgttttctctaactcgttgggtataacactacaagtggg
ttcctgggaatgatgccagttcagaggaaaagtgggtgggctattcatatttgggctctttttagaagattcataaaacag
atatttcctatacgttctgtgactcctgatttactatccttcccagagggtaaggtccctaagtgttttgcggtatatcca
tgtctatgaaagaaagcaagttctggtgaatcccgtaaggaatgtcctttgatgagaagtggagaccttggtcatgaggcac
atcatgtatgatttctataattccgttagattcactgtaattttgggggggtgtcctgtggaatgggtcttctgtgtccctgc
atgttcagctatatctgtgtggtgccacttacacttaatgagatgagattcctgctgcttgtatcaggtcactggtgatctct
gaagctgcttctggtttctgctttaatatgtaaagagcatgtcaaacatcacccacattcttacaataataaaagcctggaaa
attgattatcaataatttcttgaatctgttgaagaaatgaaattgcagggaaaaccaggaccccccaaaactagaaagacatta
aaatagagataatcagactgatggatcaaagttctgtggcaataagataccaaattataaacaaggcctaaagtcatggatta
agtcactcaccctacacttaaaaaaatgactgtactgtaacttccacagggcttttttgttttctgtagcacctaaacaagc
actggttctgaggtaagcatattaaaacattgcagctcatggaactccaaacgtggtaactgctgaccctctcccacaggccata
aatagagctttgtttggacaagagacagatttcagtaactgtcttctgagaagagactactgaccatgaacttgtcctggcaa
tttacagagactgtgcagtgtgtgtctttctgcctctgcacaaagcccttttgatgaacagggcccgattgtcattcatttag
ttcttaagtcctcatccccaaagcaaacactaaatgcatgtaacatgtgtgtttgcttattagacatgagagcctgccacta
tgtgaacatcaacaagatccttctatagcctgctgagtgtgtacacttggccaatccatttgcatgaattcatttctcctctt
tccctctcttgaagtgcctgctcactgtctctgtgggaggctttgcttcccagcctgttaaggtggctgtcctgcagcttaa
ccatttctcagaagtaaagtctcctttctaaatttataaattatgtgactgttccgttgaaagtgcaagctggtgggaacagt
tacatggtaattcggtaaattgctggtggacaggtgtggacagggatagggtaagaactcctgggggctgcacacccccacact
tcgatggaatttccctccagaaacttctgggttctcaggatgataatccaaacagattccttcatggctctgtcatcaggaga
gctactctcttgataaatatgctcagaacttcctccagacaagatcctacagagaaaaaatgcttttcaagatcctctattct
atgtgagggaaggtattctttttccatcccaggcagtttcatcttagccttcctgtgtcataaaaaggtcaggttcaagacaa
taatatgtggatgctgcagccaggaggggggagtagaagacggaggaaaatcagctgcaccactggagactccttgtaaaggg
cacagtctagagaaaaaacatcaagaaaacattgaaatcaattccagtacatatactgctccctgcccaccacatcacctc
ttcaccagtatgatcaatctggattaaagagaaaagtgtggcaatgcacagactctgtccaagactagaccttagggaaacc
aaaggcagagggagaggaaaagttaaggacagtgaagcggtttaaagcctctgagaccaacagcttcaggaccaaggccacgg
ccctctgtcaatggccttagatttacctctcacgggcatccacagggttcccaggtgagaacaggcaaaaacaaggtgaag
acactttccaaatctccagcagtactgagcttgctttagctctgtttgaagaaacaaaacaacaacaacaaacaacaacaacc
gcaaatataaccaggattaaggtcagtgttggaagcacttttattaattttttttaaattttttatttctcagatggggtcttg
ctctgtctcccaggctggagtgcagtggtgcggtctcggctctgcaacctccacctcctgggtcaagcaatcctccaccta
gcctcccaagtagctgggattacaggtgcatgccacgcgcccagttaattttttgtattttttagtagagacagtgtttttcc
atgttggtcaggctggtctcgaactcctgacctcaggtgatccgcccaaattgccctccagagtcctgggattacaagttaa
ttgagttaataaagctgttctgaactatgaaaaacattagtttgctcccagattttcttgatttcagtttgattattatattc
agctgctgccctaatatgtttgagcatgttactatttaaatgaccctggctgtttgatttgttatatataaatctaaactaaa
acaactcaaaggacaggtttgtactattattaggatgagatatttcgggtgcccctccatttgctccatgaactccacatttt
taatttagaattcacataaattccttgtgagttgtgtcagtcatcgagagacctaatctctaacacctttacccagaaccttc
tccagatagaccacccacaggaagaacatttatagtaaattatctacatggtggaaggtacttcactgccattgtagaaccct
cttcccagccttcctttatgaggcaaatgattgccagtatggtaagattgaacaaaaggatgtgccagtagggtaagattgag
caaaaatagtcctgagatcctgcagacagggaaggacgtaatagacaaatatcagctttattagaggagactccttgtaaagg
tcatagccaagaaaagaagacaaaatcactgagattaaattctaagaatcttggtccagttcaatcaagccatcaacagcca
ggtggcttcagtggccactatgcatattacccccatgcctaaatgttctggcttgtacaaagagcttctctgtaaattgcacat
tgccatagtggaagatggcatgggagattttgtgacaaacacttaaggtgcaataatagctatttttccttttatcatgacaat
atgtggcatgcttctagattcatttcatgccaaagaagttcctcagaagggtaaggaaatggagaatcttacacggtccaatg
cagtccccaagaagggactttgaatgacagttacactggttactacgatgtgtctctgaccttctcaggatcgaagatagtc
atgagtatcaaggtggagatggtctaggtgagagaaaggaagtagtgttcttagaagatggtatgccaagataagcctgacta
tctctcctcttccagttcctgcaacttcatattgcctgattgagtcacttgcctatggtgtaatgacatcagcaatgcaata
aattctctggtgctttatatctggtttataacatgggagatgtttcctcaagagtggtgatgccagtgtggcttctgctctc
tggtggtgttggaatctgtcattagtctgtgggtttggaggaaggagattgccatggggaagaatctgacactctcacaccc
tctgtgccttcggtactggactgctcctgccctcactatggtgattgcatcagatattgcctcccaccagacaacacgttaa
catggctccttgtacctggctttaaccaagaaagttgtcgacttgactcttcgtgacattgtatagcctggttttgtcacaatc
tttatttcgggaattatcagtgctgccatcttggctgtcttcaagtatgtcatcctcacagtgtgaagctgtttgacattaac

FIG. 7 (Cont. 27)

```
attttttgtcaatgtttgggactaccttacatattccggctcagttcaaaatgagctatgtaatgtagccaggtttccactgag
ttccactttgcttcttggctgtctattcctgcgcaagtttctatgtattttgtatcaggcttcaattccattatgtttaaat
gttgtctctaaagataaacaaagatttttttaaaacaaccaaacatgcagccatttgaccgagtgtggtctgcattgttagtc
tcaccatcttctgccctaacaagcaccgaatctaacaacaacaaatatcatggaagctttccttggagtagctcctgtaattag
aatcattgtattctgccctcctgtcagtggtggaacgttctattggcacatgtggaaacctcttagagggacgagtttcttg
aacacaataaaatttttaagttaggaataacttatttgaaagcaattcattgaaggttattgctaagaagttagaaacagtctt
ttggcagtcatttcttcaagatgtatggcagtgtgggagggatatataaagtggaataggaacttgggctagttaaatggaat
agcctccaatgttaatctgtttaccttttaactgaatgaaaaagcctatagttgtaagaaaagaaaaaaaacacaatcctcac
acattcccttcccatcagcattgaagatgagtgtggcaatgcagagactctatatagggaggagaacatagggaaatgcaaag
acaatgggagaaaaaagtcaaggacagtagagcaactggaagcttctgacaccaacagcttgatgaacagggtcactcaaccc
ttggtggacacagagtcacttctcttagggaaactgcagtattctcaggtgacaatatgcaaacatgatgaatgtacacttgc
tacgtctccagttgtgtactgttttccttacttctgtttggagaaggaagtcatatactcaggtctagtatccgtgtagaggg
tgctcaccatttgcaagatactaggaaaaatggcaagttagaggcccactgttgtaaaaatcaaccagttctgtgtgtgtgtg
tgtgtgtgtgtgtgtgtgtgtgttatagaaaaagaagacatggagtgggcattgatccacaagtatatatacctacaggta
ttcttagatgtaatattcaattgcaggagaccaacaagataaagcatccccaaacccttgaaaattttttgtgctcactat
gtgtccactgattaaatgtatcctgagctccagggaagggctccccgatggtttcttagagttcactgggtctcctaaggtca
atgtttcaaaagatggtgtcagtaacatatggtgtcactgaaggagcattttaaactagggcatgacctcttcctatagccc
tagagacactgagagagaaatcctctgtgagcccagatgaaacctccatgcagggcagaggcagtgctgcaggggcgccca
ggacccacccagaacaggctccagccccagagctggtgcacaggaggctgcagaggggatttctcccagaattgagtgttgtt
ttattgaaaaccaaaaaattataacatgttaaaattagaattttgcaaagactatttctattatctctatacatttagaaata
aacaaatcaacaattcagtgagaaccacatttaaaaggcaaaattgttacttgtttgagatattttcctagtaaaaagatgaa
gaacagggatggttttattaaatcaaaaggtacacatttcagaagacgcagagatcccaagagtaagactgcagacagcaaag
cctagaaagggcggaggctgtccatgtgccatgtcctgtgtgagtcaccttcttagtggagaagttctcccttcacaaagttt
tgggcatataaagggaaacacgacattaaataagaacgaggacttgtacctcagcatcccacagttgtgtggttcatgtgaga
tctattttctctttctcatgctggatcaagggtaaggctatgaagtagtagttctcgtgaatatgcaaatcacctgaggtgaa
cactacagatatgtctgtgccctgagagcatcacccaataaccacacaccacaaagacactcgctgagaagagcaaccctaag
acacataattgtcagattcaccaaggttgaaatgaaggaaaaagttttaagggcaaccagagttgtgccatgtgcacagtgttg
tgccatgtcctttctctgttttcttgcctgtttattttatgtcagatgtgccacctacatggaataaggtcagaattctgcctc
cagtaacacatcaaaggtgacctttgattgtacttttggtttatgctccaaaatattgattataaaattcatcaccgtcatat
tttatgtcaaaataaatctgcataatctgaatgtcagtacattttggaatctattaaataactgaaattgcaagaaatattac
ccactccaaaaactggagagatgggcatgtccagaatggcagttagcacttgcttacctggtgcagaaactgcagaagccaca
agctgttgagggcacttacatggtaaccactacggacgtctgaaagacaaatgtggactcggtaaatgtgaccgttccagagg
gtcttatacttctaaggtttctggactttctctccagaaacctccagattctaaaatatacaatccaataaattccgatgg
gtcagaattgaagatgaaatgaagatgattaattacagagaaatataccaggagcccacttcaaaagcttctaaagggaatga
cttttccagaaccttatcctatgtgaaggaagacaaatctcccattccagattctcccccattcttccattattatatgaatg
agtaaagttagccaaaaggggtaagacgtacataaatagtccaaggaggccgaaacctcaaaagggagtaacagccaaaaatg
agcttttcccctggagatgctttgtcaaggtcacagcccagaagaggaagcctattgaatctctaggtttccattggaagaac
aggcagtgcttacctgcactgcacaatccattctaactaggatgatggctatggattaaagatgaaagtgtggcaatgcacag
actccatctgaggagaacacagaaatactaagacaatgcagagggtgagacaaagacagtagacaatgtgaagcctctgac
atcgtgattttttaagaccaacatcttgtaaatgccatcatagttctcagcttctttattatggaccttttgctggtttccta
gctgagaaagtgaaaataacaacctgcatggacttcccaagtctccacctgtatcctgtttgctttagatctctaggagaaga
aagtcagataactgggcctggtgtcagtgtaggaggcacttcctaaaagccacatattaggagaagggaaaatgtgtgttatt
ggaatagtggatatggagtgggctttcatttgaatgtatctgcacctgctagtattctcagatgcaacattcaactgcaagag
cccagtgaagaaacatggcactcgcaaatctcttgtaagttttttgtcttcattttggttccactaatgaagtgaatctggagc
ttcagggaaggggctccctcctgtgtcattgaatccttgctctgggtctccctgcagagttcaataggtttagtaaggctaat
caattgtttcaagagatggtgtcagcagcatatggtgtcactgaaggagtattctacactagcacacagccatttcatgctgg
gctagagaagcctggggggaaatgatttgaagtctcagcaaggaacctccttgcaaggcaggggctgggctgcgggggcaccg
agcaggtgagtcagaaatcaatatgtaaagatgaggacctatggatatgaattgaaaatatataaatacttcaaaaaattcca
gtaaattgagtccaaaattaacccccaaattattcaaaacaaaattccttgacaattattttgggagcagtgagttcataaag
aattcaaaactactgtttcagcttctgattcttattgttcctgagatgagaaatcatctctaatcacacatcacacagcaaa
tctgtaaacaagagtgtttctatggaagatcctgggggatctgaacaccaggcaggtgctggagacccctgtttcaggagcgcc
cagcagatctcagagggacctgctggtcactcacgtgggacatcagcagtaactttctcagtcaccagtcagctgtgctggtg
actgatggacccaggacagaaccaaggcacctcctcagtgtcatggagagtgatggttccagaaatcatccaggtgctctctg
tgcttataaaatgtaggttcactgtgaggagcatgttctgaggggattgttctgtgaaaggacctctgttcatgagtgttca
taaatggagcagggcatgcatttcctcaaacaggaatagcgcttggaccatcagcatctcactcttgtaaatctgatgtgtca
tttatcttcccttttcttattattgaccaggctttgcgctatgaaatgctctgtctcatgaatatgcaaataacctgagatcca
ctgaggtaaatttggatgtctgtgccctgagagcatcacccaacaaccacatccctcctctatagaagcccctgagagcacag
ctcctcaccatggactgtacctgggggatcctcttcttggtggcagctgccacaggtaaggggctcccaagtcctagtgatga
ggaggggattgagtccagtcaaggggctttatcatctcctcccttctcctcacagatgtccattcccaggttcagctgttg
cagcctgggctgaggtgaagaagcctgcgtcctcagtgaaggtctcctgccaggcttccagatacaccttcaccaaatactt
tacacagtgggtgcgacagggccctgacaagggcatagtggttgggatgcatcaacccttacaatgataacacactacgc
acagaagttccgggcagagtcaccattaccagtgacggtccgtgagcacaccctacatggagctgagcagcctgagatctg
aagacatggtcgtgtattcctgtgtgagagacacagtgcgaaaaccacatcctgagagtgtcagaaacccaggaaggaggc
acctgtgctgacacagaggagatgacaaagattattagattaaagattttcttagaaaatgacactaagtcattaaagaaaag
gaacaatattaatgtgtatttgagaaattttaattattttgagagattttttcatacagcatttattctgtaaacaaatttcaat
gattacagaatgaatcaaattaatgaaactaatacagaacttcctctgaaggtatctttgtaaacattaatttcttaatcagt
```

FIG. 7 (Cont. 28)

```
gctgtaagtattttggaacacagacacaaaatcacattttaagtctgcatttatgtctattaaaaatgccaaaaaatctcct
tttgtgcatgtagcattttgaattcccaccatcaatgcatgatagttcttggttttccacattcatattgtcatgtatcctta
tgagaattgtgtgttttaaccaatctagtaggtgagtaatgggatctaattttatttaaatgcacatgtccctccaaaagtt
catatttaacaattttcctataacttctgttgagacgcctctcctgacattcggttcattttaactgcattgcttcatttcga
ttcattgcaagttgacttgcatattgtttataaaagtcatttcacaaattaaaagaattcattcacaaatatgtgacttgga
agtattttctccaagtctgtggctgtctttattcccttatcagtgtgtattgcagaaacatatgtgtgtgtatgtgtctgtgt
gtgtatgtgtctgtttgtacgaatttagactcaaaaacatgtaaaattgcattcattcatagatgatgtatttggcaatatat
atgaagtctcattataaaatacactaatagtgattattttttccatgtctctcaactcaggccacaatcaactcatgagtgtt
taaacttcatctacttgattggaggactatccatttcagatatttggaatacttctgtaaggaaatgtgttcatcttcccaat
atttatttatataatcatctattaatatgtgtattggtttatgaatatatatttcatactctgaagaagatccatgctatatt
attcattttatcgttcaaatcaccacagcttattaggtcctgggagctcatttaatttggatcctgtatccttacagcacac
ctcatcctttgtttttgaatacttccctgtttccttgtattacaataaattctaagctcattttctatattaccttttttgt
acatagaattagcctttttctaaagattgcttgtttctaatgttaacgaatagcagtaaaataaaaaaaattgtgataccgt
gtataattacttctaggacctctcaacctactggcctagtagacgtgcatgtttatatgaacccatgtttgtggacgcatcaa
aactatttatgtaactaatcttctgtaacttttattatattaaaaatgagaacacactggtctcctgacccaactatgctacca
catggaccttctagccttccttccttgactgtccataaccaccactgcaaagtgaggaatcctatcctaccaactgcctta
ttattacctagttgcacaatttttaggacacatgcatagcggtatcagaaatgtaaagctcattggaaatatatttatctacta
gaatagagtgttatgtgtagtttctttacatttaaacttatagaatttcctcatttccaaagttaattagattagcaacttc
atttctacttctttagtgaagtcatttcaattacattatataatatcatttatttgaaattcggtataaaccaaaactata
gtcaagtaaacagatagaggatattcaaggaacttagagagtgagtattaaataagtacaaatggcactgtttaagaatagta
aaattattttttagtgatataaaatggttgagacacgatgcagttaatttgtctaaactcataaatgtgtgatgaaaatataa
acctaaatatatacaattttttgtaaaaagtatttagcagttcattaaccccaggattaaatgcagactgtatcaagttatcta
ataacttatttggtgagggtggggatgtcatgagatgcatgcaaaaaagaatgaagtaattttcctcatttgcgtttaagatg
ttaccattcactaaagacctttaatttaaaaaaaatcaattttctacgtgacccaggttttttcttcctgacgagcaaataac
ccagataattcttttctttccttggttgagaaagattttcccaaacttcagctcagttcaggcacacactgtccctgaatgg
gcatttaccctcagatgggtaacacacctgtcaacatggggactcttctgtcagacaaacacaccttttactcacgtggattct
tccctcagaccaacacaaagtccccacatggactcttttcctcagaccaccacatatgtccttacatttactctttcctctag
taatgacatttcctcatgtggactcttgtctcagacaaacaaacatgtctgcatgtgaactcttcactctgataagtacaaat
atttccacagtgactgtttcctgacacaagcacatatatccaatgttgaactgttttatggcaaaatgatctcaagataataa
ttataaaatccctcctgacaaggtgtagatctgcatttttttattgtaccttaactttgccttattgtcaagaacaatagttt
gcagctctatatgcaccgattagagattggtgtccatttttctctggaaatgtatttttatattcttactggatgtatttttt
gataatgtttgctactgtgaagatacctgaacagggtccacactagaaaataaaaaagactaatcggcagattaaccctgtgc
atccagacccacgagtcctttgatcctgcccccctgaaatggagacacagaggacagatgagcaatgctgagcggtgcaccca
agaccacaaaaagaaagacaaggaaatgtgtccctccctcctcatgaaaggcagctcatccctgttccttcaggccctgg
tgaggagccaacccatgtctgttccttcctcggtgtccacaccgtgggtctgccctgatttgggcttcccttctcatcacc
ctcaatattagtgtcccttgtgaatcaggtccagctgcggctgctccacatggggccgttcttccatttcctctgtgtttgca
gaagtcctgtgtgaaatttactgatagagtcaggggggaaaattgtacagcccagtggttcactgagactctcatgcaaagcc
tctgatttcaactttactggctacagcatgagcttggtccagcaggcttcatgacagggattggtgtgggtggaaacagtgag
tgatcaagtgggagttctcagagttactctccatgagtacaaataaattaacagtcccaagcgacacctttcatgtgcagtc
taccttaaagggaccaaactgaaagtcaaggacaaggccttgtaatactgtgagagacacaggagagggaatatctgcgtgag
cccagacagaaaaatctctgcaggaagacaggagggagctgcatggtagatgctcctcagaaccaccagggcaccttggggac
aacctgggggcactcagaaccaccagggtgtgcttaggaccacgggacactcaggatattgggggtgctcaggatcacgagg
gggcgctcatgacaccaggggacactcagaatcacaaggggggcgctcaggacacgagggtttgcccgggaccaccagcaggca
ctcaggtcaccaggggggtgctcaggaccaccaggggggcgctcaggacaccaggggggcgctcagaaccaccaggggcgctcag
gacacctgggggcgctcagaagcatcaggggtgctcaggatatcagagtgccctcagtaccacgaggggcgctcatgacacc
aggggcactcagaaccaccaggggcgctcagtacacgggggttctcttaggaggcagctccaaatcagaagcctgagaggct
gtggttttctttaaaccttggtgattcccgacctggtcaagcaaaagtcttcccaggatctctcaccatttcttccttgta
agtccatgattacttttacctacaaaacattaacttagaacaggaatttaattcaacttttaatgctgcatattttccaagta
atactagcaatgatcctcaggacaattttacaataggttatttatatatttttcttgattaaaaataatactattattaaaa
tagtaaagttataaaaatcacacctgtaatcccagctaaggcaggcagatcacttgagctcaggacttta
gaacagcctggcagcacagtgaggtctttttctatatatatatatgtaaaataataataataataaataacctgggtatggt
tccacctgtggtagcagctacttgaaaggctgaggcaggaggatcccttaagcctggggaggttaatgctgcagtgagctgtga
ttgtgccactgcactccagcctcgttgacagagtgagaccctatttaaagaaaatgtataccctcaatacaaactgtttcaat
gattagagttttgtatttttgtgctgtaatagtcaaacaattgtacatgttttttaacattaactcagcatatacatggtatt
ttgtttattttttctttcatctgctgttttggaaattaaacacgactttaaatgctcttgttctccattttggttggcttcag
gtgtcctgtttttcagactatttctccatcttcccttttctctttgaaagtattttacttttcctcagtctccatgaaggaaaaa
gaaagtccctttactttctgacctccaagtctgttgaatcagttcccttctcttcataatcactgaagccaaccaagtttaga
ggataatggttctccttagaatatgctcgtctacctgcagactctctgccctaactcacccttttccagggtcctgcagacca
tctcctcgtttccctaagtaccacagagtgggtctgcagctcctgctgccctctgtgtgctcagccctggggctcactagtg
ttttgatgatcaagtccaaatccccatgtgcttggaccctctgagaccaccctctaggaagatgccattgtgagtgagccctg
aaaatcatgactgtgttcagttctcatattcctggatgttctctgttgtaaaggaaatattgacaaataaatactagagtttgt
attgaatattcatgccaaaaaagttttttaaaaattttcaaatgaaacaattttatcttgcctagtttgaaaactacaatct
aaatttaacaaataatgtaatacaacgtttgtcctattagttattcaatttattaaaaacagactgatatttaaagttaatac
cattgcacatttgagtgacatatttggcaagaacagcatttacattcagcttttaacaaaacatgtatttatatatatttgtct
ttttagtattggaataggcagacatacacgtagaagagcattattttctactacaacctcaaactgcaaacacaatttaaatt
caattaagtaataaaaaaaaatatgaaacaaatgggtgtgctgttttggtgtttagatatacattcacttttgcatgggcacat
```

```
gtatgtgtctttgctgggctgttgtgtatgtatgtgtgtttgtagaaccatgaagttttcaaatacatcattaaatgacatag
ttatattaatcttggccaggcatggtggctcaagcctgtaatcccagcactttgggaatcttaggcaggcagatcacctgggg
tcaagggtttgagaccagcctggtcaacagggtaaaacccgtctctactaaaaatacaaaaattagccaggtattgtggcac
aagcctttagtcccagtgtggcagggaaatgtggggtcggaaatcccacacagagttttctactggtataccacctagtggagc
tgtaagaagaaagccactgccctccagaacccagaatggtagatccactgacagcttgcaccatgtttctggaaaaaccacat
accctcaatgccagctcgtgaaagcagccaggagggagactgtgccctgcaaaagttttttaaaacttttcatttgaaaagtt
ttaaaaaagttctgtcacaggggcagaacttcccaagaccatgtgaacccacttgttacatcaggtaacctggatttgagaca
tggagtcaaagaagattattttggaacattaagatttgacttcccagctggatttcagacttgcatgggacctgtagtttgga
ccaatttctccatttggaatggctgtatttacacaatgcctgaactccattcttttctaggaagtaactgacttggtttttat
tttacaggctcatagatggaagagacttgcctcatctcaaatgagacccttggactgtggactttttgagttaaggctcaaatga
gttaagactttggcagactcttgaacaggcatgattggttttgaaatgcgacagcaatcattactctagaggaccacacgtga
agtgcaacaagcaggcgcagaagacaagtgattcgtgatttcactgtagtttgtttaaatggtagactcacagaagtagaata
gaatgttggttaccaggggctggagggggtggactggaaaaggagagattgtggtcaaagtgtaaaatgttccagttagacaga
aggagtaagttacagtgttctaatgcacaagatggaaaatatggctgtgaatgcattatatatttcaaaatggctaaacatgc
aaatgttaaaattttttcccactaagaaattatacaggtcgggagcgggggctcacacttgtaaacccagcacttttcggaggc
cgaggtgggtggatcacaaggtcaggagttcaagaccagacttgccaagatggtgaaaccctgtctccactaaaaacacaaaa
attagccaggcgtggtgttcaccacaggagaattgcttgaagcaaaggctgcagtgagccaagatcataccactgcactccaa
ccggggtgacagagtgagactcagtctcaaaaaaaaaaagaaatacatttatgaggtgctggatatgttaaatagcttgatt
aacaattccataatgtatgcatgtatgatagcatgtgtgaatggacctgtatgaaggtgaggtgccctggtcacgtgacagtg
aggtgacttggggggaggtgtaaggttacctgggggtatgtgtgcggtgaacttgggcacatgtgaggtgacccacggtgcatg
tgtggtggcctgggtgcgtgtgaggttacctggacatgtatgaggtgacatggggaattcgtgaggtgacttggatatgtatg
atgtgacctcaggcatgtgtgaggtgacctggccgacgtgtgaggtgacctgggggacgtgtgaggtgacatggggaatgtgt
gaggtgacctgcgggaatgtgtgaggtgacctgcgagcattccaggtgacctggggggtgtgtgagcttagcaggagtgtgtg
tgaggtgacatggggtatatgtgaggtgacccccctgacgtgtgaggtgacctgagcacatgtgaggtcacctaaggcacatc
tgagttgacctggggatgtgtgaggtgacctagggaaatgtatgagctgacaaagggcatgtgtgcagtgacctgggtgcat
gtgaggtgacctggtgcatgtgttagtttacctgggggatgtgtgaggtgaacaggggcaggtgtgaagtgcctgaggaatgc
atgaggtgacctggtgcatgtgtgtggtgacctagcagatttacgaggtgacctgcgggatgtgtgaggtgaataggggacttg
tgtgaggtggccacaggaatgtgtgaggtgacctgggggatgtgtaaggtgacattgggggatgtgtgaggtgactcagggcac
atgtgaggtgacctgggggatgtgcaaggtcaccttgggtgagtgtgaggtgaccttgggggatgtgcaaggtcacactgtgtg
agtgtgaggtcatctgggatatttcaaacttcgtaaggaaagcctgcaacagtatatggcactaaaagcttcacactccaaca
ccgttaatgcgcacatcctcaaggaactctaagtgtttccaggttagcttaaatgccatggagcgacacctgccccaggcaca
ctcatatatgcatcctgggtctccctatcaaccccatcctcaaattttcagtttatgtttgctccatgatatcaactctgat
atgttgaaggttttttttttctttattttgtagttgttcaggtttgctatttcactctcattactctgggctcagtcctctcc
tcaggtgtcccacttcagagcttgctatataataggagacatgcaaataggaccctcccttttctgatgaaaagcagcgcagc
ctgaccctgcagccctgggagagaagccccagccctgggattctcaggtgtttctatttgggtcaacagcaataaacaaattac
catggaatttgggctgagctgggttttttcttgctggtattttaaaaggtgattcatggagaactaaggatattgagtgagtgg
acatgagtgagagaaacagtggatatgtgtggcagtttctgaccagggtgtctctgtgtttgcaggtgtccagtgtgaggtgc
agctggtggagtctgggggaggcttggtacagccctgggggtccctgagactctcctgtgcagcctctggattcaccttcagt
aacagtgacatgaactggcccgcaaggctccaggaaaggggctggagtgggtctcggtgttagttggaatgggcagtaggac
gcactatgtggactccgtgaagcgccgattcatcatctccagacaattccaggaactccctgtatctgcaaaagaacagac
ggagagccgaggacatggctgtgtattactgtgtgagaaatcctgtgagggacacaagtgcgagcccagacacaaacctcct
gcaggaacactgggcgaaatcagctgcaggggggtgctcagggcccactcatcagagtcaaccccagagcaggtgcacatggag
gctgggggtttgtttcctgtcaggatttgggacttcctctgcttctgacagtttccctagggaaactcttttaattttagatttc
tgtgcccaccaatgtcatctctacatatatttttttaaatcattataatacgaggactcattctcacatgcacaatatgtata
ttgccacctacgggaatgaaaactcctcaaccatggtccaccagcatcagagttgtgaggaagctcaggggtgcctggtgagtc
ttctccagtcagactcaggacagtaacctcaatgggattcctgactagaatggcttttagggatttcgattacagccaagag
agaggctggaccaggttcagtgtcatgtaggacctcacagattttatgtatgacatttctcctgacaataaagtatgcaaatg
agtatcagtcactgatctggtgcttcctgactttcattttagtggttctcgcttttccatttgattttcctgctttctggat
aaaaggatgttgtccctgtggtctaaatccctggggctcaagcccttccctggagcttaggtgggctcaggctgtgactcc
tgcagccattgggagagcgtctgagactttcttctctccattgttcaggatactccatcctgttttctggagacgcgtctg
agaacgcgtgtggccattagtaatgagggcacaagcttctttggtcaaaatggggtgaggatgtggaattgatcctgtgctgt
gtaaactgtcacagagtcaccttcttcaccagtagtgttagaagagcttgtaaaatttgtcggaatccaactggagtcccctg
tgttcaaaccctgacaaatggagctggggaaggccatggatggaagcttctcatgcacatacccctgagaacaagacctagct
ttataacactccaaaaaaccacaaattgaacaaaggcaaccacaacaataaaagaattacttatatccctgagaacaagagct
agctttataacactcagaataaccacaacaacaaaataattacttatataccctaacaacaagagctagcttttaacactcgg
aaaggccacaatcttgcacaaggcaaccacaacaatgaaagaattacttctgtgaaaatatctgcacagcaactgcctatcca
accttacactgatgtcaaccttgttattgatgcttctagcccaggatcgtcctcatcaaaatgtcattcagatcctgcctatg
aaaaaaattgtgtttttcagtgcactcatgttctagtaaagccctcagagaccctctccttcacctgtgctgtctctggattt
ccaatcataaccagtacttcctcctggagctgtatctgccagccccagggaagaagctgaagtgggtcaggtgtgtaggtca
cgaggaaacacacagtgcaacccgcttctcaagagtccagtcaccacctccagatccacattcagaaaacagttttttcctaca
gctgactacccgcacaatgagtaaaccaccatggatttttatacaaaagacacagaagggaggtcattgtgaggcagaca
caaacctccctgcagggaagctcaggacacgggggtgctcagacaccaagggctctcaggacacatcaaggcaggtgcaag
agggggaaaaaaggtgctggaggtggggttttttcatcactgtcatattttactctccactatatttattctaatgtatattatt
ttattattagacaatgatatttatataaatatatagccatacgtaggtgcaccaagttgtcctttccatcttatgtggacctt
gtccattaggacgaagtccctgtatgtatttgagcacctcataagttatggttaattatgtaggatctctcacttttctgtg
tcccttcctccctcctctctcacacacaaaactgacacccacaaagagttctacaactttaattacctgatgcgttgaagaaaa
```

FIG. 7 (Cont. 30)

```
tttactgaagtgcagcttttcagtttaactgctgttcatgttgatgtaggaataagaacattgtctttctcaactgtgtagc
tctctaagctgagtagcacctttatttataatacccagatactgaaagcaatccaatattgatcagcaggttaagcagtaaa
cactttgttctaaattcgttcacttgaataatacccactgttcaaacaagtacggctggaaatgctcaacaagggtaaattca
caagtacttatgaagagtaacataagccaaagaaatacaagtacatacatacagttccacttttataaattttataaaatgaa
aactaatctaaagttacataatgaaaaccagtagttggccgtggacatgg tatgagaagggaaggtgtaggaagtggcaatta
caggacaacgagaggaaattttgaggataattttttctgtattgagaaaggttatggttatgtcattatttgtcaaattgtac
acattaagtgaagattattactttctaatttcgacttcttaaaatactacaaatttaaacatatataatttggtagaaaagga
gttagagatggataaaatatatgagaaataaaaaagaaatctcagaacgatggcataaggattcaaccatcaaactaaataa
atttt aaatttctcaacacagaattatagattcataaaaccagctcctggattcattgattttgtggaattgatttacatgtc
tttatctccttcagtctgctctgatgttaggtatttcttctcttctgctagcttgtgaatttgctcttgcttctttagttct
tcaaattgtgatgttagggtgtcagttttagatctttcctgctttctcttgtagacacctagtactataaatttccctctaca
cactgctttaaatgtgtcctgaagattctcatatgttgtgtctttgttctcattggtttcaaagatcatctttatttctgcct
tcatttctttatttacccagtagacattcaggaacaggtttttccagtttccatgtagttgtgcagttttgagtgaatttcttc
atcctgagttctaatttgattattgcacttgtggtctgacagactgtttgttatgatttctgttcttttgcatttggcgagga
gtgtattacttccaattatgtggtcagttttagaatatgtgcgatgaggtgctgagaagaatgtatattctgttgacttgggg
tggagagttctgtagatatctattaggtctgcttcaagtcctgaatatccttgttaattttctgtctcgttgatctgtctaat
attgacagcggggtgttaaagtctcccactcttgttgtgtgggagtctaagtctctttgtaggtctctaaggacttcctttat
gaatcgggg tgctcctgtatttggtgcatatatatttaagatatttagctcttcttgttgcattgatccctttaccattatgc
aatgcctttctttgtctcttttgatctttttggtttaaaatgttttatcagagattaggattgcaactcctgctttttttttt
ttttttgctttccatttgcttagcaaatattcctccatccctttattttgagcctatgtgtgtctttgcatgtgagatgggtc
tcctgaatagagcacatcaacaaaataaatagacagctagccagattaataaagaagaaaagagagaagaatcaaataaatgc
aataaaagtaatgtaggggatatcactactgatcccaccgaaatacaaactaccatcagagaatactataaatgcctctatg
caaatatactagaaaatctagaagaaatgcataactgcctggacacatacaccgtccaaagtctaaatcaggaagaagtcaaa
tccctgaatagaacaataacaaattctgaaattgaggcagtaattaatagcgtacaaaccaaaaaaaagtccgtgaccagat
ggattcacagctgaattctaccagaggtacaaagaggaactggtaccattccttctgaaactatttcaaacaatagaaaaga
gggactcctccctaacttttttatgaagccagcatcatcctgataccaaaacctggcagagacacaacaaaaaaaaagaaaag
ctcaggccaatatccctgatgaacatcaatgccaccaattctcaataaaatactggcaaaccaaatccagcagcacatcaaaaa
gcttatccaccacgatcaagtgggcttcatccctgggatgcaaggctggttcaacatatgcaaaacaataaatgtaatccatc
acctaaacagaagcaatgacagaaaccacataatcatctcaaaagatgcagaaaaggacttcaacaaaattcaacacccttc
atgctaaaaactcaatgctctaggtattgatggaatgtatctcaaaataataaaagctatttatggcaaacccacagccaata
tcatacagaatgggcaaaaactggaagcatttactttgaaaaccagcacaagacaacgatgcctctctcaccactccaattca
acgtagtattgagagatctggccagggtaatcaggcaagagaaagaaataaattgtataaaaataggaaaagaggaagtcaga
ttgtctctgtgtgcagatgacatgattgtatatttagaaaaccccatcgtctcagcccaaaatctccttaagctgataagcaa
cttcaacaaagtctcaggatacaaaatcaatgtgcaaaaatcacaagcatttctataacccaataacagaaaaacagagagcc
aaatcatgagtgaactcccactcaaaattgctacaaagaaaataaaatacctaggaatagaacttacaagggatgtgaaggat
ctcttcaaggagaactgcaaaccaccgctcaaagaaataagagaggacccaaacaaatggaaaaacattccatgctcatgaat
aggaagaataaacatcatgaaaatggccatactgcccaaagcaacttatagattgaatgctatcccccatcaaactaccaatga
ctttcttcacgaattggaaaaaaactattttaaagttcatatggaaccaaaaatcctgagccatagccatgacaatcctgag
caaaaaaaaaaacaaagctggaggcatcatgctacctgacttcaaactatactacaaggctacagtaaccgaaacagcatggt
attggtaccaaaacagacatatagaccaatggaacagaacagaggcctcacaaataacaccacacatctacaaccatctgaac
tttgacaatcttgacactaacaaacaatggggaaagaattccggaactatttaataagtggtgttgggaaaactggcgagcca
tatacagaaaactgaaactggaccccttccttacaccttatacaaaaactaactcaagatggatgaaagacttatccagacct
gaaaccataaaaatcctagaagaaaatctaggcaataccatccaggacataggcatgggcaaagacttcaagtctaaaacacc
aaaagtaatggcaacaaaagctaatactgacaaatgagatataattaaaggaaagtgcttctgcacagcaaaagaaactatca
tcagaatgaacaggcacctacagaatgggagattttgcaatctatccatctgacaaaggcgtaatatccagaatctacaaca
aatttacaagaaaaaaaacccatcaaaaagtaggtgaaggatatgaacagacatttctcaaaagaagacatttatgcagcca
gcaaacatgaaaaaccctcctcatcactggtcattagagaaatgcaatcaaaaccacaatgagataccatctcacaccagt
tagaatggtgaccattaaaaagtcaggaaacaacagatgctggagaggatgtggagaaatagtaacatttttacactgttggt
gggagtgtaattaagttcatccattgtggaggacagtgtggcgattcctcaaggatctagaactagaaataccatttgaccca
gcaatcccattacttggtatgtaccccaaggattataaatcattctactacaaagacacattgcggccaccattcccaatagca
aagacttgaaaccaacccaaatgtccatcaataatagactggataaagaaatgtggcacatatacaccatggaatactatgc
agccataaaaaggattagttcatgtcctttgcagggacatggatgaagctggaaaccatcattctcagctaactaacagaag
aacagaaaaccagacaccgctgttctcactcgtaagtgggagttgaaccatgagaccaggtggacacagggagggaatatca
cacactgaggcctgttgggaggtaaagggctaggggagggatagcattaggagaaatacctaaggtagacggcaggttgatgg
gtgcagcaaaccaccatggcgtgtgtatacctatgtaacaaaactgcacattctgcacacgtacccagaacgtaaagtatca
tttaaagaaaggattacatattccattaaatatatatgagaaatcagagactcctgaatatacacatgaatacacactgggtc
tacctatatttttagggaaacactagaatacagcaaaataatgtcatgattttattaaaaggggggtttatcaaaccacacc
aggcatgtccagctctgtcctggagctggttcaggg aacaggtgggtcctgtgtttgggagccatgacaacaagctcacagcg
tcagttctagttgaaacctcaaaaaggcaaagggatctcaactaaaatatcatgtggatgtcacatctgtgggtgctgcatac
tcccccgatgtgaatatggaaaggttaattacctcttgaactctctgccgagattagtgctggtctctcaggaacacccaaaa
tggctcgatagagccgaaagcagactggctcaggg ttttgtgatggtttcgtcgtgggtcagagtgaggcttcccacgcac
aggaagggggattgtacagtgcgaaacccccactggtgtcaatgaggaagctcccgccattcctaactagattcacattgtgt
gataaagacacacaatagacataactctcatgtcggatatcacaaaatgcgttaaaagatgtggtaaaaaggcaactttaa
atttttagtcattggagtgcgtacaacacaaaaatcattttcaatatttgtaacacatgcatgcaataggacaaaggtatgtg
atgagggtaaaatctcgaaagtgtgaatcttccagctaccaagtcgtagggtaataactgatgtgtgctgagggaggaaacca
tcacgccatagtgctaatggtataaccccttggtgaagagagttcaatattttattgaagttttcataattttttatttaaagat
```

FIG. 7 (Cont. 31)

```
gccattttttcaacatactcagatgattgtgagtgccattgattctgtatcgtatgaacaatggcaatacettccatgtttaca
taatattaaaaaccacgttaagactgaatatttggtgtcatggtgcatcacgttattctagcttccatactagttgttttatt
tgtttgttttctcctttgttggcatttggtttcgaattcatatgtcaggtctctataatgtaggaatttatttaaaagtgtct
ttttttgtccattttgatggggcttccaggagacgtaagaacctcctctgcttgcaacacattttaaaattacacactaatgt
agaacatctgtatttaatcctggtttttagttaattgacaagctctaataagtgaagtaacttctccattctgggctgatttt
acatcaggtataggaatatatcctaggtgaaagtttgtaccagtaatatgaattattaggtaataacctccaccttttatgatt
tacatgttattcatcaagaaatagtgttaaatcaggagtctcaatgaaagtattacctaagggatatacaaaatatattgcta
atctacataaaacagatgtgaacacactcttagtatccagccatgtttcctgtcaaccacacagtaactttgacttcacttgg
gacttgttctaatttttcaaattagttacttattaatcttaatgcttctagatattatgtgtgactattttagcagagagtgaa
gaaagacagcctaggccgactaaacaatgaggaaaatcacaacctgatgaaacaggaagcctctggatgtgagtggctccagg
attgaataaatttgacaactcatgtacccaggaagtttcttttctcaattttccacactgatgcatccagaaagtcagcttcac
ccccccaggtgactccataatgcagtgacatggtgacaatattcccatggtcacatacgtatttatatattggctggaaaag
gggcagagacagtctctgcaattctcctctgaaggaccaggaacacctcaacagaccacctccctgccccatgactagaact
gcaccacgtgcccacatggacactcatccctgatggggataagaagactccattgatgaggccgactattttagcatataaat
tagtaaagactgatataaaggtttcaacaactaattgaagtctgttcttctatgtccaccagagactatagatgctccagcga
tatcttgtttttctttgctgcgtgactgtgtctcttctccttgttccatctccagagaatctcttcagctcccacaggtgc
attcctctgttacatgtaactgacaattgataaattagtggaagcccttacactaaaggaagagtctctgacctcatcttggt
ccatattcctagaaaggcattgtgcccgtaagtctgggtgtgaccttctgagtgttcctgaccctcctccagaggagatgctc
atctgtgtgttcttgtcccttcactggggtagaaccaccctgtttcccccaggtgttccctcccacagctccagtgttccgc
atcagtgtcatcacctcccagatctgctgccctgccctgcagactaaagctctgattccataagaaggagagttatgtctcaa
cagaacttcgtggcagtgacctctgttcccatctcaattcctgaggggttgcaccagtgcccctagggtactggttttggtgg
ttccctgcaaagtaattttttggttctgtagtggatataaggagtcgagtctgaatgcctttcaaaaatgggggctcttgtt
ctctcccagacagacactttgggaaaggaagattttgtgactgccccttttttggggaaagggattcaagaggatagaaaagc
tcttcagtatgtggtccttagaatttcaaactacaacaagcttaccatattcagtttcaagcaatccatatatatttgtat
ttttatcttttaacagactatatttcatatgccagactctgccttaggtaatctcatatgctggctttgttactctctacaaga
acttgcttcttgttaaatttaagattttttttaacttcagttatcctaagcattcagaaatttgcaaaatttcatcttgactg
tttatctgttattgttgatgtagttgtaagaaataaagaatatatatccctcatttatgtacattttcaagtcgagtagtaga
ttttagtactaccagagtaataaaataatttgaacattgttaagctgcttaacagaaaatcaaattatggtaaatttgttca
atggaatactacacaacatttataataaataattgtctgatacatgcaacaagaaggtaaaatatctaagtattttgctgag
taaaataaaccagacaaatgagaagatttaccatataatttcatttatataaatttctggaaaataaaaactgaacttacttaa
gtaatataacaacaaggtaaaatatctaagtattgatgttcaggaaaataaagcaaatgaataagaatatgtactatgttatt
ccattttaataaactctgataaattaaattgaatctacagcaatataaagaagaacagaatttaccatttgggaaatggtag
aagaagggaagaggaaaggaggaggaatatagaagaatgagagggaaatttttgtgaattttctggttcaccttggtaactagg
atggttacatcaggtttatcaattgtacactttaaatatgtgaagtttattatcagtaaactgaaatttataaaatttattac
cagcaaacaaatgaaaacttgcacaagaaataagtgacataaagatagaaaaaatattaaatttcagaaacacctaataattt
atcttcgtgaaccctagttctcaccatatttttaggtgaatgctagaatgcagcaaaattacacatgctctcaatacagaaag
tgggtttcacaaaccacactaggcatgctcagctctgtcctggagttgggttagggagtaatatagggccagtggatgaggag
cacaggcctagatctggggctcactaacctcaggtatgagctcttagatacatacaaagccccctccacgcatgggtttactt
cccatctgtaaattgagaaaccattgaccccctaaaaaatatgatttacacaaatatgtaaaaatgtaagagagtgattagtgc
aaagtgtttatcacagcacaatttcataacaagacagcaagttttccaaacagcatcattgtcattagattcctgcagggcat
cattacctatctgggccctgccctctgttcaggcatcccaccccagagcttgctatatagtaggtgacatgcaaatagggcc
ctccctctcctgatgaaaaccagcccagtcctgaccctgcagctctgggagaggagcccagccttgggattcccaagtgttt
tcattcagtgatcaggactgaacacagaggactcaccatggagtttgggctgagctggattttcttgctgctattttaaaag
gtgatttatggagaactagagagattaagtgtgagtggacgtgagtgagagaaacagtggatatgtgtggcagtttctgatct
tagtgtctctgtgtttgcaggtgtccagtgtgaggtgcagctgttgagtctggggaggcttggtaaagcctggggtcc
ttagactctctgtgcagcctctggattcacttttagtaacgcctgatgagcgggccgcaggctcagggaagggctg
gagtgggtggccgtattaaaagcaaactgatggtggacaacagactacgcgcaccgtgaaaggcagattcaccatct
aagagatgattcaaaaaacgctgtatctgcaaatgaacagcctgaaaaccgaggacacagccgtattactgtaccacag
gcacagtgaggggaggtcagtgtgagcccggacacaaacctcctgcaggggcgcgcgggccaccaggggcgctcgtgacc
cactgagggcgggacaggtccaggacaggtgccggagaggtttccttctcctcagctggaaaagtcaggtttatcttcg
caggactctggagtcttctaggctgtgatattttgttacttatatttattatgaatttttatcattaatacttaaattttagta
attattaacattctacatattattatattttttaagtatatactttcaagaaataaaacattcctaattgcataataattattgt
aacataattattgtaacatataattatatcctaaatgcataataattattgtaacaatcacattctcattttgtatttgaatt
tcatatttatttttactaagattttaatttttaatataaaatattttttctacaattgtctgtttttccattttgtgagataaa
ttagcatatacaaaatgcacagattctccaggtacagttagagggtttcaggcaaatgtgcacatacttgtctacagcagct
aagtgagggtgaggaacaggtgaggtccatctccccacaaagtgtcctcttagtgcttccagttagttctcacataaggattt
ttttttatttcaactttataatttagatacagagggttcatgtgtggatttgttacatgggattactgagtgatgctgaggtt
tggaatacagatttcttcaccccctccctccatggtctagcagtccacagtgtctgttgctcccatatttatgtctatgtgtg
ctcaatgctgaggtcccacttacaagaatatgtggtgttcagttttattttcctgaattaatttgttaggattaagaactcc
agctccatttgttttgctgcaaaggacatgatttcattcttttcttatggctgtgtagtattatatattttacatgtaacacat
tttatatatccactctaccattgatgtgcatctgggctgatctttgtctttgccactgtgaataacacagcaataaacataca
catgcatgtgtctctttgtgaattatttgtttaccttgtagtgtataccctgtaataggatagctggttcatataatatct
ccatttttaagttttttgagaaatctccagtctgctttccaaagtgggtggactaattttatattcccattaacagtgtgtaagt
gctttcttttcaccacagccccatcagtatccattggttttttgacttttttagtgataaaaatttgagtggtgtgaggctgcac
acctacaaccatatgatctttgataaggctgacaaaaaaacaagaaatgagaaaggaattccctgttccataaatggtgctgg
gacaactagctggccacacgacaaagattgaaactggatgtctgctttcaacatatataaaaattaactcaaaattgataaaa
```

```
gatttaaatgtaagacatcaaactataacaatccttgaagacaacgtgaaaatactcttctcgacaccagctttgacaaatac
tttttggctaagtatgcaaaagcaattgcaacaaaaacaaaaatagataaggagagactaatttgctaaagagttactacaca
gcaaaccaaccagctaatcaaccaaacaaacaaataaacaaacaaaactatcagcatagtaagcagacaacctacagaatgtg
ggaagttattcacaaatattgcatccaacaatgccctaatatccagaatttgtattagctggttttcatgctgctaataaagac
atacccgatattaggaaatttatcaaaaaagaagaagaagaggtttgatccacagttccacaaggctggagaggcctcacagt
catggtggaatgtgaaaggcacgtctcatatgcagcagacaagaaaagagaacttgtgcaggaaaatcccccctttataaaac
tatcagattttatgagacattcactctcaagagaatagcatgggaaagaccccaccccatgatttaattatctcacaggggt
ttattccacaacattaggaaattactgaagctccaattaagatgagaatgggtgggacacagtcaaatcatatcattctgc
ccctggctcctcctaaatctcatgtactcacatttcaaaatggatcctgccttcccaacagtcccaaattcttatttcagcat
taactgaaatgtccgcattccaaggcctcatctgagacaaagcaagtcccttctgcctatgagcctgtaaaatcaaaagtaag
ttaattacttcctagacacaatgggagtacaggtattgggtaaatagagcaattccaaatgggagaagttggccaaaacacag
aggctaaaggccccgtacaagtccaaaatccagtgggacagttaaatcttaaagctcaaaaagatctattttgactccatgt
ctcacatccaggtcatgctgatgtaagtgttgggttcccatggtcttgggcagctatgtgcctctggctttgcagggtacagt
ctttcacccagctgttttcaccggcttgctctgagtgtccatggcttttctaggtgcatggtgcaagctgttggtggatctac
tattctggggtctgaataactgcggccttctaatcatagcttcactaggcaatgcaccagtggggactctgtgtgaaagcacc
cacccacatttcttcctcgctgccctaacagaggttcccatgtgggccctccctgcagccaccttctgcctggacatc
caggcatttacatacatcctccgaaatctgggcagaggttattaaacctcaattcttgacttctgtgcacttgcaggctcaac
acaaaatggaagatgctaaggctcggggctttcacccctgaagccacagcctgagttatatgtaccttggccccttttaatc
atggctggagcagctctgatgcaaggaagcaagtcctagactgcacacagcagagggaccctgagcccagcccatgaaacaa
tttttttcctcctaggtctctggcttatgatgggagaaccttccacaaaggtctctgacatgccctggaacatttttctgcattg
tcttggtgaccaacatttgggtcctcgttacttatgtaaatttacgcagctggttttgaatttatcctaaccaaatgggatttt
attttctattgcattgtcgggctgcaaattttctgaacttttatgttctacctccttttaaaactgagtgtgtttaacagca
cccaagtcacaccttgaatactttgttgcttagaattttttactgccagatacctggtatcatctctctcaagctcaaagttc
cacaaatctctaaggcagaggcaaaatgccaccagtctctttgctaaagcctaactagagtcaccttttgctccagttcccaac
aagttccttgtctccatctgaggccacctcagcctggattttattgttgacatcattatcggcattttggccaaagccattca
acaaatctctagagagttttcaaactttcacacatttttttgtgtcttcctcttagccctccaaactgtttcatcctcagcgtgt
tttccaattccaaattttgcttttatgcttttgggtatcttatcagaagcacttcactcaactgataccaatttaccgtattag
ttgcttttcatgctgctgataaagacatacctgagactggcatttacaagagaaagaggttgaatagactcacacttccacg
ttgctggggaggcctcgaaatcatggcagaacatgaaaggcacatatcacatggtggcatacaagagaagagaggacatgcag
ggaaactcccctttataaaatcatcagcaagacaggagaactcatgcagggaaactcccctttatcaaatcatcagatctcat
gagactaattcactatcatgagaatagcatgggaaagaccccccccaccatgattcaattatctcccacgggtccctccca
caacacatggtaattatgggagcagcaattcatgataagatttgtgtggggacacaatcaaaccatatcaagaatgtatagga
aacttaaacaaatcaagaatcaaaagacaaataaccccattaataaatgggcaaataacaagaacagacacttctgaaaagaa
gacttacaggtggccagcaatattttaaaagattctcatcatcactaaccatcagaaaaatgcaaatagaaaaatgttctaat
ttttgtcattatagattgattttttctgttttgaacttattttgctattttttaggtttatttatgtaatttcatgtctcaa
ggttttgtcattgtatatatacatatgtatgtactaatacacatatgaatatttcatatctgaatcaatccataacatcagta
aatgacagtttattaagtaaataaatcagtttattatgtgaaataatgacgatatgtatatttgttttcctgttgatgaaatt
taaatttgtttccaacataaatattataagcaaactgttataacttatttttgtgcaagtttttctgtttatattctcacatat
tgataaaatatgtagaaatataagtatgcttttttattataagacttacattttcagcttttatggagctaaagttgacaaata
aaattgtatgtatttaaggtacaccacttgacgtattgatatacatgggaaaatgctggatggtagataagtaaacaatgcta
aacagcactaattatcagggagatgcaaattaaaactgcagtgatatttcttaaaccagtcagaacagctactattaaagagc
caaaataacaggtattggtgaggattgaaggcaaaaggaacgcttggacacttgtggtgaggatgtagattagcacagcctc
gatggaaaacagtatggagatttttcaaagaagtaaaagtagaactactttgattcgataaccacaaataactacctaaagga
aaaataaatcattatatcagaatgataagcagacttttgttttcctgcagaactattcataatagcacagtcatcaaacttag
gaattaacctatgcctaacaacagatagtttataaagaaaatgttacatatatatacatttaaatactatccagccatatta
agggatgcaatcatatcttttgcagctacatggatggaattcatcattatttttaagtataataattgagaaacagaacatcat
acaccacatgttctcacttataaatgagagtgaactcatatgtgcacaaggacatagagaaaggaatgatggacattggagac
tcagaaagatgggagagcaaaggtgggagaatggtgagaaattacttaatgggtatgatgtacattatttggatcatggata
tgttaaagccaagactactactgcatatatatatgtaacaaaattgcagtcactccccataaatttatacatataaaataaaa
acaaatacaattaaaattgattaacagttgataaacaatactgaaattaaaattttgtgatcaataaatgaaaataatattagt
tgaacttcaaattttaaaacattttctactcaagtgactatcaagaaaattaaggacaagctgcaaaggaaaaaatatttgca
agtcatatatctaccaatgtaattataacaagaaccggcaaacctcaaagatgtacagatgacacatcagcataggaatgtga
ttttccaccagagaaatgcaaatcaagaccaaaggagacactactatagactttctagaaagacaaaaataaaaaagaaat
actgacaatatcagagttggtgaggaagtcagtcaccctagagactaatatattgctagtgggaatgcaaaatgaaaccgttt
ctgggaaaatcatttacagtttcccataaaattaaacatgtccttaatccatgacctagaactctcactcctaagtatgtcct
acaaaggattaaaatcatatgttcacacacgtattcagatgtttaacattgtgtgtgtgtgtgtgtgtgtggtgtgt
gtgtgtgttagaaactaaaaacaacatggacgtctttgaaaatttgacacaaaccattacaggtgaactccagactttctt
ctgagtgacagaaggcctgcctgaaagatccccagagacacagtcgtggatttcactgtcaccctcgcatgtcactggcttgg
gctgggctctctctggctcttcctgaccaggaccagatgttgagctccactacctgcagttggaagtttatattttcaacaa
tgcactgaggtctaagttgctctgcagatggaaccaaacaaacatgggcgcctttgaacaaacagtgcctgacatttgtactg
acccaggagaactcttcccagctctcattcttcttggttctctcctgcaggccagcagccctgaagtttagcctggatctcc
catgcatccacccatctccttccaagtgcatttaccacagcctccactgtttttgaagcactcttgggctttgtaattctcc
acactctgttgtaaaggaagtcagtccttcaagaccagattcgggactctattttatgaccaaatttcagcctcaccctgc
tcctgagagagagctcctagataagattctgcaggtggagattaggagtgttttttcttcttcaatgtagttgctgagcgctca
gtgcagggttggggagaaactttccactttgtcagcatgcagctcctgctgggtagaccttcttccatagaagcagggttgg
gaaccaggggggccaatgtcctcagtgctgctgcacccagggcagagccttcatccatcagtggggctgtggaagaagtgagtc
```

FIG. 7 (Cont. 33)

```
tctggttctcagtagctcttgtccagaactgagcctctgcagcatgttctgtcggcccagtgtcctggcccctaaggagcag
catcctaaaatggggagctagcatatttgagaataacaacacctacacattcagaagctctttggctttcttttccagctaatat
aatttccttttttttgtgtagcaacctgtacacacgcatattgatgcatacagacctatgacactttttttctcgataagtaaa
aaattattgatcactgtgatcttttctccaagttcaccattcccctgaaggtgagcacaggtccttctgcatgtgttcaaaca
aaaggcccagagactacctggtaagtgaggtgctcacctggttctggatgtttggtctgtctcctcccctctgttgccccaca
caaggtcagcccactctttccaggtccgaagaagagagcacaggtttgtcctgattatatgactcacccagttctgatgact
ctcctgttgccagcgtccatggcctcagtgaaggtctcctgcaaagctctggatacaccttcgccagctacgacattcactgt
gtgtgacaggccctggataagggttgaatggatggtagggagctactctggcaatggtaacacaggctatgcacagaagtt
tcagggcagagtcaccatgaccagggacacgtccacgagcacagcctacatggagctgagcagtcagagatctgaggacatag
atgtgtactactgtgcgagacacacagtgtgaaaacccacatcctgagagagtcagaaatcctgagggaggtggcagcagtgc
taggcttgagagatgacagggatttttatttgctttaaaggcttttttagaaagcgaggttaattcattacagaaaaaggaa
aatagaaatgtgtatggactctaattatgtgggaaattttccatacaacttttgttctctaagcaaaattcagggagtggaaa
acaaatcaaattaataaacctgataaaagaattcctctgaaaatttagtgtgagcataagttttttgaatgggtgttgtaaata
ttttggaacacagctgctagatcacatttttaactctacacttatctccattatataaaatatcaaaatgttttaatgttttcc
atttttgtgcaattataatttttgtgttataatcacattttaacactttaactctacacttatctccattatataaaatatcaa
atgttttaatgttttccatttcgtgcaattataattttgtgttcatgccagcaatgcatgatagatcttgttcttccgcatcc
tcattgccatttggcactaagagtattgtgtatttaatattctaatagattagtagtgatagctcattgctgtttaaatgca
catatttctaattaaaattttgtatttaattattttatataattgtgatgaagtgtctcgtatggtatttggattattttta
ttgcattgtttcttttgatcagttgtaagtttccttatataccattatataagtcactcacaaagttaacaaaaaattgat
taacaaatatgtgttttacaagtgtattctccaaattgttgttgtcgttttactcccatatcagtgtctgtgggagaaaaata
tttatatacatatatatgtgtgtgtgcatatatatatatatatatatatagtgtgtgtgtgtgtaaacttagataaaataatt
atttcataaatcatacttttggcatcatatctaaaaactaattatgaattccactaacaggattttttctcttgtctccaatct
caggccacaatcacagcataagcatttaaatttctcctatttgatgagaagattattaacttaagatgtttagaattcttctg
aatggaaggtgccttttttctaattttctgtattcaataatctgttaatatcagtattggctcatgaatgtttattttttact
atggagaagatctagtgctacattatttattttatcgctcaaatcaccacagcttttttttaggttctgtgagctcatttagt
ttggattctgtattttttacagcatgcccatcctttgttttgatcacttccctatttctggtattacaagaaatactaag
ctcattatctctattatcttttccacacatagaatcagttatttctccaaggattactggtccctgatattaaagaatatat
taaaacacaaaattatgatgttggatgtgtgtgttgttaatgtactgtcagtgtttctagaatctctaagctaacaggcctag
aaaatgtgtatgtgtatattaacccatgttaactgacccatctaatctatttatgtatccaatcttctgtatgtttattgcat
caaactttagaacactggtatctacaatctactatgatgatacatgaatgtttcaagccttccttcctgcctgtccatacca
cctactgcaaagtgaggaacccctcccatcatttgccgttcattcaatttgttgtacaattttagaatatatgcgtcgtggta
ttagaattgttaacttgtaccctgttggaagtatgtttattgactagaataaagtgtttaagtgcagtttctttatacttta
gacttacagaacaccctgagttctaagttatataggtgagaaactttatgtgccaccttcttcagtgaggttatttgaaatat
gttgtatacatttttatttgacattctgtaaaagacaaaactgtagatgtcataaatatatgaggattttctagaaattagag
agagggtatgcattaggagaaacaggtactgtttgcaaacagtgaaattttttatgatctgcagtagtgaacacatgacacaa
tttgttaattctcacaatttatgatgtaaactgtgaatctaaatatatacaacttacaaaattatgtagcacatcatgaaca
tgcaaagtgtacaaaaataaaatatcaaatacatttacaccgcgtgggcagggaattgcatgagatgcaggcaacaaagaatg
aagtaaccttccccatttgcacataagatgtttccattcacaagagacctttctttatcaggttcagtgtgcaaccaagtttc
cctgctgacaagcattcaagccagatgattcgcaacttccttgactgagaaagattcccctcaaacttcagctcagtgcagg
cacacaccatctctgaatgggcatttaccatcagacaatgccacacctgtcccacatggaccttccctcagacaaacaaa
cacatcctcaggttgactcttccctcagacaagcacccctgtcttcatgtgaactcttccctcagataagcacacatgtcccc
acattgacttttcctcagacaagcacatatagctgacaacgaacagttatgtggcaaaatgagctcaggatagtggtaatta
tggactccagctctgatagtttgtagaaattgtcatttttaaaattctgactgaagacttccttttattgtagaagacagtcc
tttacagctctaattgcacagcctacagacaggagtccatttcctctgggcaaggttttatttttatttgtttactgtacttat
ttgttgataaatattgatactacaaagatagcctataggtccacatacgagaaaaaagagtaatgggcagatcaaccctgc
aaatccagtcccaggagtctttgaccctgccctccctggaatccagagacagagatgggaagaggcctgctgagcagtgcact
catgtccccagggagaaagacatggaaatgaggcccctcctctgcaaatgaaaagtagctcatccctgttcctgtagatcct
ggtgaggagccatcccacatctgtgcccttcctcagtgtccacaccatggggtctgtgcagatctggctgctcttgtcatca
ctctcaatgttcaggttcccgtggatcaggcccctgctgtggctgttgcctctgtgttttcagaagtccctgtgaagttaac
taatggagttagacagaaatactacagaccaggaattctgcctttctgcaaagcctctggattcacttcactgaaaaca
gcataagcttgatccagcaggcttcatgacaggggtgggtgtgggtaataacaataattcaaatagaagttctcagtgggact
ctccttgagtaaaagatgattaacaatcctcaaatacactcagttcaggagattctcttttaagatgattaacctgagagct
caggaaaagtccgtgtattactttgagggacacagtgagggagacatctgtgtgaactcagacaccaacctcctgcagggaga
caggaggggactgcctggtagatgcttctcagaaccaccaggggggtgctcaggacatcaggggggcactcagaaccatcagggg
atgctcaggacaccagagggcactcaggacactggggggggtgtcactcagaaccaccaggggggcactcaggacactgggg
ggggggtcactcagaaccaccaggggcgctcaggacactgcggggggggggggtcactcaaaaccaccaggggcg
ctcaggacactatgaggggggtggtcactcaaaaccaccagggggcgctccggacacggtggtgagggtagctcaggatag
cagggtgctcagaaccaccagggggcgctcaggacactgggggggggggtcactcagaaccaccaggggacactcaggaca
ctggtggcgggggggggggtggtcactcagaaccaccaggggcactcagagacaccaggggagccctcaggacactagggg
gagctcagaaacaccaaaggcaatcaagacaccaggggatctcagaaccaccaggaggtgctcaggacaccagggtctct
gaaccactaggggagattaggaccccagggggctcagaaccactagggggttttcaggagacagggggcgctcaggacacc
aggggctaggggacaccaggtggttcagaaccactagagtgtgctggaaccaccaggggtgctcagaacccaggggct
gctaaggacaataggagtgctgagaaccaccagtgggcgctcaggacaccaggggatctcagaatcaccaggctgtgctca
ggacaccgggggtgctcaggacctccaggagcgcacacgacacaaaggatagctcaggacctacagggggcgatcagaacgc
cagggtgcgttgaggacaacaaggggctcacaggacacaacgacgtgctagtaaaccggggggacactcacaaccaccggggg
tactcaggacaccaggggggtgcccaggaaaccaggagcactgaggacaccactgctcccttaggaggcagctccacatcagg
```

```
tccctgagtgggagcagggaggagggttcctcttgtatcttgccactaacatgttgggagttttctgcttcctttgtggttt
caattattggctgattcttcggtacaaagcagagcaagtataaagctctgctttcttggattatgtaatgttttggctttgg
atgctaccagaattacattgtactttgagaggattcattcatggtgtgtgcaatagtgaatgaaacctgtaattttaggggtg
gctttgaaagctatgttaggtgtggctgagggcagtttacaggaaatggtcatcactatagaaggctactcatttctttgcac
atttgcgtaagcaattgtagtttatgaattaaaaactgcctgttttcttggtccttttttcttaaatggtcccactctaagggc
agtaatgtaatcaagctgtgtttcaaagatctgcaatcaagttaagtctgtttaatgaaatgctttgtaaagaaaatgtacat
ctattttttagagtcaccttttacattttacattgctttacaaatattaatttggtaaatttagtctcataattatcttcagta
attaaaaatcttaaagtcatgtcatgttaaattaagtaatcctaggcttctcactgtgaattagggttactaaaaattagaat
agtaagagagtataatcaatttatggtgaagtttattaagaaagatgaagatatgttttttgcttaaaaatattttgtttttcc
agtttacagggcctttctactggtttttaagatgacaaccactgtttacatctgaccctttttttgttgaacatctgttgagttt
ctattgatattccacagctagagttttaaagtaaaagctctagtatctttgtattagtgtgaatgtgtgcttgtatgtattat
gtacatatatatatatttttttgttatgtgttatggctacaaggtacaaaattgactttaaaataaataactattttaaattaa
gtcaatgagccctaatgcatctgaagtacatgtaacttaaataaatatgtaataaataagctggcttcaaaattattggtaaa
ataaaattggaaatattttaacaattattagaatacctcatagttttatatcaattgatcaagtgattttatatttaaaatcac
agctagatatatatggtgtgaaacatttctatgaagattataaaattattaacctagttaaaaccagaatgatctttgtaat
ttgacaaataagatgttttaatactgttgttttaataaaaaaacaggtaaatagttattggaaatacaatcatttatttaataag
aattttacttaggtaaacacctgaaattcatgggttataatatgggtaacagggaaaaaacttttaaaggatgagtattactgt
tttcataaatgatctaggtaagctatttaaaaaataaaattaggttaatgtaacaaaataaaccttttaaataaacttgttcta
caatttaaaaatctaaagtttaattaaataatagatattaactaaatgtttaggtcattactaattgttttaaaaaatgtata
ctataagaaaatattttttgtaaaaaatttgttcttacagaaagattttatttaattcagaggttacttataaaacatcctaaa
cataaccagtaaataagagagatgccactgcactccagcctgggtgacagagcaagattctgtctcaaaaaaaaaaaaagaaa
agaaatttttagacatagaggagtacttttggtatgaaaggttaaaataaaaaaaataatttttatatgagaaagaatcttgt
aacttttttatcctaaaataaaaatgactttatttaagaaacagtgatgtttagaataaaactatatgctcaagtatgccataa
gcgttttgtgtaagtcaaactaaggtttgtaaaagttaattaattaaaataacttcatattatgaagttgactataattaaa
aaggaagtatttataatagtctttatagatttgtagagatctggctttcatataaaaatatataaatatactaaagattggtt
aggaatgaaaaattgtgcttaaagtattgatttactcaataaaattataagatattttttaattttttaacccaaaagtttaact
cttactgcatcttgccagttttattttattctcttttgagaaggcttgagaggatctcaaattttttcatgagctcctctaaca
tttttttttcttacagcagttagcctctaacgatgttaacttctaactgttgttagcttctaactgctattattgcctgatgct
aaaaatcttttatattaaagttcttaataaaatgttttattttcaatatagtattctgcactcttgggttttttttaaatgtcta
tatttgtctatggaaccaaaatcttcacttgtaatccaagacacattcttcctatgtctaattaatcaaatactttgtttcat
tagagttgacttgcaggttatctgcatggatttccccacagggaaacacagtcacactgctgaaggtgttttttcccatttgg
taactggcataaaacaaattttatattttcttgaaatacttcctctgtagctgttttttaagtttttcaactacttaggaatac
tgagattttgagaaaatataaattattgttattacgttaatgtaactatctggcataacttttaaaggacttgtcctgctaca
ttactgatctttgattcctaggtctaaaaaggatacacaacactttgggaggcttcagagggtggatctcctgagggcaggag
ttagagacgaacctggccaaaaaggcacaatctcattttaataaaaaatacaaaaaattagctgggcgtggtggcgggcgcagg
taatcccaactacttgggagcctgaggcaggagaattgcttgaacctgggaggcagaggttacagtaagccgagattacacc
actgcactccagcctgggtgagactctgtctcaggaaaaacaaataaatacaataaaaataaaaaagacaccgagtcttgcta
aattttaaactctgacagcaattgaagcccccatctagagatgtggaagaaaatgacaataaaaaattaatcacacacttaagac
acaaggccggaaaattgaatctactcaaccactccaggcccagggactgttacagaagaagcggtttgtaagattgtaaaagc
taattttgaaagatgaaattacttgagagtttctttatacagtaaacattaatattaaaggcacactaatgccaggctagtag
ctgggccatgtgtcagattgacaaggggtttcttgaagaattaatccactttttaatttgaaaaacttataaaagtttataaga
gatcatttgaaattaaattttatggtaaaagtaattataatgtaatagatttattttttcagaattgagagacagttttaacttt
ctctcatgctgttcttataaggggctattgtttagaaaattaattcttctctttgaaaaataaaagttttttgctttctttcaa
aatcactgagttctcactgggctaaataaataacttacattacagcaatctgtaatcctattttgtaatatcaagcattgtaa
actttttgatatttgacaaacttcacaaaataaaattctaaattcagtcatttgacctcattattcttttatgatattaggtcc
ccaaagccaaaattaaacatattcagcttatttggtataattaaaaatatgcaggaagcaatgtcaaatttgcaaagtgttta
actttggactatatttaaataaatgtggactatataattggactatatttatataaattaaagagtatattttccaaaattgt
atgagattcaagtgatttgatatgtcttagtatattttatcagtagtatttatgattattatgtaaaatttctgtttattgcc
agaaataagcaaatcttctcctcaattctgtctttaaccatggctattctaaaacttcagtcatccacagttggtgtttttact
ttgattctttatcaggtggcttatagtaatctatagaattttgaggagtactcaaatatacgattgtgacaatttttataaatt
gtgccattggtatagagattaaaaacttccatgactctcattgatacctgattcatttatgatgattgttaatctaatattaag
caggacaggacttaattgcatgaactgaattgacagaagactgaaattgttttttatggcttattcttttaatgcatttgctaat
tacttatgttctgttttttcagaatcaggaaaagtttgtcttttaagctcttcacagttgttaacaattgagtatggtatact
ttactgataaaaaataaaaacataatatcttcttatttacataatttctccaaaatttggaaactgtgagtattcttatatc
aaaatagttatttgcataggttcaataaaaacctgctttcttccataacagggcacaattggagacaatggtcatttactaa
ggctttaacttgaattatatattttcagatttactttataaaatgaatctaacctggagagctgataaagcccccttgggaaaa
ctggcatgcacattttttttttttttacagggccccgaactgtagtaagtaaacaatttaatttctgacagacccaggactccc
aggttttcttggaaacttgaaaaaagagaaagtaacccaattcacatagctatctggtggcacagataaaatattggctgggc
ttgaagattttaaagattctaccctttgattccttataaaaaatttccagcaaagtcaatttatggaataaaattggcctatg
tacaaacaaaaaatagaaaacaaaaagagagctaatatgttaaagggttactttggctggcatcttatacaaaaaaaccaggg
ccaagtctcataagcctaaaactgatttttaccaaatagttagtcctactatgattttttgtgtctaaaaaattggggaattata
gagagaaatattatttcaaaataaactatagtgcatcagttaatagattttaacctgtccacttgcttttcaatttatatta
ttttctacaatttggactgaattttaaagcgtatctttgcacgagtctccaaaataatgttttcagttatttcccttttttaaa
tattttttcctggcttgaaatcagcagaagttaaactgtgcttcttacagctagacaatgtaaattctaaaagaaaacaaaat
caatgtatatggtttggctccgtgtccctacccaaatctcaccttgtattgtaataattcacacattgcaagggtggaatgagg
tggagataattgaatcatagggctgttttcttcatgcttttctcctgttagtgagtgagttctcacaagatttgataattttt
```

FIG. 7 (Cont. 35)

```
atgaggggcttccctcttcacttaacacttctctctcctgcagtcatgtgaaatagcatgtgtttgctaccccttcatcatg
attgtaagttttttgtggcctccccagccatgcagaactgtgagtcaattaaacctatttttctttaaaaattacccagcctc
gtgtatgtccttatagcaacctgaaaatggactgatacaagcaacttaactacatacgaagtctccttttgtacctgcctat
gtgaagagaaaataaatcttgagaccccaaaatcactaagctaaagagaagagtccagctggtgtaataggagatagaaagaa
attatttaggtagatagttaggatgaaagagtctctggcaaaacttttcttctcacaagaattagctcagaaataacttcttt
tctaatcagacacagttcaaagagatcacttctaacaaagagcagcctgaaagatcgggctgtaaaacatagataaacaactc
tggcagagagggtatttctgtgtgtaatcaccaaagttcacatacataggatgggtcccaataaaaacatgggtcttaatga
gcacattcctttccttttctgggtcacactgagataggaaagctgttagcttgcacggggtttgggatgcctccagctgcaa
ggaggtaccagggacctggcatggaaactcctccccccttttcagcacatgcatggtggaaggagataaggaacgtggagca
gaccaagctaagtccccacctgcataataaaagcatgagatgggctgccagagacttcgctctctgcagatggcacacctgg
tcctgcttttgcaccttatgttgataagaagccatctcccacgagcacatttataaaaatccttacgttgataagatactgt
ctccccacgagcacatttataaaaatccttacattttactgcggcacagcaacccatctgggacctttctgtgacagagaga
ttttttttccttttacacattaaatttctgctctaacctcactctttgtgtgtctgtgtccttgattttcatagccacgacac
aaagaacctttggtgatattccagataacaaaggtgctttactggagagggctttgggcaacctgcctcccattctattcaaa
gtgattcctctgaggcccacacgagacagatacatatctgattgcttcctcttcagtatcatttatgaaaaaatgaagattca
ctaagtctgactaaattgtggattcagtggtaggctgataaaggacttaaaataatgcaacctactgtgtcttatctacttct
aaactgcaaaaccccctttcaatttgtcctgtcttgaaggaaaaaaaatgtacattttacatatattgattgatgtctcatgt
ctctctaaaatgtataaaatcaagctgtacttcaatcgccttgggcacatgtctcaggacttcctgaggctggtcatgggtgg
gttcttaacttttggcaaaataaatgtattagtctgttctcctgctactaataaaaacataaccaagcctgggtaatttataaa
gcaatgaggtttaatggacttatagttccacatggctgggaatgcttcaaaatcatgtcaggaaagcaagggacatcttacat
ggtggcagacaagagagagcttgcacaggggaactcccttgataaaaccatcagatctaatgggacttattcactatcatga
gaacagcatgggaaagtgctgacttactgcaggagaactacataattttatattttcctatatgcttcttttttcattacacat
gtaaattttcataccatccaaatttccccttacccagcttttcctctttatatattgaaagccctaaaaattgtctttgggga
atggcactaaccacacacagttctgtgattacttttattttcttccaggcatgtcctggaaagacataatttccttgggga
aaattaattttaatttgattaagatctgtctcagaaaccttcggtttacactaggaaagatcccaaattaggagccaattact
gtaaaaatcagccataccactctgtgagtgtgtgtgtgtggcggggggtgtatatgtgtgtgtacatgcatgtttcattt
ctgtgggctttaagccatgtagttctctctgcgaagatactatttggcatgaccttttgaatagagaattgtaagagaaataag
aggctcctatgaattatccgaaagtttctggactcaccatgtatcttgactgtgtcattgcatctgacagtcccagggaagtg
actctctggtggtttcatgaatctgtgcttgggctctctctgcagtttactgggtatagtaatgacaaatcactgttcaaga
gacaatttcgaaagcattagatgctgctgagagaggattatgaaccaggggacagccccttcattctggggagcgacattgg
gagaatatgctctgtgagcccaaacagcttcctcccctgcagggtgagggcagagctgcaggacaggcccagaacccactcaa
cacagatgtcagccctggagctgctgcagaggagtctgaggagaaaattttaccagcacctgaattacacttatttcaaacaa
aaatgcatgtcctgtgagtgtttgtttccctattggaggagttctgtactcatgaagttctggacatgccagcggacaaatat
cagtaaacaaacatcagaacttgaacctcagcttcccactgttgcattctccatgtgtcatctctattatttctcatgctaga
tcaggtatttagctatgaaatattccagctaattaacgtgtaaatagcttgaagtctactgagttaaatacatatattttctc
ttgttttttgccaggtgttccctcccacacctccaatagtctccactattatcatcatcttctagatcttctgcgatgcctgg
agattaaggatttgattccatgacagagaggaggtgcatttcgatggaactttggtgaaaaccttggtctttatcccatttcc
tctgggctccaccagtgcctctggaatcatggtttcagtggctgcccctgcatggtaggtcattccttttattctgtagtgc
tgatgaggggagtgggtctgaacgcattcagtagtatgggctctccttctgtctcagacactttgggaaaggaaaattttc
tgagcgtcctccattctagaacaaaggggattcaattgtataggaatgctgaaaatagaaaaccttcagccaaattaaggttaat
aagattaattgagcaatggatgattcatgaattgggcagccccagaatcacagcagattcaaagagacttcagtgcagtcac
ggggtggaagaagatttatagattagaaaaatgatgtacagaaatcagaagtgaggtacagaaacagctggattggttacagg
ttgcttttgtcttatttaaacaaggtgtgcaccctcaagagtgtacgagtggttgaggtatggctgctggaattggccaagac
tccgctgttgttacaggcgcatgctccgaagttggcttttcaatctcgtccacctattcaggtaggttacagtttgtccacaa
ggactcaaacacagaagtacggagtccttttcaggccatatttaattcactttatcagtgcccttcagtatgtggttcctgag
aatttcacatgacaacacgtttaccacactggaatttaagcaatccaacacgtttgtagctttgtcttgtaatgggctatatt
tcatgtggcagcctcggcctcagtttagctaacactatggcttcatttctctacaagaactcatttcttccaagatttcca
tgttcctgaaaggaaaataaaccctttgggaccccatatcactaagccaaagggaagtcaagctgaaattgtttgggcaaa
cccacctccattcttccctaaaatgagagctactaaggttttaaaagctacagacctccttcaaaattgaccacaagtaa
aatccttgtggaccaggacagagagagtcattctctgctcatgtaagtcaaacgcatacctgattgctccctgtgctctac
tgtttcactaaatcagactaaggcctacgtgactattcctgtaaattgtgcattcagttaaaggctaatcagaaactcaaata
atgcaaccatttctctcaaacctacctatgatctagaagccctctccccacttcaagttgtcctgcctttctgaactaaatca
atgtacatctgatatatatatattgattaatgtctcatgtctccctaaattgtataaaaccaagctgtgcccacaagcttggg
cacatgtcgtcagcactccctgaggctgtgtcacaggcatgtccttaatcttggaaattgaacttcctaaatctattgagatt
agtctcagatactctttggtttacaggttgtttttatttcataacttcaattatttgacatgctaaagaaaatttgccaaat
agcgcattctcttgtttatgtgttattgttgttgcaaaataatatattttatatataattatcatctatgtacattaccaa
attgagtagcagatttattagtaagacccaaagtaatgaaaagttcagataccaattagcaacttagaaaaacaaattatgct
acatttgtttgctgaaatgctacctatattttaaaaaataaacaatacaacataaaggttttaattctcagtatttctatt
gagaaaaataagccaaatagatgagtacatactatattatttcattcttataaattctagagaataaaaactagtctaaagaa
atatgaaaacatcagtacttttataaagaaatggtagaagaaaaggagaaaaacaaaaatatatctataaaagagcaagagga
attctgagtgagttgacttgtcacctcttgaaaatagagactttctttatcaaaattactattgtacaggttaaatatgt
gaatttctcatctgtcaattaaaactcataaaattattacaagtaacaagtgaaatttagacaaaaaagggatgataag
aaggaacaaataaatacattaaatgtcagatacaccaaaaatgtatctgcctgacgcctagttgtctctgtattttaggtaa
atgcagcaaaatcacacaggttgtcgtggcaggaagtggattctgcaaaccacactaggccgtttatctctgtcctgtagttg
gttcagagcaactgaggccagctgtgaggcgcataggcccaggtactaggactcactcatgccagatataagccctgagacac
gtacatagcccctccatgtgtgggttcacttttacatctgtacatgaagaaaccactgactcctaaataacatcatctataca
```

FIG. 7 (Cont. 36)

```
cataggtaaaaaaattaaaaatatgatagttgttaaatgtttatcgcagaacaatttcaaaataaggcagcattttcccaaat
acaatcattgtcatcaaaatccccaggacgctctcatctactctgcgccctgccttcacctcagatgtcccaccccagagct
tgctatatagtaacagacatgcaaatagttgactccctctcctgatgaaaaccagcccagccctgaccctgcagctctgggag
tggagccccagccttgggattcccaagtgtttgtattcagtgatcaggactgaacacacaggactcaccatggagttgggggct
gagctgggttttccttgttgctatattagaaggtgattcatgtgagaactagagatattgagtgtgaatgggcatgaatgagag
aaacagtgggtatgtgtggcaatttctgactttttgtgtctctgtgtttgcaggtgtccagtgtgaggtgcagctggtggagtc
tgggggaggcttggtacagcctggggggtccctgagactctcctgtgcagcctctggattcaccttcagtagctacgacatgc
actgggtccgccaagctacaggaaaaggtctggagtgggtctcagctattgtactgctggtgacacatactatcaggctcc
gtgaagggccgattcaccatctccagagaaaatgccaagaactcctgtatcttcaaatgaacagcctgagagccggggacac
ggctgtgtattactgtgcaagagacacagtgaggggaagtcagtatgagcccagacacaaacctccctgcagaatgcctgggg
gaaatcagctgcaggggggcgcacaggacccactgatcagagtcatcccccagaggcaggtgcagatggaggctggtttcctgtc
aggatgtgggacttcatcttttttagagtttctctagggaacctctctaagttcagaattctgtgcttaccaatgccatcccta
catattttaaaatgattattttaatatgaaaacctattctcttatgcacgaaacacagactgatgcttacagagatgaaaag
ccctcaaccattgtcaccaggatcagagtattgaggaaactcaggggtacctggtgggtcttctccactcagactcaggacag
aaacctcagtgagattccctgactaggacggtctcttaggaattgtgatcgcagccaatagagagtctgggcaaggatcagtgt
catgtagaacttcacaggtttcacttctgacccttctcctgacactaaagtatacaacttagtatcagcactgatctgggggcc
ccttttgctcttagcccattctatttcttttttatttgttgttgttgttcttgcttttccttgtagtgttcctgctccctgtaa
agtggggatgtggctcttgctgccaaagctccaggtctcaagccccattccctgcagctcaggtggggctcaggctgtggctcc
tgcagccacgtggaagaggctgatgggactttcctctctccattgctcagcaccctccagtgtgtcacgtggagactcacct
gcgaatggaagtggccaacagtagtgaaggggatgagcttgtgtggacaaaatgggatgtggatgtgaaatttatcctgtgct
gtgcaaagtagcacagagtgagtcaccttcctcaccagtagtgttagaaagagggtgtgaaagttgtcagaatcaaaatagat
ccacttgtgttaaaaccctgacaaatggaactaggaatgaccatgaaggaggtttcccatgcacatactcctgataacaagat
cgaccataaatggattctgcttaaccacaaccttttgatagaagccaccatgacctttataaaaatcacttctacaaggacatct
tcccagcaaatcacggtttaaccctatactgatgccaaccttggtattgactctacaagcaaggaaaatcctctcaaaacaat
ttatgcaacccacctcattttcactcataaacctatggattgacatcgcctcccatgattccaacactgagttcagacttgt
acatggaactatcttgcatgttttgtgcacagacagatggaccaaccatgattagtggatggatggatgatggatgga
tggatggatggatggatggatggatggatggatggatagatggatggatggatggctgagtaggtgtggtggatggaagagtgaaaagatagatgg
atgcatgtatgtggatgggtaggtgatggatcatggatggatgggtgatgga ggtgagtgatgaatggatgggtaggtg
ggtggctacatgctggatgagtacttggatagatagtgagtggatggatggatgatggatgatgggtatgaaggcat
ggatgtatttagagtgggtagttaggcaggcatgagctgatagtcaagtgattgtaaactgcctctctaaaataataattggt
ctggctggacgcggtggctcatgtctgtaatcccaacactttgggaggctgaggtggcggatcacaaggtcaagagattga
gaccatcctgaccaacatggtgaaaccctgtctttactaaaaatacaaaaattagctgggcgtgtgtggcgtgcatctatagtt
ccagctactcgggaggctgaggcagcagaattgcttgaacctgggaggaagaggctgcagtgagctgagattgtgccactgca
ctccagcctggtgacagagcaaagctctgtctcaaataataataataataataaataataattgatctcagcagcgccaaga
aaaggcagtctcccaatagatagaaaacaccgaaactggtcatcagcagcttcctgataagatctcaggcattgggtgagtg
ggctcaagcatatgcactaagaggcaaagtggcagagtttaactggcacataacttcctctaggaacactctaatagtaaga
gaaggacacctcaaatgagcatgtgcacattttcattaaacccactgtgtatgcagcccctcccaagtgctggcaggccactgt
acatgtgggcagcccactccaagggaagaatcaagggagaagaaatacaaatcccaaaccatgtcaatgtataaaacccaa
gtcaagggccgacagagcactagatctctcaagtcgcccactagccctctccaagtgtactttacttcttagttccc
acttaaaactttaataaacattactcctgtctaaaacttgcttgggtctccactctctgtatgccccttggccaaatt
ctttcctcaaggaggcagaatcaagttgctgcagacctgtatggattcgctcctgctaacagatagctggatgggggaca
gatgcatgaattagtggatggacgtttgatgtgtgggtgggtgggtggattgcgggatggctgatgaatgcatggctggat
ggtggacagatgcatgaattagtggatgatgtttgatgtgtgaagtgggtgggtggattgtgggatggctggatgaatgca
tggctggatggtggacagatgcatgaattcgtggatggacgtttgatgtgtgaagtgggtggtgggtggattgtgggatggctgg
atgaatgcatggctggatgggtggacagatgcatgaattcgtggatggacgttgggatgtgtgggtggtgggtggatgtgg
gatggctggatgaatgcatggctggatgggtggacagatgcatgaattcgtggatggacgtttggatgtgtgggtggtgggt
ggattgtgggatggctggatgaatgcatggctggatgggtggatgatgcatggataagtggtggacggatggacgggtgagt
ggatgggtgatgtgtgtggatgggtggataggaaagccctctaattgattacaggctcagtgtgtgcttcaacatcatg
atggcatcatcacatggtgcctgtatgaagcagtggggaggagatgtaccaggggagcaggaatgactttttctccagaat
cgacctctccaccctgagcgtgcagcgcacattggaagaggtgcgtgcgactactcctaaatgttgttgtgtcc
astggcttgttgacgttgatgtaggaatgagcctacatctccaccatagatggaactgtttgggttcccaaaagcagaaagcct
cttctgttgcaggtgctgaagtttccatctttcttctgcttatacggaagctcacgcatccttgatggcaggcgtcaggttc
ctgtgcgcactgagttcccccttacatgctttggacagaagtgtgagacacacaagattgctgcaggaagtcacctgtggg
gatgctgcgacttctccagcaagaacacgagtctgctcattgaccatcaccacacataacaaattaagtgtccttttttgat
aacacgtcattgtttcacagagtattcttttaaagtgtataagtgtgactgcagtattattttttacttctgttaataattta
ctcataattaggcacaatttacacttaagaaatttcttaatagttttttcctccttaaggtgaactacagtcagataacatac
ttatcaattgtctctagctcttgtcagaaaacatatagatgtgtgtgtgcgtgtgtcttggccttccaatgatgaattaag
atgtgcattgagaaggcattcactttatttgacgttaaggaagtaccaagaagacgctctccacagaccctgggaaagccagc
agctgcaacccgaggctgtgccaggcaggaacaaggaggcagcaccacctgcgggcaggaaaatgtcctcccagccctg
ccgcttctctgcagaggcacaaagagctgcccttcctctgggccttctcctggctgatgagattgctccccgatacccaa
atcaggttgtgcatctgaggctcgtctagactctgacctccttcctactcctgcaagtgaagaaacaatgcaagggt
cctggaggcgtctacccggagagttttgactctcttcaatagtctccacctccccgtcctccatgtcctccgttt
ctcccctaaagcgggtgccagtctgattgcactgtggcaggagataacgaggccaggacatcaggggagagaagtttctacct
gagtcacagcagcgggctgccctgcagactcctgaagacacaagacacatttccatcccagagaccccagcgaaatgcaacctca
ggctagagacagcacagttattttttcttgttctgtcctgagaggccactgagaaagtcgagcccttgttgagaaaacatg
agatctctgtgtgtcgtctctgccctgatggctgtacctccatgtgagtgtctcagagatttcagaacggggggctgtgggctg
```

FIG. 7 (Cont. 38)

```
tgacaatctaaaaacttgtcacacttcacatggatctgtcatggcggaaacagcggttatcaatcacaagaaacgtaaaata
gccgcgaatcgtccagtcaaacgacctcactgaggcggcatatagtctctcccgggatcaaaaacgtatgctgtatctgttc
gttgaccagatcagaaaatctgatggcaccctacaggaacatgacggtatctgcgagatccatgttgctaaatatgctgaaat
attcggattgacctctgcggaagccagtaaggatatacggcaggcattgaagagtttcgcggggaaggaagtggtttttatc
gccctgaagaggatgccggcgatgaaaaaggctatgaatcttttccttggtttatcaaacgtgcgcacagtccatccagaggg
ctttacagtgtacatatcaacccatatctcattcccttctttatcgggttacagaaccggtttacgcagtttcggcttagtga
aacaaaagaaatcaccaatccgtatgccatgcgtttatacgaatccctgtgtcagtatcgtaagccggatggctcaggcatcg
tctctctgaaaatcgactggatcatagagcgttaccagctgcctcaaagttaccagctgtatgcctgacttccgccgccgcttc
ctgcaggtctgtgttaatgagatcaacagcagaactccaatgcgcctctcatacattgagaaaaagaaaggccgccagacgac
tcatatcgtattttccttccgcgatatcacttccatgacgacaggatagtctgagggttatctgtcacagatttgagggtggt
tcgtcacatttgttctgacctactgagggtaatttgtcacagttttgctgtttccttcagcctgcatggattttctcatactt
tttgaactgtaattttttaaggaagccaaatttgagggcagtttgtcacagttgatttccttctctttcccttcgtcatgtgac
ctgatatcgggggttagttcgtcatcattgatgagggttgattatcacagtttattactctgaattggctatccgcgtgtgta
cctctacctggagttttttcccacggtggatatttcttcttgcgctgagcgtaagagctatctgacagaacagttcttctttgc
ttcctcgccagttcgctcgctatgctcggttacacggctgcggcgagcgctagtgataataagtgactgaggtatgtgctctt
cttatctccttttgtagtgttgctcttattttaaacaacttttgcggtttttttgatgacttttgcgattttgttgttgctttgca
gtaaattgcaagatttaataaaaaaacgcaaagcaatgattaaaggatgttcagaatgaaactcatggaaacacttaaccagt
gcataaacgctggtcatgaaatgacgaaggctatcgccattgcacagtttaatgatgacagcccggaagcgaggaaaataacc
cggcgctggagaataggtgaagcagcggatttagttggggtttcttctcaggctatcagagatgccgagaaagcagggcgact
accgcaccggatatggaaattcgaggacgggttgagcaacgtgttggttatacaattgaacaaattaatcatatgcgtgatg
tgtttggtacgcgattgcgacgtgctgaagacgtatttccaccggtgatcggggttgctgcccataaaggtggcgtttacaaa
acctcagtttctgttcatcttgctcaggatctggctctgaaggggctacgtgttttgctcgtggaaggtaacgaccccaggg
aacagcctcaatgtatcacggatgggtaccagatcttcatattcatgcagaagacactctcctgcctttctatcttggggaaa
aggacgatgtcacttatgcaataaagcccacttgctggccggggcttgacattattccttcctgtctggctctgcaccgtatt
gaaactgagttaatgggcaaatttgatgaaggtaaactgcccaccgatccacacctgatgctccgactggccattgaaactgt
tgctcatgactatgatgtcatagttattgacagcgcgctaacctgggtatcggcacgattaatgtcgtatgtgctgctgatg
tgctgattgttcccacgcctgctgagttgtttgactacacctccgcactgcagtttttcgatatgcttcgtgatctgctcaag
aacgttgatcttaaagggttcgagcctgatgtacgtatttttgcttaccaaatacagcaatagtaatggctctcagtccccgtg
gatggaggagcaaattcggatgcctggggaagcatggttctaaaaaatgttgtacgtgaaacggatgaagttggtaaaggtc
agatccggatgagaactgttttgaacaggccattgatcaacgctcttcaactggtgcctggagaaatgctctttctatttgg
gaacctgtctgcaatgaaatttcgatcgtctgattaaaccacgctgggagattagataatgaagcgtgcgcctgttattcca
aaacatacgctcaatactcaaccggttgaagatacttcgttatcgacaccagctgccccgatggtggattcgttaattgcgcg
cgtaggagtaatggctcgcggtaatgccattactttgcctgtatgtggtcgggatgtgaagtttactcttgaagtgctccggg
gtgatagtgttgagaagacctctcgggtatggtcaggtaatgaacgtgaccaggagctgcttactgaggacgcactggatgat
ctcatcccttcttttctactgactggtcaacagacaccggcgttcggtcgaagagtatctggtgtcatagaaattgccgatgg
gagtcgccgtcgtaaagctgctgcacttaccgaaagtgattatcgtgttctggttggcgagctggatgatgagcagatggctg
cattatccagattgggtaacgattatcgcccaacaagtgcttatgaacgtggtcagcgttatgcaagccgattgcagaatgaa
tttgctgaaatattctcgcgctggctgatgcggaaaatatttcacgtaagattattaccccgctgtatcaacaccgccaaatt
gcctaaatcagttgttgctctttttctcaccccggtgaactatctgcccggtcaggtgatgcacttcaaaaagcctttacag
ataaagaggaattacttaagcagcaggcatctaaccttcatgagcagaaaaaagctggggtgatatttgaagctgaagaagtt
atcactctttttaacttctgtgcttaaaacgtcatctgcatcaagaactagtttaagctcacgacatcagtttgctcctggagc
gacagtattgtataagggcgataaaatggtgcttaacctggacaggtctcgtgttccaactgagtgtatagagaaaattgagg
ccattcttaaggaacttgaaaagccagcaccctgatgcgaccacgttttagtctacgttttatctgtctttacttaatgtcctt
tgttacaggccagaaagcataactggcctgaatattctctctgggcccactgttccacttgtatcgtcggtctgataatcaga
ctgggaccacggtcccactcgtatcgtcggtctgattattagtctgggaccacggtcccactcgtatcgtcggtctgattatt
agtctgggaccacggtcccactcgtatcgtcggtctgataatcagactgggaccacggtcccactcgtatcgtcggtctgatt
attagtctgggaccatggtcccactcgtatcgtcggtctgattattagtctgggaccacggtcccactcgtatcgtcggtctg
attattagtctggaaccacggtcccactcgtatcgtcggtctgattattagtctgggaccacggtcccactcgtatcgtcggt
ctgattattagtctgggaccacgatcccactcgtgttgtcggtctgattatcggtctgggaccacggtcccacttgtattgtc
gatcagatatcagcgtgagactacgattccatcaatgcgtgtcaaggcaagtattgacatgtcgtaacctgtagaacg
gagtaacctcggtgtgcggttgtatgcctgctgtggattgctgctgtgtcctgcttatccacaacattttgcgcacggttatg
tggacaaaatacctggtgatcgccaacaaatactacctttatcttgctcttcctgctctcaggtattaatgccgaattgttt
catcttgtctgtgtagaagaccacacacgaaatcctgtgattttacatttttacttatcgttaatcgaatgtatatctattta
atctgcttttcttgtctaataaatatatatgtaaagtacgcttttttgttgaaattttttaaacctttgtttatttttttttct
tcattccgtaactcttctaccttctttatttactttctaaaatccaaatacaaaacataaaaataaataaacacagagtaaat
tcccaaattattccatcattaaaagatacgaggcgcgtgtaagttacaggcaagcgatccgtctaagaaaccattattatcat
gacattaacctataaaaataggcgtatcacgaggccctttcgtctttgcgatcgcacaccgcagggtaataactgatataatt
aaattgaagctctaatttgtgagtttagtatacatgcatttacttataatacagttttttagttttgctggccgcatcttctc
aaatatgcttcccagcctgcttttctgtaacgttcaccctctaccttagcatccctttccttttgcaaatagtcctcttccaac
aataataatgtcagatcctgtagagaccacatcatccacggttctatactgttgacccaatgcgtctcccttgtcatctaaac
ccacaccggtgtcataatcaaccaatcgtaacctctcatctcttccaccccatgtctcttgacaataaagccgataacaaaa
tcttttgtcgctcttcgcaatgtcaacgtaccccttagtatattcccagtagatagggagccttgcatgacaattctgctaa
catcaaaggcctctaggttccttgttacttcttctgccgcctgcttcaaaccgctaacaatacctgggcccaccacaccgt
gtgcattcgtaatgtctgcccattctgctattctgtatacacccgcagagtactgcaatttgactgtattaccaatgtcagca
aatttctgtcttcgaagagtaaaaaattgtacttggcggataatgcctttagcggcttaactgtgcctccatgaaaaatc
agtcaagatatccacatgtgttttagtaaacaaattttgggacctaatgcttcaactaactccagtaattccttggtggtac
```

```
gaacatccaatgaagcacacaagtttgtttgcttttcgtgcatgatattaaatagcttggcagcaacaggactaggatgagta
gcagcacgttccttatatgtagctttcgacatgatttatcttcgtttcctgcaggttttgttctgtgcagttgggttaagaa
tactgggcaatttcatgtttcttcaacactacatatgcgtatatataccaatctaagtctgtgctccttccttcgttcttcct
tctgttcggagattaccgaatcaaaaaatttcaaagaaaccgaaatcaaaaaaagaataaaaaaaaatgatgaattgaat
tgaaaagcgtgtg
```

FIG. 7 (Cont. 40)

HUMAN ANTIBODIES FROM TRANSGENIC RODENTS WITH MULTIPLE HEAVY CHAIN IMMUNOGLOBULIN LOCI

SEQUENCE LISTING

The instant application contains a Sequence Listing which has been filed electronically in ASCII format and is hereby incorporated by reference in its entirety. Said ASCII copy, created on Sep. 6, 2019, is named 189315_PCT_US_SL.txt and is 3,973,157 bytes in size.

FIELD OF INVENTION

The invention relates to transgenic animals useful for the production of immunoglobulins with human idiotypes in rodents, and methods for making the same. The invention further relates to compositions and methods for the production of humanized and fully human antibodies using polynucleotides derived from modified large regions on bacterial artificial chromosomes and their combined tandem integration. Crossbreeding of independently obtained transgenic animals allowed the expression of highly diverse human antibody repertoires using many different, potentially all, human VH, D and JH segments. Expression is managed in vivo by regulating separate integration sites in unison such as to obtain VH gene diversity and choice without interference.

BACKGROUND OF THE INVENTION

Human monoclonal antibodies have proven to be invaluable in therapeutic applications, either as IgG of conventional size, single chains or domain modules (Chan & Carter *Nature reviews. Immunology* 10, 301-316 (2010); Enever et al. *Current opinion in biotechnology* 20, 405-411 (2009)). Despite the successes there are still major shortcomings in their production, which relies either on specificity selection of available human material and subsequent modification of individual products, or the immunization of the limited availability of transgenic animals (Brüggemann et al. Part I: Selecting and shaping the antibody molecule, Selection Strategies III: Transgenic mice, in Handbook of Therapeutic Antibodies. Ed. Dübel, S. *Wiley-VHC*, 69-93 (2007)).

DNA rearrangement and expression of human immunoglobulin (Ig) genes in transgenic animals was pioneered over 20 years ago by stably inserting heavy-chain genes in germline configuration (Bruggemann, M. et al. *PNAS* 86, 6709-6713 (1989)). One problem associated with the therapeutic application of non-human immunoglobulins is the potential immunogenicity of the same in human patients. In order to reduce the immunogenicity of such preparations, various strategies for the production of chimeric, partially human (humanized) and fully human antibodies have been developed. Chimeric antibodies comprise a human constant region and a binding region encoded by non-human V-genes. The ability to produce transgenic antibodies having a human idiotype in non-human animals is particularly desirable as antigen binding determinants lie within the idiotype region, and non-human idiotypes are thought to contribute to the immunogenicity of current antibody therapeutics. Human idiotype is an especially important consideration in respect of monoclonal antibody therapeutics, which consist of a single idiotype delivered at relatively high concentration as opposed to the variety of idiotypes delivered at lower concentrations by a polyclonal antibody mixture.

Major improvements resulting in higher expression levels and exclusive production of human Ig, combined two new strategies: gene knock-out in embryonic stem (ES) cells (Kitamura et al. *Nature* 350, 423-426 (1991)) and locus extension on artificial chromosomes (Davies et al. *Nucleic acids research* 21, 767-768 (1993)). Silencing of the endogenous Ig genes by gene targeting in ES cells produced several inactive mouse lines without the ability to rearrange their IgH and IgL locus or without producing fully functional IgH, IgK or IgL products. More recently zinc finger nucleases (ZFNs) were designed to generate site-specific double-strand breaks in Ig genes, which allowed gene disruption by deletion and non-homologous DNA repair. Injection of ZFN plasmids into fertilized eggs produced Ig silenced rats and rabbits with IgH and IgL disruptions (Geurts, A. M. et al. *Science* 325, 433 (2009); Menoret, S. et al. *European journal of immunology* 40, 2932-2941 (2010); Flisikowska, T. et al. *PloS one* 6, e21045 (2011)).

A significant technical challenge encountered with many prior art approaches to producing humanized transgenic antibodies in non-human animals relates to the apparent competition between duplicate Ig loci in the same animal, e.g, an existing or endogenous Ig locus and an exogenous or artificial locus introduced into the transgenic animal. Historically, in the absence of effective knock-out the endogenous locus out-competes the exogenous locus for antibody production, such that the duplicate locus is effectively silenced (Lonberg et al., *Nat Bio*, 23, 1117, 2005; Nicholson et al. *J Immunol*, 163, 6898, 1999; Brüggemann et al., *AITE* 63, 101, 2015). In this regard, therefore, the prior art does not address or resolve whether duplicate Ig loci integrated at different chromosomal sites can act cooperatively in the production of transgenic antibodies in the same host animal, and in fact would reasonably suggest to the skilled artisan that the opposite is true.

Another technical challenge encountered with the production of transgenic antibodies having a human idiotype in non-human animals is the difficulty with providing the full complement of human immunoglobulin VDJ or VJ gene-segments used to generate the human antibodies. Some have attempted to address the problem by introducing megabase-sized fragments from the human heavy and kappa light chain loci. However, this approach has only proven successful with roughly 80% of the human immunoglobin gene included in the germ-line configuration and has relied on the use of protoplasts to deliver the large fragments of the relevant chromosomes with a yeast artificial chromosome (YAC) system (U.S. Pat. No. 5,939,598).

While integration of extensive overlapping $V_H$ D $J_H$ regions, such as to maintain the full functionality of the IgH locus and essential for DNA rearrangement, have been utilized in transgenic animals in order to maximize antibody diversity, the overlapping integration had primarily been reported for much smaller regions (<100 kb) (Wagner et al. *Genomics* 35, 405-414 (1996); Bruggemann et al. *European journal of immunology* 21, 1323-1326 (1991)) or with larger regions but still having a limited repertoire at a single integration site (WO2014/093908; Bruggemann et al.). At the time of filing, the common understanding in the art was that spreading or multiple integration of BAC or YAC mixtures were rare and would be a disadvantage for breeding to homozygosity. Moreover, laborious integration of large YACs into stem cells and subsequent animal derivation therefrom was more commonly performed (Mendez et al. *Nature genetics* 15, 146-156 (1997); Davies et al. *Biotechnology (NY)* 11, 911-914 (1993)).

Optimal production of immunoglobulins or antibodies maximizing the diversity of antibodies with human idiotypes using transgenic animals with the full complement of human V-genes remains a challenge for the generation of novel specificities for therapeutic applications in a broad range of disease areas.

SUMMARY OF INVENTION

The current invention resolves the foregoing uncertainties in the art with the provision of a transgenic animal comprising a plurality of artificial Ig heavy chain loci comprising duplicate/overlapping human immunoglobulin VDJ or VJ gene segments integrated at different chromosomal sites, and lacking the capacity to produce endogenous immunoglobulin. The method used to generate these transgenic animals comprising the insertion of two different loci in two different locations on two different chromosomes surprisingly produced functional B cells that advantageously avoids allelic exclusion and provides increased antibody diversity as a result of the full complement of human immunoglobulin VDJ heavy chain gene segments integrated into the genome of the transgenic animal.

In one aspect of the invention, novel polynucleotides are disclosed comprising nucleic acid sequences encoding chimeric immunoglobulin chains, particularly chimeric heavy chains for use in creating transgenic animals. The polynucleotides of the present invention advantageously provide optimal expression due, at least in part, to the inclusion of a 3' enhancer since transloci lacking this 3' enhancer result in impaired isotype switching and low IgG expression. Accordingly, in preferred embodiments the invention provides chimeric polynucleotides comprising a rat 3' enhancer sequence, an Ig constant region gene and at least one human immunoglubulin (Ig) joining (J) region gene. In a preferred embodiment, the rat 3' enhancer sequence comprises the sequence set forth as SEQ ID NO:1, or a portion thereof.

In one embodiment, the chimeric polynucleotides set forth herein may further comprise at least one human variable (V) gene, at least one diversity (D) gene, or a combination thereof. In one embodiment, the constant region gene of the chimeric polynucleotide is selected from the group consisting of a human constant region gene and a rat constant region gene. In a preferred embodiment, the constant region gene is a rat constant region gene. In another preferred embodiment, the constant region gene is selected from the group consisting of Cμ and Cγ.

In one embodiment, the chimeric polynucleotide comprises a nucleic acid sequence substantially homologous to the bacterial artificial chromosome (BAC) Annabel disclosed herein (e.g., SEQ ID NO:10, or a portion thereof), and may optionally further comprise at least one human variable Ig gene isolatable from a BAC6-$V_H$3-11 and BAC3 construct and/or from a BAC9 and BAC14/5 construct. In a preferred embodiment, the chimeric polynucleotides contemplated herein comprise nucleic acid sequences (a) and (b) in 5' to 3' order: (a) a human Ig variable region comprising human V genes in natural configuration isolatable from a BAC6-$V_H$3-11 and BAC3 construct and/or a BAC9 and BAC14/5 construct, and (b) a human Ig joining region comprising human J genes in natural configuration isolatable from the BAC Annabel. In another embodiment, each of the human Ig variable region, human Ig diversity region, human Ig joining region, the Ig constant region and the rat 3' enhancer region of a chimeric polynucleotide as disclosed herein are in the relative positions as shown in FIG. 1a. In another embodiment, a chimeric polynucleotide as disclosed has a sequence comprising or substantially homologous to the sequence set forth as SEQ ID NO:2 or a portion thereof. In another embodiment, a chimeric polynucleotide as disclosed has a sequence comprising or substantially homologous to the sequence set forth as SEQ ID NO:11, or a portion thereof. In a further embodiment, a chimeric polynucleotide as disclosed herein comprises a rearranged V-D-J regions, wherein said rearranged V-D-J regions encode a heavy chain variable domain exon.

In one embodiment, the transgenic animal further comprises a chimeric polynucleotide wherein said human Ig V region comprises at least one human V region gene isolatable from BAC9 and/or BAC14/5. In a preferred embodiment, the chimeric polynucleotides comprise nucleic acid sequences (a) and (b) in 5' to 3' order: (a) a human Ig variable region comprising human V region genes in natural configuration used (or rearranged) from BAC9 and/or BAC14/5; and (b) a human Ig joining region comprising human J region genes in natural configuration used (or rearranged) from the bacterial artificial chromosome (BAC) Annabel. In another embodiment, each of the human immunoglobulin variable region (gene), the human immunoglobulin diversity region (segment), the human immunoglobulin joining region (segment), the immunoglobulin constant region gene, and the rat 3' enhancer are in the positions shown in FIG. 1b. In another embodiment, a chimeric polynucleotide as disclosed has a sequence comprising or substantially homologous to the sequence set forth in FIG. 6. In another embodiment, a chimeric polynucleotide as disclosed has a sequence comprising or substantially homologous to the sequence set forth in FIG. 7, or a portion thereof. In a further embodiment, chimeric polynucleotides as disclosed herein may comprise rearranged V-D-J, wherein said rearranged gene segments are derived from the above SEQ ID NOs and Figures.

Also disclosed herein are polynucleotides encoding human kappa light chain genes. In one embodiment, a polynucleotide as disclosed herein has a nucleic acid sequence comprising or substantially homologous to a nucleic acid sequence selected from the group consisting of RP11-1156D9 (set forth as SEQ ID NO:3) and RP11-1134E24 (set forth as SEQ ID NO:4). In another embodiment, the isolated polynucleotide comprises nucleic acid sequences (a) and (b) in 5' to 3' order: (a) a human Ig variable region comprising human V genes in natural configuration isolatable from bacterial artificial chromosomes (BAC) RP11-156D9 and/or RP11-1134E24; (b) a human Ig joining region comprising human J genes in natural configuration isolatable from the bacterial artificial chromosomes (BAC) RP11-1134E24 and/or RP11-344F17 (set forth as SEQ ID NO:5). In a preferred embodiment, each of the human Ig variable region, the human Ig joining region, and the human Ig constant region are in relative position as shown in FIG. 2. In another embodiment, a chimeric polynucleotide as disclosed has a sequence comprising or substantially homologous to the sequence set forth as SEQ ID NO:6 or a portion thereof.

Also provided herein is a rodent cell comprising one or more polynucleotides of the invention. For example, provided herein is a rodent cell comprising a polynucleotide as disclosed herein, preferably comprising a nucleic acid sequence encoding for a chimeric heavy chain, e.g., a nucleic acid sequence encoding a rat 3' enhancer sequence, an Ig constant region gene and at least one human J region gene, and, optionally, comprising a nucleic acid sequence substantially homologous to the nucleic acid sequence selected from the group consisting of RP11-1156D9, RP11-1134E24 and portions thereof. The rodent cell contemplated herein may further comprise a polynucleotide encoding a functional light chain, e.g., having a nucleic acid sequence comprising or substantially homologous to a nucleic acid sequence selected from the group consisting of the sequence shown in FIG. 2a (set forth as SEQ ID NO:6), the sequence shown in FIG. 2b (set forth as SEQ ID NO:7), and portions thereof. In one embodiment, one or more of the polynucleotides are integrated into the rodent cell genome.

In another aspect of the invention, a transgenic animal is provided which comprises at least one inactivated endogenous Ig locus and a plurality of artificial transgenic Ig heavy chain loci integrated in the animal's genome at different chromosomal sites. In one embodiment, the transgenic animal having a plurality of artificial Ig heavy chain loci comprises (i) a V-region having at least one human V gene segment encoding a germline or hypermutated human V-region amino acid sequence; (ii) one or more J gene segments; and (iii) one or more constant region gene segments, wherein said artificial Ig heavy chain loci are functional and capable of undergoing gene rearrangement and act cooperatively to produce a repertoire of artificial immunoglobulins. In another embodiment, the transgenic animal comprises the full complement of human variable heavy chain regions. In other various embodiments, the transgenic animal i) has an artificial heavy chain loci which comprises overlapping heavy chain gene segments, ii) lacks a functional endogenous Ig light chain locus and/or iii) lacks a functional endogenous Ig heavy chain locus. In yet another embodiment, the transgenic animal expresses a diverse repertoire of antibodies encoded by V-genes from transgenic immunoglobulin loci located at different chromosomal sites.

In some embodiments, the transgenic animal lacks a functional Ig light chain locus and is capable of producing heavy chain-only antibodies.

In another embodiment, the transgenic animal with at least two artificial Ig heavy chain loci has at least one artificial Ig heavy chain loci which comprises at least one human immunoglobulin (Ig) joining (J) region gene, an Ig constant region gene, and a rat 3' enhancer. In these transgenic animals the rat 3' enhancer may comprise the sequence set forth as SEQ ID NO:1. The transgenic animal described in the above embodiments which may further comprise at least one human Ig variable (V) region gene and/or a human Ig diversity (D) region gene. In other embodiments of the invention the constant region gene is selected from the group consisting of a human constant region gene and a rat constant region gene. In certain embodiments the constant region gene comprises a constant region gene selected from the group consisting of Cμ and Cγ. In various embodiments the transgenic animal comprises a nucleic acid sequence substantially homologous to bacterial artificial chromosome (BAC) Annabel, or a portion thereof.

In certain embodiments, the human Ig V region of the transgenic animal comprises at least one human V region gene isolatable from BAC6-$V_H$3-11 and/or BAC3. In a specific embodiment the transgenic animal comprises nucleic acids with (a) a human Ig variable region comprising human V region genes in natural configuration isolatable from BAC6-$V_H$3-11 and/or BAC3; and (b) a human Ig joining region comprising human J region genes in natural configuration isolatable from the bacterial artificial chromosome (BAC) Annabel, in 5' to 3' order. In one embodiment each of the human immunoglobulin variable region, the human immunoglobulin diversity region, the human immunoglobulin joining region, the immunoglobulin constant region, and the rat 3' enhancer are in the relative positions shown in FIG. 1a. In another embodiment the transgenic animal has a nucleic acid sequence substantially homologous to the nucleic acid sequence set forth as SEQ ID NO:2. In yet another embodiment the transgenic animal has a nucleic acid sequence substantially homologous to the nucleic acid sequence set forth as SEQ ID NO:11. In some embodiments the transgenic animal has V-D-J regions which are rearranged and form a complete exon encoding a heavy chain variable domain.

In certain other embodiments, the transgenic animal has an human Ig V region which comprises at least one human V region gene isolatable from BAC9-$V_H$3-53 and/or BAC14/5. In a specific embodiment these transgenic animals comprises nucleic acids with (a) a human Ig variable region comprising human V region genes in natural configuration isolatable from BAC9-$V_H$3-53 and/or BAC14/5; and (b) a human Ig joining region comprising human J region genes in natural configuration isolatable from the bacterial artificial chromosome (BAC) Annabel, in 5' to 3' order. In one embodiment each of the human immunoglobulin variable region, the human immunoglobulin diversity region, the human immunoglobulin joining region, the immunoglobulin constant region, and the rat 3' enhancer are in the relative positions shown in FIG. 1b. In another embodiment the transgenic animal has a nucleic acid sequence substantially homologous to the nucleic acid sequence set forth in FIG. 6. In yet another embodiment the transgenic animal has a nucleic acid sequence substantially homologous to the nucleic acid sequence set forth in FIG. 7.

In another aspect of the invention, a method for producing antibodies is provided which comprises immunizing the transgenic animal as described above with an immunogen. In one embodiment a polyclonal antisera composition is produced wherein said antisera comprise antigen-specific antibodies encoded by V-genes encoded by transgenic immunoglobulin loci located at different chromosomal sites. In another embodiment the method for producing a monoclonal antibody comprises (i) immunizing the transgenic animal described above with an immunogen, (ii) isolating a monoclonal antibody producing cell from said transgenic animal wherein said monoclonal antibody producing cell produces a monoclonal antibody that specifically binds to said immunogen; and (iii) using said monoclonal antibody producing cell to produce said monoclonal antibody that specifically binds to said immunogen, or using said monoclonal antibody producing cell to produce a hybridoma cell that produces said monoclonal antibody and using said hybridoma cell to produce said monoclonal antibody.

In another embodiment, the method for producing a monoclonal antibody, comprises (i) immunizing the transgenic animal as described above with an immunogen, (ii) isolating a monoclonal antibody producing cell from said transgenic animal wherein said monoclonal antibody producing cell produces a monoclonal antibody that specifically binds to said immunogen; (iii) isolating from said monoclonal antibody producing cell a monoclonal antibody nucleic acid which encodes said monoclonal antibody that specifically binds to said immunogen; and (iv) using said monoclonal antibody nucleic acid to produce said monoclonal antibody that specifically binds to said immunogen. In certain embodiment the monoclonal antibody has a human idiotype.

In yet another embodiment the method for producing a fully human monoclonal antibody comprises (i) immunizing the transgenic animal as described above with an immunogen, (ii) isolating a monoclonal antibody producing cell from said transgenic animal wherein said monoclonal antibody producing cell produces a monoclonal antibody that specifically binds to said immunogen; (iii) isolating from said monoclonal antibody producing cell a monoclonal antibody nucleic acid which encodes said monoclonal antibody that specifically binds to said immunogen; (iv) modifying said monoclonal antibody nucleic acid to produce a recombinant nucleic acid encoding a fully human monoclonal antibody; and (v) using said recombinant nucleic acid encoding a fully human monoclonal antibody to produce the encoded fully human monoclonal antibody.

Another aspect of the present invention is a monoclonal antibody produced by the method described above.

In yet another aspect a method for neutralizing an antigenic entity in a human body component is provided which comprises contacting said body component with a polyclonal antisera composition as described above, wherein said polyclonal antisera composition comprises immunoglobulin molecules that specifically bind and neutralize said antigenic entity. In one embodiment the method for neutralizing an antigenic entity in a human body component comprises contacting a body component with the monoclonal antibody according to the above, wherein said monoclonal antibody specifically binds to and neutralizes said antigenic entity.

BRIEF DESCRIPTION OF THE DRAWINGS

Figure 6:
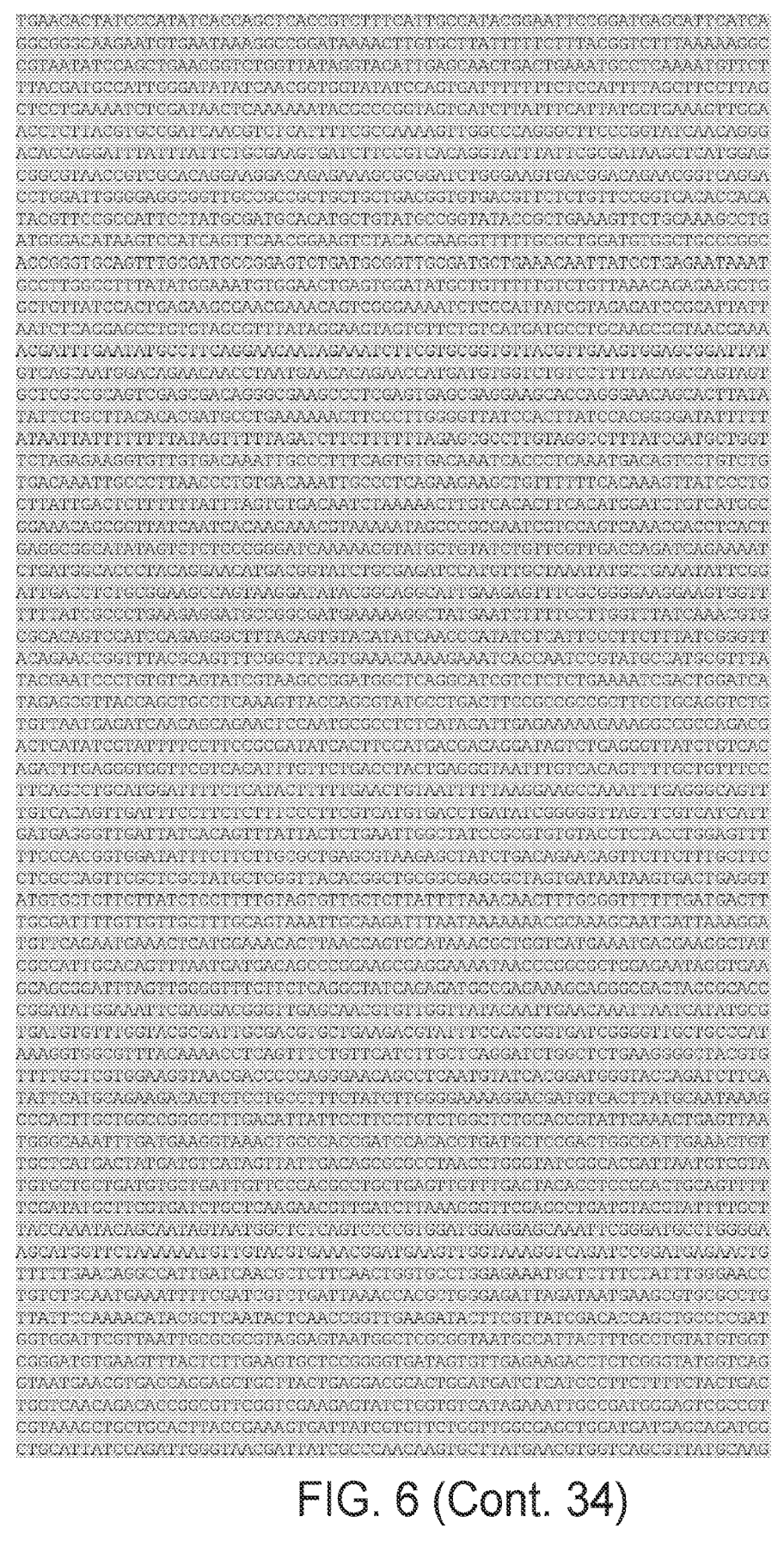
Figure 6:
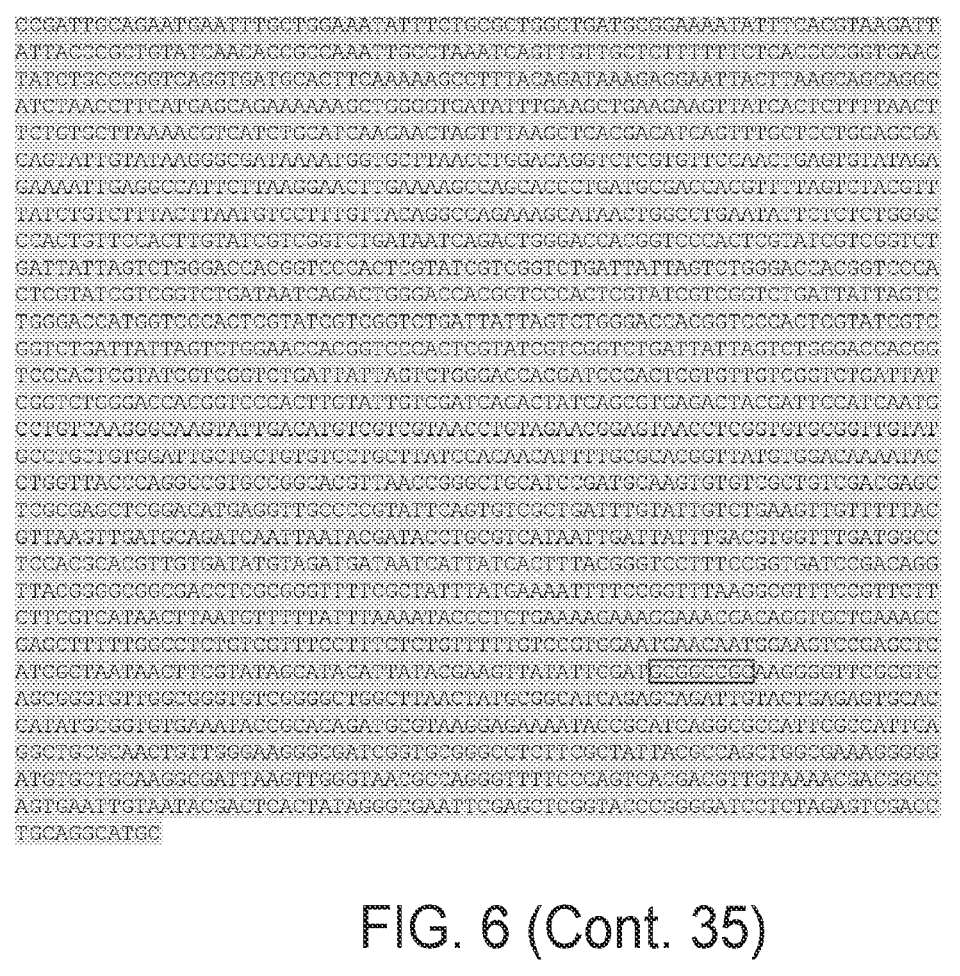

FIG. 6: BAC 9 sequence (SEQ ID NOS 109-111, respectively, in order of appearance)..

Figure 7:
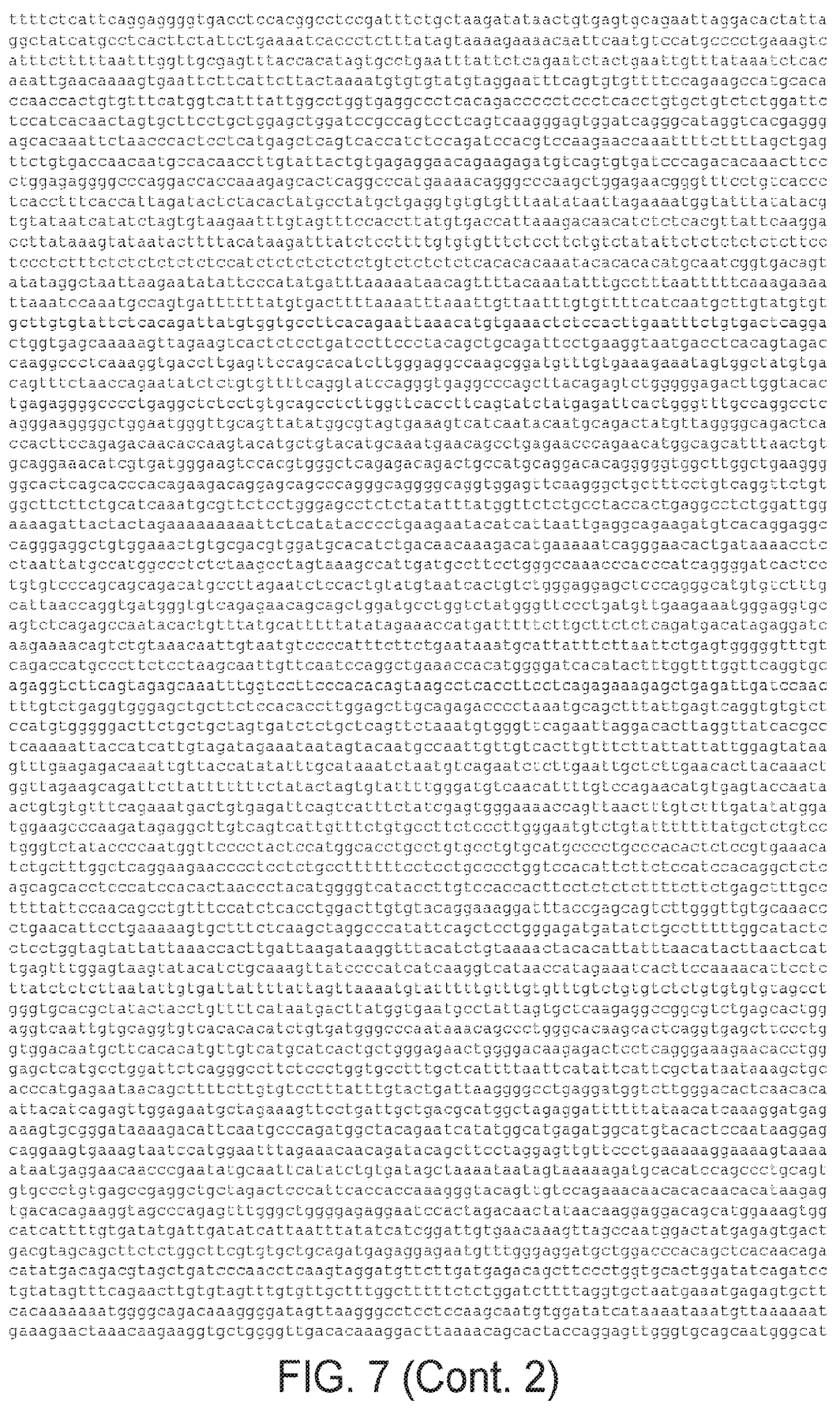
Figure 7:
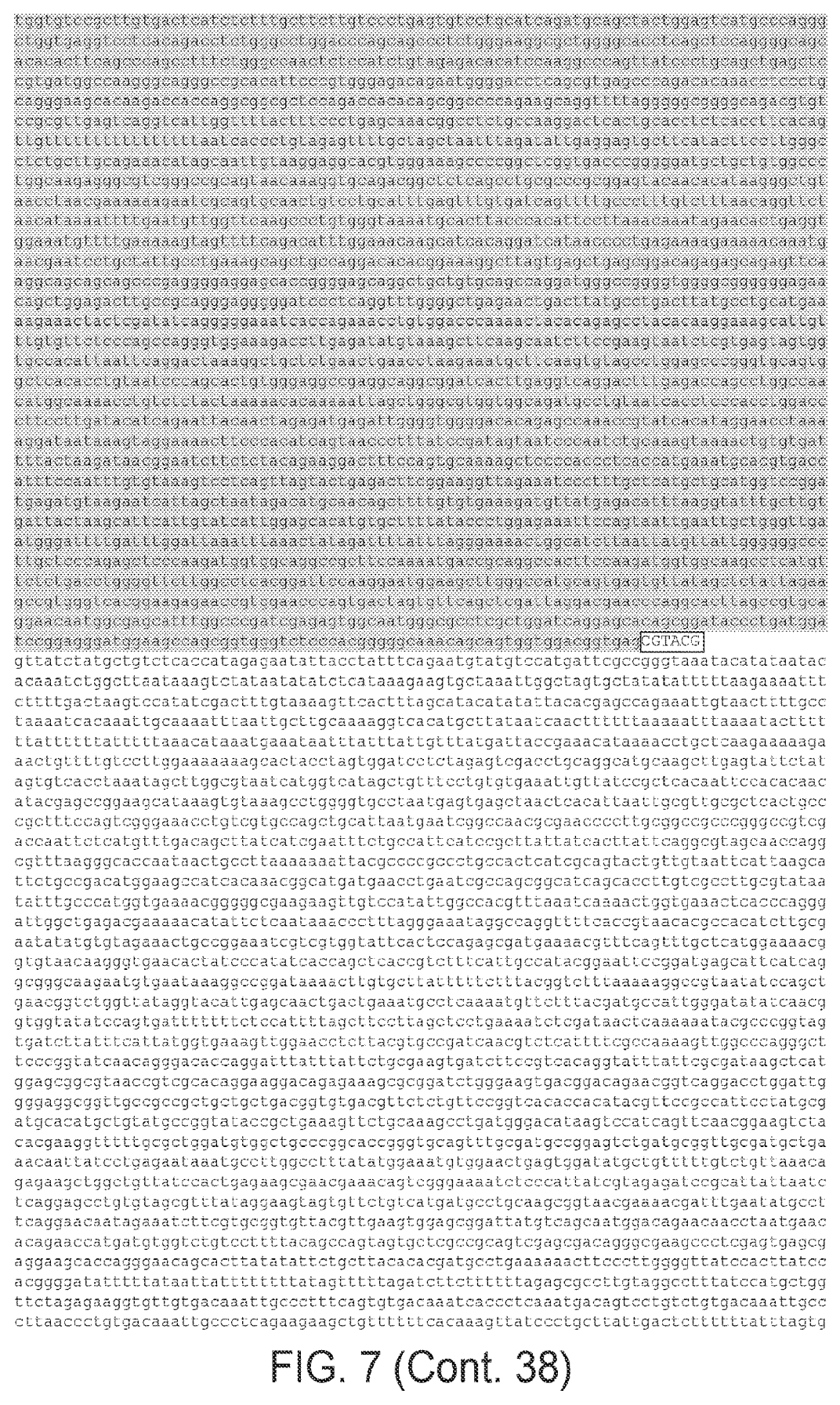

FIG. 7: BAC 14/5 sequence (SEQ ID NO: 112).

DETAILED DESCRIPTION

Figure 1A:
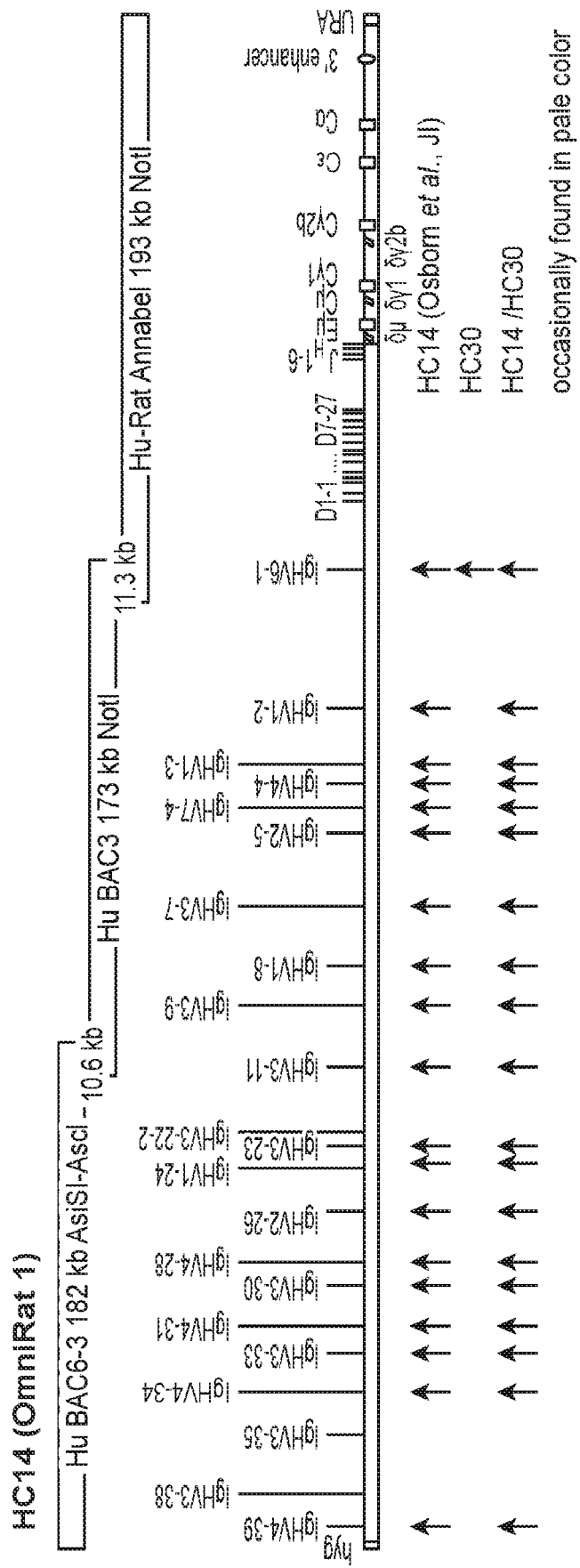
FIG. 1: A summary of the integrated chimeric (human, rat) and fully human Ig loci. The 2 chimeric human-rat IgH regions (HC14 and HC30) contain each 3 overlapping BACs with ≥22 different and potentially functional human $V_H$ segments. In HC14 BAC6-3 has been extended with $V_H$3-11 to provide a 10.6 kb overlap to BAC3, which overlaps 11.3 kb via $V_H$6-1 with the C region BAC Hu-Rat Annabel (A) and in HC30 BAC9 provides an overlap of 4.6 kb to BAC14/5, which was extended by adding VH3-43 followed by part of BAC5 and equipped with an overlap of 6.1 kb to Hu-Rat Annabel (B). The latter is chimeric and contains all human D and $J_H$ segments followed by the rat C region with full enhancer sequences. Arrows indicate the VH gene usage in HC14, HC30 and HC14/HC30 combined. Fainter bands indicate less frequently expressed VH genes. Sequences were obtained by unbiased RT-PCR and NGS.

Provided herein are chimeric polynucleotides encoding a recombinant or artificial immunoglobulin chain or loci. As described above, the chimeric polynucleotides disclosed herein are useful for the transformation of rodents to include human Ig genes and for the production of immunoglobulins or antibodies having human idiotypes using such rodents. As further provided herein, transgenic animals are generated that comprise at least three distinct transgene constructs harboring the full complement of human immunoglobulin VDJ heavy chain gene segments tandemly integrated into the genome of the transgenic animal, thereby ensuring the availability of the entire human immunoglobulin genes in germ-line configuration in a background of complete inactivation of endogenous immunoglobulin genes or locus. Unexpectedly, as demonstrated herein for the first time, a plurality of transgenic loci comprising different V-genes can act cooperatively in the expression of humanized and fully human transgenic antibodies.

Definitions

Immunoglobulin refers to a protein consisting of one or more polypeptides substantially encoded by immunoglobulin genes. The recognized human immunoglobulin genes include the kappa, lambda, alpha (IgA1 and IgA2), gamma (IgG1, IgG2, IgG3, IgG4), delta, epsilon and mu constant region genes, as well as the myriad immunoglobulin variable region genes. Full-length immunoglobulin "light chains" (about 25 Kd, or 214 amino acids) generally comprise a variable domain encoded by an exon comprising one or more variable region gene(s) and one or more joining region gene(s) at the $NH_2$-terminus (about 110 amino acids) and constant domain encoded by a kappa or lambda constant region gene at the COOH-terminus. Full-length immunoglobulin "heavy chains" (about 50 Kd, or 446 amino acids), similarly comprise (1) a variable domain (about 116 amino acids) encoded by an exon comprising one or more variable region genes, one or more diversity region genes and one or more joining region genes, and (2) one of the aforementioned constant domains comprising one or more constant region genes, e.g., alpha, gamma, delta, epsilon or mu (encoding about 330 amino acids). The immunoglobulin heavy chain constant region genes encode for the antibody class, i.e., isotype (e.g., IgM or IgG1).

As used herein, the term "antibody" refers to a protein comprising at least one, and preferably two, heavy (H) chain variable domains (abbreviated herein as VH), and at least one and preferably two light (L) chain variable domains (abbreviated herein as VL). An ordinarily skilled artisan will recognize that the variable domain of an immunological chain is encoded in gene segments that must first undergo somatic recombination to form a complete exon encoding the variable domain. There are three types of regions or gene segments that undergo rearrangement to form the variable domain: the variable region comprising variable genes, the diversity region comprising diversity genes (in the case of an immunoglobulin heavy chain), and the joining region comprising joining genes. The VH and VL domains can be further subdivided into regions of hypervariability, termed "complementarity determining regions" ("CDRs") interspersed with regions that are more conserved, termed "framework regions" ("FRs"). The extent of the FRs and CDRs has been precisely defined (see, Kabat et al. (1991) Sequences of Proteins of Immunological Interest, Fifth Edition, U.S. Department of Health and Human Services, NIH Publication No. 91-3242; and Chothia et al. (1987) *J. Mol. Biol.* 196:901-17, which are hereby incorporated by reference). Each VH and VL domain is generally composed of three CDRs and four FRs, arranged from amino-terminus to carboxy-terminus in the following order: FR1, CDR1, FR2, CDR2, FR3, CDR3, FR4. The antigen binding fragment of an antibody (or simply "antibody portion," or "fragment"), as used herein, refers to one or more fragments of a full-length antibody that retain the ability to specifically bind to an antigen (e.g., CD3).

Examples of binding fragments encompassed within the term "antigen binding fragment" of an antibody include (i) an Fab fragment, a monovalent fragment consisting of the VL, VH, CL and CH1 domains; (ii) an F(ab')$_2$ fragment, a bivalent fragment comprising two Fab fragments linked by a disulfide bridge at the hinge region; (iii) an Fd fragment consisting of the VH and CH1 domains; (iv) an Fv fragment consisting of the VL and VH domains of a single arm of an antibody, (v) a dAb fragment (Ward et al. (1989) Nature 341:544-46), which consists of a VH domain; and (vi) an isolated complementarity determining region (CDR). Furthermore, although the two domains of the Fv fragment, VL and VH, are coded for by separate genes, they may be joined, using recombinant methods, by a synthetic linker that enables them to be made as a single protein chain in which the VL and VH regions pair to form monovalent molecules (known as single chain Fv (scFv); see, e.g., Bird et al. (1988) Science 242:423-26; and Huston et al. (1988) Proc. Natl. Acad. Sci. USA 85:5879-83). Such single chain antibodies are also intended to be encompassed within the term "antigen binding fragment" of an antibody. These antibody fragments are obtained using conventional techniques known to those skilled in the art, and the fragments are screened for utility in the same manner as are intact antibodies.

An antibody may further include a heavy and/or light chain constant domain to thereby form a heavy and light immunoglobulin chain, respectively. In one embodiment, the antibody is a tetramer of two heavy immunoglobulin chains and two light immunoglobulin chains, wherein the heavy and light immunoglobulin chains are interconnected, e.g., by disulfide bonds. The heavy chain constant domain is comprised of three gene segments, CH1, CH2 and CH3. The light chain constant domain is comprised of one gene, CL. The variable domains of the heavy and/or light chains contain a binding domain that interacts with an antigen. The constant domains of the antibodies typically mediate the binding of the antibody to host tissues or factors, including various cells of the immune system (e.g., effector cells) and the first component (C1q) of the classical complement system.

By polynucleotide encoding an artificial immunoglobulin locus or artificial immunoglobulin chain is meant an recombinant polynucleotide comprising multiple immunoglobulin regions, e.g., a variable (V) region or gene segment comprising V genes, a joining (J) gene region or gene segment comprising J genes, a diversity (D) region or gene segment comprising D genes in the case of a heavy chain locus and/or at least one constant (C) region comprising at least one C gene. Preferably, each region of the variable domain, e.g., V, D, or J region, comprises or spans at least two genes of the same type. For example a variable region as used herein comprises at least two variable genes, a joining region comprises at least two joining genes and a diversity region comprises two diversity genes. A constant region may comprise only one constant gene, e.g. a κ gene or λ gene, or multiple genes, e.g., CH1, CH2, and CH3.

"Enhancer sequences" or "enhancer" as used herein refers to sequences that have been identified near many active genes by nuclease digest and hypersensitivity to degradation. Hypersensitive sites may precede promoter sequences and the strength of their activity was correlated with the DNA sequence. Linkage to reporter genes showed elevated transcription if enhancer function was present (Mundt et al., J. Immunol., 166, 3315 [2001]). In the IgH locus two important transcription or expression regulators have been identified, Eμ and the 3'E at the end of the locus (Pettersson et al., Nature, 344, 165 [1990]). In the mouse the removal of the whole 3' regulatory region (containing hs3a, hs1,2, hs3b and hs4) allows normal early B-cell development but abrogates class-switch recombination (Vincent-Fabert et al., Blood, 116, 1895 [2010]) and possibly prevents the optimization of somatic hypermutation (Pruzina et al., Protein Engineering, Design and Selection, 1, [2011]). The regulatory function to achieve optimal isotype expression is particularly desirable when transgenic human IgH genes are being used. Transgene constructs with incomplete 3'E region, usually only providing the hs1,2 element, led to disappointing expression levels in transgenic mice even when the endogenous IgH locus was knocked-out. As a consequence, only few antigen-specific fully human IgGs have been isolated from constructs produced in the last 20 years (Lonberg et al., Nature 368, 856 [1994]; Nicholson et al., J. Immunol., 163, 6898 [1999]; Davis et al., Cancer Metastasis Rev. 18, 421 [1999]; Pruzina et al., Protein Engineering, Design and Selection, 1, [2011]). In the rat IgH locus, the 3'E region has only been poorly analyzed. A comparison of mouse and rat sequences did not allow identification of hs4, the crucial 4$^{th}$ element with additional important regulatory sequences further downstream (Chatterjee et al., J. Biol. Chem., 286, 29303 [2011]). The polynucleotides of the present invention advantageously provide optimal expression due, at least in part, to the inclusion of a rat 3' enhancer since chimeric polynucleotides lacking this 3' enhancer result in impaired isotype switching and low IgG expression. In one embodiment, the rat 3' enhancer has a sequence comprising or substantially homologous to the sequence set forth as SEQ ID NO:1 or a portion thereof.

As used herein, a polynucleotide having a sequence comprising or substantially homologous to a portion, e.g., less than the entirety, of second sequence (e.g., SEQ ID NO:1, SEQ ID NO:2, etc.) preferably retains the biological activity of the second sequence (e.g., retains the biological activity of a 3' enhancer to provide optimal expression and/or isotype switching of immunoglobulins, is capable of rearrangement to provide a humanized chimeric heavy chain, etc.). In one embodiment, a nucleic acid comprising a sequence comprising or substantially homologous to a portion of SEQ ID NO:1 comprise at least 8 kB, preferably at least 10 kB of continuous nucleic acids that are substantially homologous to SEQ ID NO:1. In another embodiment, a second nucleic acid comprising a sequence comprising or substantially homologous to a portion of SEQ ID NOs:59 or 60 comprise at least 8 kB, preferably at least 10 kB of continuous nucleic acids that are substantially homologous to SEQ ID NOs:59 or 60.

"Artificial Ig locus" as used herein may refer to polynucleotides that (e.g., a sequence comprising V-, D-, and/or J regions in the case of heavy chain, or V- and/or J regions in the case of light chain, and optionally a constant region for either or both a heavy and light chain) that are unrearranged, partially rearranged, or rearranged. Artificial Ig loci include artificial Ig light chain loci and artificial Ig heavy chain loci. In one embodiment, an artificial immunoglobulin locus of the invention is functional and capable of rearrangement and producing a repertoire of immunoglobulin chains. In a preferred embodiment, the variable domain or portion thereof of a polynucleotide disclosed herein comprises genes in natural configuration, i.e., naturally occurring sequences of an human Ig gene segment, degenerate forms of naturally occurring sequences of a human Ig gene segment, as well as synthetic sequences that encode a polypeptide sequence substantially identical to the polypeptide encoded by a naturally occurring sequence of a human Ig gene segment. In another preferred embodiment, the polynucleotide comprises a variable domain or portion thereof in a natural configuration found in humans. For example, a polynucleotide encoding an artificial Ig heavy chain as disclosed herein may comprise in natural configuration at least two human V genes, at least two D genes, at least two J genes or a combination thereof.

In a preferred embodiment, an artificial Ig locus comprises a non-human C region gene and is capable of producing a repertoire of immunoglobulins including chimeric immunoglobulins having a non-human C region. In one embodiment, an artificial Ig locus comprises a human C region gene and is capable of producing a repertoire of immunoglobulins including immunoglobulins having a human C region. In one embodiment, an artificial Ig locus comprises an "artificial constant region gene", by which is meant a constant region gene comprising nucleotide sequences derived from human and non-human constant regions genes. For example, an exemplary artificial C constant region gene is a constant region gene encoding a human IgG CH1 domain and rat IgG CH2 and CH3 domain.

In some embodiments, an artificial Ig heavy chain locus lacks CH1, or an equivalent sequence that allows the resultant immunoglobulin to circumvent the typical immunoglobulin: chaperone association. Such artificial loci provide for the production of heavy chain-only antibodies in transgenic animals which lack a functional Ig light chain locus and hence do not express functional Ig light chain. Such artificial Ig heavy chain loci are used in methods contemplated herein to produce transgenic animals lacking a functional Ig light chain locus, and comprising an artificial Ig heavy chain locus, which animals are capable of producing heavy chain-only antibodies. Alternatively, an artificial Ig locus may be manipulated in situ to disrupt CH1 or an equivalent region and generate an artificial Ig heavy chain locus that provides for the production of heavy chain-only antibodies. Regarding the production of heavy chain-only antibodies in light chain-deficient mice, see for example Zou et al., *JEM,* 204:3271-3283, 2007.

By "human idiotype" is meant a polypeptide sequence present on a human antibody encoded by an immunoglobulin V-gene segment. The term "human idiotype" as used herein includes both naturally occurring sequences of a human antibody, as well as synthetic sequences substantially identical to the polypeptide found in naturally occurring human antibodies. By "substantially" is meant that the degree of amino acid sequence identity is at least about 85%-95%. Preferably, the degree of amino acid sequence identity is greater than 90%, more preferably greater than 95%.

By a "chimeric antibody" or a "chimeric immunoglobulin" is meant an immunoglobulin molecule comprising a portion of a human immunoglobulin polypeptide sequence (or a polypeptide sequence encoded by a human Ig gene segment) and a portion of a non-human immunoglobulin polypeptide sequence. The chimeric immunoglobulin molecules of the present invention are immunoglobulins with non-human Fc-regions or artificial Fc-regions, and human idiotypes. Such immunoglobulins can be isolated from animals of the invention that have been engineered to produce chimeric immunoglobulin molecules.

By "artificial Fc-region" is meant an Fc-region encoded by an artificial constant region gene.

The term "Ig gene segment" as used herein refers to regions of DNA encoding various portions of an Ig molecule, which are present in the germline of non-human animals and humans, and which are brought together in B cells to form rearranged Ig genes. Thus, Ig gene segments as used herein include V gene segments, D gene segments, J gene segments and C gene segments.

The term "human Ig gene segment" as used herein includes both naturally occurring sequences of a human Ig gene segment, degenerate forms of naturally occurring sequences of a human Ig gene segment, as well as synthetic sequences that encode a polypeptide sequence substantially identical to the polypeptide encoded by a naturally occurring sequence of a human Ig gene segment. By "substantially" is meant that the degree of amino acid sequence identity is at least about 85%-95%. Preferably, the degree of amino acid sequence identity is greater than 90%, more preferably greater than 95%

Polynucleotides related to the present invention may comprise DNA or RNA and may be wholly or partially synthetic. Reference to a nucleotide sequence as set out herein encompasses a DNA molecule with the specified sequence, and encompasses an RNA molecule with the specified sequence in which U is substituted for T, unless context requires otherwise.

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent sequence identity between two sequences may be accomplished using a mathematical algorithm. In a preferred embodiment, the percent identity between two amino acid sequences is determined using the Needleman and Wunsch ((1970) *J. Mol. Biol.* 48:444-53) algorithm, which has been incorporated into the GAP program in the GCG software package (available online at gcg.com), using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (available at www.gcg.com), using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about what parameters should be applied to determine if a molecule is within a sequence identity or homology limitation of the invention) is a Blossum 62 scoring matrix with a gap penalty of 12, a gap extend penalty of 4, and a frameshift gap penalty of 5. The percent identity between two amino acid or nucleotide sequences can also be determined using the algorithm of Meyers and Miller ((1989) *CABIOS* 4:11-17), which has been incorporated into the ALIGN program (version 2.0), using a PAM120 weight residue table, a gap length penalty of 12 and a gap penalty of 4.

Artificial Ig Loci

The present invention is further directed to artificial Ig loci and their use in making transgenic animals capable of producing immunoglobulins having a human idiotype. Each artificial Ig locus comprises multiple immunoglobulin gene segments, which include at least one V region gene segment, one or more J gene segments, one or more D gene segments in the case of a heavy chain locus, and one or more constant region genes. In the present invention, at least one of the V gene segments encodes a germline or hypermutated human V-region amino acid sequence. Accordingly, such transgenic animals have the capacity to produce a diversified repertoire of immunoglobulin molecules, which include antibodies having a human idiotype. In heavy chain loci human or non-human-derived D-gene segments may be included in the artificial Ig loci. The gene segments in such loci are juxtaposed with respect to each other in an unrearranged configuration (or "the germline configuration"), or in a partially or fully rearranged configuration. The artificial Ig loci have the capacity to undergo gene rearrangement (if the gene segments are not fully rearranged) in the subject animal thereby producing a diversified repertoire of immunoglobulins having human idiotypes.

Regulatory elements, like promoters, enhancers, switch regions, recombination signals, and the like, may be of human or non-human origin. What is required is that the elements be operable in the animal species concerned, in order to render the artificial loci functional. Preferred regulatory elements are described in more detail herein.

In one aspect, the invention provides transgenic constructs containing an artificial heavy chain locus capable of undergoing gene rearrangement in the host animal thereby producing a diversified repertoire of heavy chains having human idiotypes. An artificial heavy chain locus of the transgene contains a V-region with at least one human V gene segment. Preferably, the V-region includes at least about 5-100 human heavy chain V (or "VH") gene segments. In a preferred embodiments, the V-region includes greater than 20, greater than 25, greater than 30, greater than 35, or greater than 40 VH gene segments. As described above, a human VH segment encompasses naturally occurring sequences of a human VH gene segment, degenerate forms of naturally occurring sequences of a human VH gene segment, as well as synthetic sequences that encode a polypeptide sequence substantially (i.e., at least about 85%-95%) identical to a human heavy chain V domain polypeptide.

In a preferred embodiment, the artificial heavy chain locus contains at least one or several rat constant region genes, e.g., Cδ, Cµ and Cγ (including any of the Cγ subclasses).

In another preferred embodiment, the artificial heavy chain locus contains artificial constant region genes. In a preferred embodiment, such artificial constant region genes encode a human CH1 domain and rat CH2 CH3 domains, or a human CH1 and rat CH2, CH3 and CH4 domains. A hybrid heavy chain with a human CH1 domain pairs effectively with a fully human light chain.

In a preferred embodiment, an artificial Ig locus comprises 3' enhancer sequences, including hs1,2, hs3a, hs3b and sequences between rat Calpha and 3'hs3b.

In another preferred embodiment, the artificial heavy chain locus contains artificial constant region genes lacking CH1 domains In a preferred embodiment, such artificial constant region genes encode truncated IgM and/or IgG lacking the CH1 domain but comprising CH2, and CH3, or CH1, CH2, CH3 and CH4 domains. Heavy chains lacking CH1 domains cannot pair effectively with Ig light chains and form heavy chain only antibodies.

In another aspect, the invention provides transgenic constructs containing an artificial light chain locus capable of undergoing gene rearrangement in the host animal thereby producing a diversified repertoire of light chains having human idiotypes. An artificial light chain locus of the transgene contains a V-region with at least one human V gene segment, e.g., a V-region having at least one human VL gene and/or at least one rearranged human VJ segment. Preferably, the V-region includes at least about 5-100 human light chain V (or "VL") gene segments. Consistently, a human VL segment encompasses naturally occurring sequences of a human VL gene segment, degenerate forms of naturally occurring sequences of a human VL gene segment, as well as synthetic sequences that encode a polypeptide sequence substantially (i.e., at least about 85%-95%) identical to a human light chain V domain polypeptide. In one embodiment, the artificial light chain Ig locus has a C-region having at least one rat C gene (e.g., rat Cλ or Cκ).

Another aspect of the present invention is directed to methods of making a transgenic vector containing an artificial Ig locus. Such methods involve isolating Ig loci or fragments thereof, and combining the same, with one or several DNA fragments comprising sequences encoding human V region elements. The Ig gene segment(s) are inserted into the artificial Ig locus or a portion thereof by ligation or homologous recombination in such a way as to retain the capacity of the locus to undergo effective gene rearrangement in the subject animal.

Preferably, a non-human Ig locus is isolated by screening a library of plasmids, cosmids, YACs or BACs, and the like, prepared from the genomic DNA of the same. YAC clones can carry DNA fragments of up to 2 megabases, thus an entire animal heavy chain locus or a large portion thereof can be isolated in one YAC clone, or reconstructed to be contained in one YAC clone. BAC clones are capable of carrying DNA fragments of smaller sizes (about 50-500 kb). However, multiple BAC clones containing overlapping fragments of an Ig locus can be separately altered and subsequently injected together into an animal recipient cell, wherein the overlapping fragments recombine in the recipient animal cell to generate a continuous Ig locus.

Human Ig gene segments can be integrated into the Ig locus on a vector (e.g., a BAC clone) by a variety of methods, including ligation of DNA fragments, or insertion of DNA fragments by homologous recombination. Integration of the human Ig gene segments is done in such a way that the human Ig gene segment is operably linked to the host animal sequence in the transgene to produce a functional humanized Ig locus, i.e., an Ig locus capable of gene rearrangement which lead to the production of a diversified repertoire of antibodies with human idiotypes. Homologous recombination can be performed in bacteria, yeast and other cells with a high frequency of homologous recombination events. Engineered YACs and BACs can be readily isolated from the cells and used in making transgenic animals Transgenic Animals Comprising Artificial Ig Loci and Capable of Producing Antibodies Having Human Idiotypes In one aspect, the invention provides transgenic animals capable of producing immunoglobulins having human idiotypes, as well as methods of making the same. The transgenic animals used are selected from rodents (e.g., rats, hamsters, mice and guinea pigs).

The transgenic animals used for humanized antibody production in the invention carry germline mutations in endogenous Ig loci. In a preferred embodiment, the transgenic animals are homozygous for mutated endogenous Ig heavy chain and/or endogenous Ig light chain genes. Further, these animals carry at least two artificial heavy chain loc Ig loci that are functional and capable of producing a repertoire of immunoglobulin molecules in the transgenic animal. The artificial Ig loci used in the invention include at least one human V gene segment.

In a preferred embodiment, the transgenic animals carry at least two artificial Ig heavy chain locus and at least one artificial Ig light chain locus that are each functional and capable of producing a repertoire of immunoglobulin molecules in the transgenic animal, which repertoire of immunoglobulin molecules includes antibodies having a human idiotype. In one embodiment, artificial loci including at least one non-human C gene are used, and animals capable of producing chimeric antibodies having a human idiotype and non-human constant region are provided. In one embodiment, artificial loci including at least one human C gene are used, and animals capable of producing antibodies having a human idiotype and human constant region are provided.

In another preferred embodiment, the transgenic animals carry at least two artificial Ig heavy chain loci, and lack a functional Ig light chain locus. Such animals find use in the production of heavy chain-only antibodies.

Production of such transgenic animals involves the integration of at least two artificial heavy chain Ig loci and one or more artificial light chain Ig loci into the genome of a transgenic animal having at least one endogenous Ig locus that has been or will be inactivated by the action of one or more meganucleases. Preferably, the transgenic animals are nullizygous for endogenous Ig heavy chain and/or endogenous Ig light chain and, accordingly, incapable of producing endogenous immunoglobulins. Regardless of the chromosomal location, an artificial Ig locus of the present invention has the capacity to undergo gene rearrangement and thereby produce a diversified repertoire of immunoglobulin molecules. An Ig locus having the capacity to undergo gene rearrangement is also referred to herein as a "functional" Ig locus, and the antibodies with a diversity generated by a functional Ig locus are also referred to herein as "functional" antibodies or a "functional" repertoire of antibodies.

The artificial loci used to generate such transgenic animals each include multiple immunoglobulin gene segments, which include at least one V region gene segment, one or more J gene segments, one or more D gene segments in the case of a heavy chain locus, and one or more constant region genes. In the present invention, at least one of the V gene segments encodes a germline or hypermutated human V-region amino acid sequence. Accordingly, such transgenic animals have the capacity to produce a diversified repertoire of immunoglobulin molecules, which include antibodies having a human idiotype.

In one embodiment, the artificial loci used comprise at least one non-human C region gene segment. Accordingly, such transgenic animals have the capacity to produce a diversified repertoire of immunoglobulin molecules, which include chimeric antibodies having a human idiotype.

In one embodiment, the artificial loci used comprise at least one human C region gene segment. Accordingly, such transgenic animals have the capacity to produce a diversified repertoire of immunoglobulin molecules, which include antibodies having a human idiotype and a human constant region.

In one embodiment, the artificial loci used comprise at least one artificial constant region gene. For example, an exemplary artificial C constant region gene is a constant region gene encoding a human IgG CH1 domain and rat IgG CH2 and CH3 domain. Accordingly, such transgenic animals have the capacity to produce a diversified repertoire of immunoglobulin molecules, which include antibodies having a human idiotype and an artificial constant region comprising both human and non-human components.

The transgenic vector containing an artificial Ig locus is introduced into the recipient cell or cells and then integrated into the genome of the recipient cell or cells by random integration or by targeted integration.

For random integration, a transgenic vector containing an artificial Ig locus can be introduced into a recipient cell by standard transgenic technology. For example, a transgenic vector can be directly injected into the pronucleus of a fertilized oocyte. A transgenic vector can also be introduced by co-incubation of sperm with the transgenic vector before fertilization of the oocyte. Transgenic animals can be developed from fertilized oocytes. Another way to introduce a transgenic vector is by transfecting embryonic stem cells or other pluripotent cells (for example primordial germ cells) and subsequently injecting the genetically modified cells into developing embryos. Alternatively, a transgenic vector (naked or in combination with facilitating reagents) can be directly injected into a developing embryo. Ultimately, chimeric transgenic animals are produced from the embryos which contain the artificial Ig transgene integrated in the genome of at least some somatic cells of the transgenic animal. In another embodiment, the transgenic vector is introduced into the genome of a cell and an animal is derived from the transfected cell by nuclear transfer cloning.

In a preferred embodiment, a transgene containing an artificial Ig locus is randomly integrated into the genome of recipient cells (such as fertilized oocyte or developing embryos). In a preferred embodiment, offspring that are nullizygous for endogenous Ig heavy chain and/or Ig light chain and, accordingly, incapable of producing endogenous immunoglobulins and capable of producing transgenic immunoglobulins are obtained.

For targeted integration, a transgenic vector can be introduced into appropriate recipient cells such as embryonic stem cells, other pluripotent cells or already differentiated somatic cells. Afterwards, cells in which the transgene has integrated into the animal genome can be selected by standard methods. The selected cells may then be fused with enucleated nuclear transfer unit cells, e.g. oocytes or embryonic stem cells, cells which are totipotent and capable of forming a functional neonate. Fusion is performed in accordance with conventional techniques which are well established. See, for example, Cibelli et al., *Science* (1998) 280:1256; Zhou et al. *Science* (2003) 301: 1179. Enucleation of oocytes and nuclear transfer can also be performed by microsurgery using injection pipettes. (See, for example, Wakayama et al., *Nature* (1998) 394:369.) The resulting cells are then cultivated in an appropriate medium, and transferred into synchronized recipients for generating transgenic animals. Alternatively, the selected genetically modified cells can be injected into developing embryos which are subsequently developed into chimeric animals.

In one embodiment, a meganuclease is used to increase the frequency of homologous recombination at a target site through double-strand DNA cleavage. For integration into a specific site, a site specific meganuclease may be used. In one embodiment, a meganuclease targeting an endogenous Ig locus is used to increase the frequency of homologous recombination and replacement of an endogenous Ig locus, or parts thereof with an artificial Ig locus, or parts thereof. In one embodiment, the transgenic animal lacks a functional Ig light chain locus and comprises an artificial Ig heavy chain locus.

The preferred embodiments for integration of the human Ig gene segments using YACs and BACs, and interchanging between the two, has the advantage of both, speed and the ability to check integrity when making constructs of large regions by overlapping homology. The tandem integration of the constructs with overlapping regions have the ability to integrate, such as to maintain the full functionality, which is essential for DNA rearrangement. The preferred embodiments of the invention not only have the desired integration by homology but also produce tandem integration as a frequent event. This eases the transgenic technology substantially as no laborious integration of large YACs into stem cells and subsequent animal derivation therefrom has to be performed. In addition, ZFN technology, also performed via DNA injection (Geurts et al. *Science* 325, 433 (2009); Menoret et al. *European journal of immunology* 40, 2932-2941 (2010)), produced Ig KO strains easily and may well be the future technology of choice for gene disruptions and replacement. Silenced endogenous Ig gene expression in OmniRats™, containing human-rat IgH and human IgL loci, has the advantage that no interfering or undesired rat Ig could give rise to mixed products.

In the mouse an enhancer region downstream of Cα plays a vital role in class-switch recombination (Vincent-Fabert et al. *Blood* 116, 1895-1898 (2010)) and it is likely that elements in that region may facilitate hypermutation (Pruzina et al. *Protein engineering, design & selection: PEDS* 24, 791-799 (2011)). This may be the reason why immune responses and generation of diverse hybridomas at high frequency may be difficult in mice carrying even a large fully human locus (Davis et al. *Cancer metastasis reviews* 18, 421-425 (1999); Lonberg *Current opinion in immunology* 20, 450-459 (2008)). As the chimeric human-rat IgH locus facilitates near wt differentiation and expression levels in OmniRats, it can be concluded that the endogenous rat C region and indeed the ~30 kb enhancer sequence 3' of Cα are providing optimal locus control to express and mature human $V_H$ genes. Another region, Cδ with its 3' control motif cluster (Mundt et al. *J Immunol* 166, 3315-3323 (2001)), has been removed from the chimeric C-region BAC since silencing or a lack of IgD did not appear to reduce immune function (Chen *Immunol Rev* 237, 160-179 (2010)). Normally, mature IgM$^+$IgD$^+$ B-cells down-regulate IgD upon antigen contact, which initiates class-switch recombination (Id). Thus, switching may be increased without IgD control, which is supported by our finding that IgG transcripts and serum levels are significantly lower when the Cδ region is retained in transgenic constructs (data not shown).

The production of specific IgG in OmniRats™ is particularly encouraging as we found that in various immunizations mAbs with diversity in sequence and epitope, comparable to what was produced in wt controls, could be isolated via spleen and lymph node fusion. V-gene, D and J diversity was as expected and nearly all segments were found to be used productively as predicted (Lefranc & Lefranc The immunoglobulin factsbook. *FactsBook Series*, Academic Press, GB, 45-68 (2001)). This was in stark contrast to mice carrying fully human transloci where clonal expansion from a few precursor B-cells produced little diversity (Pruzina et al. *Protein engineering, design & selection: PEDS* 24, 791-799 (2011)). Since the number of transplanted V-genes is only about half of what is used in humans we anticipated to find restricted immune responses and limited diversity when comparing OmniRats with wt animals. However, this was not the case and a comparison of CDR3 diversity in over 1000 clones (sequences can be provided) revealed the same extensive junctional differences in OmniRats as in wt animals. The few identical gene-segment combinations were further diversified by N-sequence additions or deletion at the $V_H$ to D and/or D to $J_H$ junctions and also by hypermutation. Thus, it is clear that the rat C region sequence is highly efficient in controlling DNA rearrangement and expression of human $V_H DJ_H$. Extensive diversity was also seen for the introduced human Igκ and Igλ loci, similar to what has previously been shown in mice (Nicholson et al. *J Immunol* 163, 6898-6906 (1999); Pruzina et al. *Protein engineering, design & selection: PEDS* 24, 791-799 (2011); Popov et al. *The Journal of experimental medicine* 189, 1611-1620 (1999)). Hence, substantially reduced efficiency in the production of human antibodies from mice (Lonberg, N. *Nature biotechnology* 23, 1117-1125 (2005)) has been overcome in OmniRats™, which diversify rearranged H-chains reliably and extensively by class-switch and hypermutation to yield high affinity antibodies in bulk rather than occasionally. The yield of transgenic IgG and the level of hypermutation, impressively utilized in antigen-specific mAbs, showed that clonal diversification and production level are similar between OmniRats™ and wt animals. Routine generation of high affinity specificities in the subnanomolar range was even accomplished by different single immunizations and again compares favorably with wt animals; results that have not been shown in transgenic mice producing human antibody repertoires from entirely human loci (Mendez et al. *Nature genetics* 15, 146-156 (1997)).

In summary, to maximize human antibody production an IgH locus that uses human genes for antibody specificity but rodent genes for control of differentiation and high expression should be regarded essential. L-chain flexibility is a bonus as it permits highly efficient human IgH/IgL assembly even when wt Ig is present. For therapeutic applications chimeric H-chains can be easily converted into fully human Abs by C-gene replacement without compromising the specificity.

Immunoglobulins Having a Human Idiotype

Once a transgenic animal capable of producing immunoglobulins having a human idiotype is made, immunoglobulins and antibody preparations against an antigen can be readily obtained by immunizing the animal with the antigen. "Polyclonal antisera composition" as used herein includes affinity purified polyclonal antibody preparations.

A variety of antigens can be used to immunize a transgenic animal. Such antigens include but are not limited to, microorganisms, e.g. viruses and unicellular organisms (such as bacteria and fungi), alive, attenuated or dead, fragments of the microorganisms, or antigenic molecules isolated from the microorganisms.

Preferred bacterial antigens for use in immunizing an animal include purified antigens from *Staphylococcus aureus* such as capsular polysaccharides type 5 and 8, recombinant versions of virulence factors such as alphatoxin, adhesin binding proteins, collagen binding proteins, and fibronectin binding proteins. Preferred bacterial antigens also include an attenuated version of *S. aureus, Pseudomonas aeruginosa, enterococcus, enterobacter*, and *Klebsiella pneumoniae*, or culture supernatant from these bacteria cells. Other bacterial antigens which can be used in immunization include purified lipopolysaccharide (LPS), capsular antigens, capsular polysaccharides and/or recombinant versions of the outer membrane proteins, fibronectin binding proteins, endotoxin, and exotoxin from *Pseudomonas aeruginosa, enterococcus, enterobacter*, and *Klebsiella pneumoniae*.

Preferred antigens for the generation of antibodies against fungi include attenuated version of fungi or outer membrane proteins thereof, which fungi include, but are not limited to, *Candida albicans, Candida parapsilosis, Candida tropicalis*, and *Cryptococcus neoformans*.

Preferred antigens for use in immunization in order to generate antibodies against viruses include the envelop proteins and attenuated versions of viruses which include, but are not limited to respiratory synctial virus (RSV) (particularly the F-Protein), Hepatitis C virus (HCV), Hepatits B virus (HBV), cytomegalovirus (CMV), EBV, and HSV.

Antibodies specific for cancer can be generated by immunizing transgenic animals with isolated tumor cells or tumor cell lines as well as tumor-associated antigens which include, but are not limited to, Her-2-neu antigen (antibodies against which are useful for the treatment of breast cancer); CD20, CD22 and CD53 antigens (antibodies against which are useful for the treatment of B cell lymphomas), prostate specific membrane antigen (PMSA) (antibodies against which are useful for the treatment of prostate cancer), and 17-1A molecule (antibodies against which are useful for the treatment of colon cancer).

The antigens can be administered to a transgenic animal in any convenient manner, with or without an adjuvant, and can be administered in accordance with a predetermined schedule.

For making a monoclonal antibody, spleen cells are isolated from the immunized transgenic animal and used either in cell fusion with transformed cell lines for the production of hybridomas, or cDNAs encoding antibodies are cloned by standard molecular biology techniques and expressed in transfected cells. The procedures for making monoclonal antibodies are well established in the art. See, e.g., European Patent Application 0 583 980 A1 ("Method For Generating Monoclonal Antibodies From Rabbits"), U.S. Pat. No. 4,977,081 ("Stable Rabbit-Mouse Hybridomas And Secretion Products Thereof"), WO 97/16537 ("Stable Chicken B-cell Line And Method of Use Thereof"), and EP 0 491 057 B1 ("Hybridoma Which Produces Avian Specific Immunoglobulin G"), the disclosures of which are incorporated herein by reference. In vitro production of monoclonal antibodies from cloned cDNA molecules has been described by Andris-Widhopf et al. *J Immunol Methods* 242:159 (2000), and by Burton *Immunotechnology* 1:87 (1995).

Once chimeric monoclonal antibodies with human idiotypes have been generated, such chimeric antibodies can be easily converted into fully human antibodies using standard molecular biology techniques. Fully human monoclonal antibodies are not immunogenic in humans and are appropriate for use in the therapeutic treatment of human subjects. Antibodies of the Invention Include Heavy Chain-Only Antibodies In one embodiment, transgenic animals which lack a functional Ig light chain locus, and comprising at least two artificial heavy chain loci, are immunized with antigen to produce heavy chain-only antibodies that specifically bind to antigen.

In one embodiment, the invention provides monoclonal antibody producing cells derived from such animals, as well as nucleic acids derived therefrom. Also provided are hybridomas derived therefrom. Also provided are fully human heavy chain-only antibodies, as well as encoding nucleic acids, derived therefrom.

Teachings on heavy chain-only antibodies are found in the art. For example, see PCT publications WO02085944, WO02085945, WO2006008548, and WO2007096779. See also U.S. Pat. Nos. 5,840,526; 5,874,541; 6,005,079; 6,765,087; 5,800,988; EP 1589107; WO 9734103; and U.S. Pat. No. 6,015,695.

Pharmaceutical Compositions

In a further embodiment of the present invention, purified monoclonal or polyclonal antibodies are admixed with an appropriate pharmaceutical carrier suitable for administration to patients, to provide pharmaceutical compositions.

Patients treated with the pharmaceutical compositions of the invention are preferably mammals, more preferably humans, though veterinary uses are also contemplated.

Pharmaceutically acceptable carriers which can be employed in the present pharmaceutical compositions can be any and all solvents, dispersion media, isotonic agents and the like. Except insofar as any conventional media, agent, diluent or carrier is detrimental to the recipient or to the therapeutic effectiveness of the antibodies contained therein, its use in the pharmaceutical compositions of the present invention is appropriate.

The carrier can be liquid, semi-solid, e.g. pastes, or solid carriers. Examples of carriers include oils, water, saline solutions, alcohol, sugar, gel, lipids, liposomes, resins, porous matrices, binders, fillers, coatings, preservatives and the like, or combinations thereof.

Methods of Treatment

In a further aspect of the present invention, methods are provided for treating a disease in a vertebrate, preferably a mammal, preferably a primate, with human subjects being an especially preferred embodiment, by administering a purified antibody composition of the invention desirable for treating such disease.

The antibody compositions can be used to bind and neutralize or modulate an antigenic entity in human body tissues that causes or contributes to disease or that elicits undesired or abnormal immune responses. An "antigenic entity" is herein defined to encompass any soluble or cell surface bound molecules including proteins, as well as cells or infectious disease-causing organisms or agents that are at least capable of binding to an antibody and preferably are also capable of stimulating an immune response.

Administration of an antibody composition against an infectious agent as a monotherapy or in combination with chemotherapy results in elimination of infectious particles. A single administration of antibodies decreases the number of infectious particles generally 10 to 100 fold, more commonly more than 1000-fold. Similarly, antibody therapy in patients with a malignant disease employed as a monotherapy or in combination with chemotherapy reduces the number of malignant cells generally 10 to 100 fold, or more than 1000-fold. Therapy may be repeated over an extended amount of time to assure the complete elimination of infectious particles, malignant cells, etc. In some instances, therapy with antibody preparations will be continued for extended periods of time in the absence of detectable amounts of infectious particles or undesirable cells.

Similarly, the use of antibody therapy for the modulation of immune responses may consist of single or multiple administrations of therapeutic antibodies. Therapy may be continued for extended periods of time in the absence of any disease symptoms.

The subject treatment may be employed in conjunction with chemotherapy at dosages sufficient to inhibit infectious disease or malignancies. In autoimmune disease patients or transplant recipients, antibody therapy may be employed in conjunction with immunosuppressive therapy at dosages sufficient to inhibit immune reactions.

Examples

In mice transgenic for human immunoglobulin (Ig) loci, suboptimal efficacy in delivery of fully human antibodies has been attributed to imperfect interaction between the constant regions of human membrane IgH chains and the mouse cellular signaling machinery. To obviate this problem, we here describe a humanized rat strain (OmniRat™) carrying chimeric human/rat IgH loci [comprising 22 human $V_H$s, all human D and $J_H$ segments with germline gene spacing but linked to the rat $C_H$ locus] together with fully human light-chain loci [12 Vκs linked to Jκ-Cκ and 16 Vλs linked to Jλ-Cλ]. The endogenous rat Ig loci were silenced by designer zinc finger nucleases. Following immunization, OmniRats perform as efficiently as normal rats in yielding high affinity serum IgG. Monoclonal antibodies, comprising fully human variable regions with sub-nanomolar antigen affinity and carrying extensive somatic mutations, are readily obtainable—similarly to the yield of conventional antibodies from normal rats.

Materials and Methods
Construction of Modified Human Ig Loci on YACs and BACs a) IgH Loci The human IgH V genes were covered by 2 BACs: BAC6-VH3-11 containing the authentic region spanning from VH4-39 to VH3-23 followed by VH3-11 (modified from a commercially available BAC clone 3054M17 CITB) and BAC3 containing the authentic region spanning from VH3-11 to VH6-1 (811L16 RPCI-11). A BAC termed Annabel was constructed by joining rat CH region genes immediately downstream of the human VH6-1-Ds-JHs region (FIG. 1). All BAC clones containing part of the human or rat IgH locus were purchased from Invitrogen.

Both BAC6-VH3-11 and Annabel were initially constructed in S. cerevisiae as circular YACs (cYACs) and further checked and maintained in E. coli as BACs.

Unlike YACs, BAC plasmid preps yield large quantities of the desired DNA. To convert a linear YAC into a cYAC or to assemble DNA fragments with overlapping ends into a single cYAC in S. cerevisiae, which can also be maintained as a BAC in E. coli, two self-replicating S. cerevisiae/E. coli shuttle vectors, pBelo-CEN-URA, and pBelo-CEN-HYG were constructed. Briefly, S. cerevisiae CEN4 was cut out as an AvrII fragment from pYAC-RC (Marchuk & Collins Nucleic acids research 16, 7743 (1988)) and ligated to SpeI-linearised pAP599 (Kaur & Cormack PNAS 104, 7628-7633 (2007)). The resulting plasmid contains CEN4 cloned in between S. cerevisiae URA3 and a hygromycin-resistance expression cassette (HygR). From this plasmid, an ApaLI-BamHI fragment containing URA3 followed by CEN4 or a PmlI-SphI fragment containing CEN4 followed by HygR was cut out, and ligated to ApaLI and BamHI or HpaI and SphI doubly digested pBACBelo11 (New England Biolabs) to yield pBelo-CEN-URA and pBelo-CEN-HYG.

To construct BAC6-VH3-11, initially two fragments, a 115 kb NotI-PmeI and a 110 kb RsrII-SgrAI, were cut out from the BAC clone 3054M17 CITB. The 3' end of the former fragment overlaps 22 kb with the 5' end of the latter. The NotI-PmeI fragment was ligated to a NotI-BamHI YAC arm containing S. cerevisiae CEN4 as well as TRP1/ARS1 from pYAC-RC, and the RsrII-SgrAI fragment was ligated to a SgrAI-BamHI YAC arm containing S. cerevisiae URA3, also from pYAC-RC. Subsequently, the ligation mixture was transformed into S. cerevisiae AB1380 cells via spheroplast transformation[41], and URA+TRP+ yeast clones were selected. Clones, termed YAC6, containing the linear region from human VH4-39 to VH3-23 were confirmed by Southern blot analysis. YAC6 was further extended by addition of a 10.6 kb fragment 3' of VH3-23, and conversion to a cYAC. The 10.6 kb extension contains the human VH3-11 and also occurs at the 5' end of BAC3. We constructed pBeloHYG-YAC6+BAC3(5') for the modification of YAC6. Briefly, 3 fragments with overlapping ends were prepared by PCR: 1) a 'stuff' fragment containing S. cerevisiae TRP1-ARS1 flanked by HpaI sites with 5' tail matching the sequence upstream of VH4-39 and 3' tail matching downstream of VH3-23 in YAC6 (using long oligoes 561 and 562, and pYAC-RC as template), 2) the 10.6 kb extension fragment with a 5' tail matching the sequence downstream of VH3-23 as described above and a unique AscI site at its 3' end (using long oligoes 570 and 412, and human genomic DNA as template), and 3) pBelo-CEN-HYG vector with the CEN4 joined downstream with a homology tail matching the 3' end of the 10.6 extension fragment and the HygR joined upstream with a tail matching the sequence upstream of VH4-39 as described above (using long oligoes 414 and 566, and pBelo-CEN-HYG as template). Subsequently, the 3 PCR fragments were assembled into a small cYAC conferring HYGR and TRP+ in S. cerevisiae via homologous recombination associated with spheroplast transformation, and this cYAC was further converted into the BAC pBeloHYG-YAC6+BAC3(5'). Finally, the HpaI-digested pBeloHYG-YAC6+BAC3(5') was used to transform yeast cells carrying YAC6, and through homologous recombination cYAC BAC6-VH3-11 conferring only HYGR was generated. Via transformation, see below, this cYAC was introduced as a BAC in E. coli. The human VH genes in BAC6-VH3-11 were cut out as a ~182 kb AsiSI (occurring naturally in the HygR)-AscI fragment, and the VH genes in BAC3 were cut out as a ~173 kb NotI-fragment (FIG. 1 top).

A self-replicating shuttle vector, termed pCAU, efficiently working in both Saccharomyces cerevisiae and E. coli, was constructed based on pBelo-CEN-URA published previously. (Osborn et al. J Immunol 2013; 190:1481-1490) In brief, ARSH4 was amplified from S. cerevisiae genomic DNA using primers 878 and 879 (all primer sequences are listed below), with an ApaLI site followed by AsiSI and a SexAI introduced into either end. The fragment was digested with ApaLI and SexAI, and ligated with pBelo-CEN-URA digested with the same restriction enzymes to yield pCAU. This vector contains S. cerevisiae CEN4, URA3 and ARSH4 in the pBeloBAC11 backbone (New England BioLabs).

Three BACs derived from human chromosome 14-CTD-2011A5 (BAC9), CTD-3148C6 (BAC14), CTD-2548B8 (BAC5) were purchased from Invitrogen/Thermo Fisher. The human genomic region encompassing IgHV3-74 to IgHV1-58 in BAC9 was isolated as a 185 kb NotI-fragment. BAC(14+5) was constructed from BAC14 and BAC5. The combined genomic regions in this BAC was isolated as a 210 kb BsiwI-fragment including from 5' to 3': a 90.6 kb region derived from BAC14 containing 4.6 kb sequence overlapping with the 3' of the NotI-fragment from BAC9 followed by a 86 kb region encompassing IgHV5-51 to IgHV1-45, a 1.7 kb synthetic region joining BAC14 and BAC5 with IgHV3-43 located in the centre, a 111.7 kb region derived from BAC5 encompassing IgHV3-21 to IgHV3-13, and a 6.1 kb region providing an overlap with the 5' of Anabel (the BAC carrying human Ig constant regions).

BAC(14+5), also referenced as 14/5) was constructed in three steps all involving generating a circular YAC (cYAC) via homologous recombination in yeast and converting the cYAC to BAC as described previously. Firstly, a BAC vector-pCAU+GAP-BAC14,5, was generated by assembling the following 3 overlapping fragments in yeast: a 1.9 kb synthetic DNA (ordered from ThermoFisher) containing from 5' to 3': 116 bp sequence overlapping with the 5' as well as 3' end of the desired region in BAC14 with an unique RsrII site in the centre, 1.6 kb IgHV3-43 gene [including 1.0 kb 5' untranslated region (UTR) and 0.2 kb 3' UTR], 106 bp sequence overlapping with the 5' as well as 3' end of the desired region in BAC5 with an unique PmeI site in the centre, and 38 bp sequence overlapping with the 5' end of Anabel, a 6.1 kb PCR fragment corresponding to the 5' of Anabel using primers 383 and 384, and an amplified pCAU vector using primers 1066 and 1088. Secondly, the pCAU+GAP-BAC14,5 vector was linearized with PmeI, and co-transformed with a 154 kb NotI-fragment isolated from BAC5 into yeast strain AB1380. The resulting BAC (~128 kb in length) had the desired region of BAC5 incorporated into the BAC vector via homologous recombination mediated by the homology ends to BAC5 exposed in the PmeI-linearized vector. Thirdly, the BAC carrying BAC5 from the second step was linearized with RsrII to expose the homology ends to the desired region in BAC14, and co-transformed with a 114 kb SnaBI-fragment isolated from BAC14 to yield BAC(14+5).

For the assembly of the C region with the VH overlap, the human VH6-1-Ds-JHs region had to be joined with the rat genomic sequence immediately downstream of the last JH followed by rat Cs to yield a cYAC/BAC. To achieve this, 5 overlapping restriction as well as PCR fragments were prepared; a 6.1 kb fragment 5' of human VH6-1 (using oligos 383 and 384, and human genomic DNA as template), an ~78 kb PvuI-PacI fragment containing the human VH6-1-Ds-JHs region cut out from BAC1 (RP11645E6), a 8.7 kb fragment joining the human JH6 with the rat genomic sequence immediately downstream of the last JH and containing part of rat µ coding sequence (using oligos 488 and 346, and rat genomic DNA as template), an ~52 kb NotI-PmeI fragment containing the authentic rat µ, δ and γ2c region cut out from BAC M5 (CH230-408M5) and the pBelo-CEN-URA vector with the URA3 joined downstream with a homology tail matching the 3' end of the rat γ2c region and the CEN4 joined upstream with a tail matching the 5' region of human VH6-1 as described (using long oligoes 385 and 550, and pBelo-CEN-URA as template). Correct assembly via homologous recombination in S. cerevisiae was analyzed by PCR and purified cYAC from the correct clones was converted into a BAC in E. coli.

For the assembly of Annabel parts of the above cYAC/BAC containing human VH6-1-Ds-JHs followed by the authentic rat µ, δ and γ2c region, as well as PCR fragments were used. Five overlapping fragments contained the 6.1 kb fragment at the 5' end of human VH6-1 as described above, an ~83 kb SpeI fragment comprising human VH6-1-Ds-JHs immediately followed by the rat genomic sequence downstream of the last JH and containing part of rat Cµ, a 5.2 kb fragment joining the 3' end of rat µ with the 5' end of rat γ1 (using oligos 490 and 534, and rat genomic DNA as template), an ~118 kb NotI-SgrAI fragment containing the authentic rat γ1, γ2b, ε, α and 3'E IgH enhancer region cut out from BAC 18 (CH230-162108), and the pBelo-CEN-URA vector with the URA3 joined downstream with a homology tail matching the 3' end of rat 3'E and the CEN4 joined upstream with a tail matching the 5' end of human VH6-1 as described above. There is a 10.3 kb overlap between the human VH6-1 regions in both the BAC3 and Annabel. The human VH6-1-Ds-JHs followed by the rat CH region together with the S. cerevisiae URA3 in Annabel can be cut out as a single ~183 kb NotI-fragment (see FIG. 1).

BAC6-VH3-11, BAC3, BAC9 and BAC (14+5) and Annabel were checked extensively by restriction analysis and partial sequencing for their authenticity.

b) IgL Loci

The human Igλ locus on a ~410 kb YAC was obtained by recombination assembly of a Vλ YAC with 3 Cλ containing cosmids (Popov et al. *Gene* 177, 195-201 (1996)). Rearrangement and expression was verified in transgenic mice derived from ES cells containing one copy of a complete human Igλ YAC (Popov et al. *The Journal of experimental medicine* 189, 1611-1620 (1999)). This Igλ YAC was shortened by the generation of a circular YAC removing ~100 kb of the region 5' of Vλ3-27. The vector pYAC-RC was digested with ClaI and BspEI to remove URA3 and ligated with a ClaI/NgoMIV fragment from pAP 599 containing HYG. PCR of the region containing the yeast centromere and hygromycin marker gene from the new vector (pYAC-RC-HYG) was carried out with primers with 5' ends homologous to a region 5' of Vλ3-27 (primer 276) and within the ADE2 marker gene in the YAC arm (primer 275). The PCR fragment (3.8 kb) was integrated into the Igλ YAC using a high efficiency lithium acetate transformation method (Gietz & Woods *Methods in Microbiology* 26, 53-66 (1998)) and selection on hygromycin containing YPD plates. DNA was prepared from the clones (Epicentre MasterPure Yeast DNA purification kit) and analysed for the correct junctions by PCR using the following oligos: 243+278 and Hyg end R+238. Plugs were made (Peterson *Nature protocols* 2, 3009-3015 (2007)) and yeast chromosomes removed by PFGE (0.8% agarose (PFC) (Biorad) gel [6 V/cm, pulse times of 60 s for 10 hr and 10 s for 10 hr, 8° C.) leaving the circular yeast artificial chromosome caught in the agarose block (Beverly, *Nucleic acids research* 16, 925-939 (1988)). The blocks were removed and digested with NruI. Briefly, blocks were preincubated with restriction enzyme buffer in excess at a 1× final concentration for 1 hr on ice. Excess buffer was removed leaving just enough to cover the plugs, restriction enzyme was added to a final concentration of 100 U/ml and the tube incubated at 37° C. for 4-5 hrs. The linearized YAC was ran out of the blocks by PFGE, cut out from the gel as a strip and purified as described below.

For the human Igκ locus 3 BACs were chosen (RP11-344F17, RP11-1134E24 and RP11-156D9, Invitrogen), which covered a region over 300 kb from 5' Vκ1-17 to 3' KDE (Kawasaki et al. *European journal of immunology* 31, 1017-1028 (2001)). In digests and sequence analyses three overlapping fragments were identified: from Vκ1-17 to Vκ3-7 (150 kb NotI with ~14 kb overlap), from Vκ3-7 to 3' of Cκ (158 kb NotI with ~40 kb overlap) and from Cκ to 3' of the KDE (55 kb PacI with 40 kb overlap). Overlapping regions may generally favour joint integration when co-injected into oocytes (Wagner et al. *Genomics* 35, 405-414 (1996)).

Gel Analyses and DNA Purification

Purified YAC and BAC DNA was analysed by restriction digest and separation on conventional 0.7% agarose gels (Sambrook & Russell Molecular Cloning. A laboratory Manual. *Cold Spring Harbor Laboratory Press, NY* (2001)). Larger fragments, 50-200 kb, were separated by PFGE (Biorad Chef Mapper™) at 80 C, using 0.8% PFC Agaraose in 0.5% TBE, at 2-20 sec switch time for 16 h, 6 V/cm, 10 mA. Purification allowed a direct comparison of the resulting fragments with the predicted size obtained from the sequence analysis. Alterations were analysed by PCR and sequencing.

Linear YACs, circular YACs and BAC fragments after digests, were purified by electro-elution using Elutrap™ (Schleicher and Schuell) (Gu et al. *Journal of biochemical and biophysical methods* 24, 45-50 (1992)) from strips cut from 0.8% agarose gels run conventionally or from pulsed-field-gel electrophoresis (PFGE). The DNA concentration was usually several ng/µl in a volume of ~100 µl. For fragments up to ~200 kb the DNA was precipitated and re-dissolved in micro-injection buffer (10 mM Tris-HCl pH 7.5, 100 mM EDTA pH 8 and 100 mM NaCl but without Spermine/Spermidine) to the desired concentration.

The purification of circular YACs from yeast was carried out using Nucleobond AX silica-based anion-exchange resin (Macherey-Nagel, Germany). Briefly, spheroplasts were made using zymolyase or lyticase and pelleted (Davies et al. Human antibody repertoires in transgenic mice: Manipulation and transfer of YACs. *IRL Oxford*, 59-76 (1996)). The cells then underwent alkaline lysis, binding to AX100 column and elution as described in the Nucleobond method for a low-copy plasmid. Contaminating yeast chromosomal DNA was hydolyzed using Plamid-Safe™ ATP-Dependent DNase (Epicentre Biotechnologies) followed by a final cleanup step using SureClean (Bioline). An aliquot of DH10 electrocompetent cells (Invitrogen) was then transformed with the circular YAC to obtain BAC colonies. For microinjection, the insert DNA (150-200 kb), was separated from BAC vector DNA (~10 kb) using a filtration step with sepharose 4B-CL (Yang et al. *Nature biotechnology* 15, 859-865 (1997)).

Derivation of Rats and Breeding

Purified DNA encoding recombinant immunoglobulin loci was resuspended in microinjection buffer with 10 mM Spermine and 10 mM Spermidine. The DNA was injected into fertilized oocytes at various concentrations from 0.5 to 3 ng/µl.

Plasmid DNA or mRNA encoding ZFNs specific for rat immunoglobulin genes were injected into fertilized oocytes at various concentrations from 0.5 to 10 ng/µl.

Microinjections were performed at Caliper Life Sciences facility. Outbred SD/Hsd (WT) strain animals were housed in standard microisolator cages under approved animal care protocols in animal facility that is accredited by the Association for the Assessment and Accreditation for Laboratory Animal Care (AAALAC). The rats were maintained on a 14-10 h light/dark cycle with ad libitum access to food and water. Four to five week old SD/Hsd female rats were injected with 20-25 IU PMSG (Sigma-Aldrich) followed 48 hours later with 20-25 IU hCG (Sigma-Aldrich) before breeding to outbred SD/Hsd males. Fertilized 1-cell stage embryos were collected for subsequent microinjection. Manipulated embryos were transferred to pseudopregnant SD/Hsd female rats to be carried to parturition.

Multi-feature human Ig rats (human IgH, Igκ and Igλ in combination with rat J KO, κ KO and λ KO) and WT, as control, were analyzed at 10-18 weeks of age. The animals were bred at Charles River under specific pathogen-free conditions.

Figure 3:
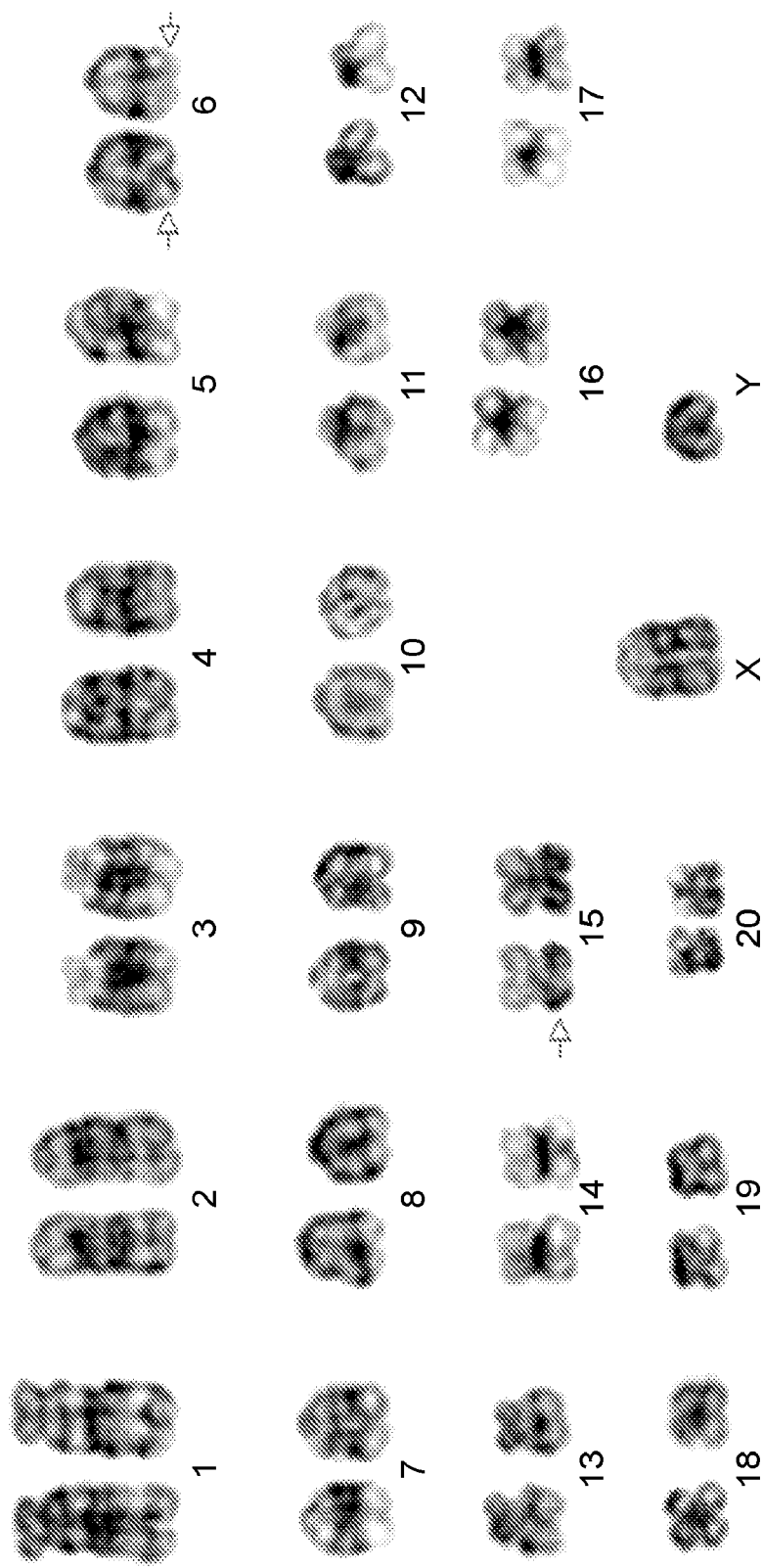
FIG. 3: Depicts HC14 locus integration into chromosome 6 and HC30 locus integration into chromosome 15.

The procedure of introducing multiple different VH region on separate loci can be implemented through the insertion of these different loci into separate transgenic rats (preferably with a defective rat IgH locus) as described in the example above. These separate loci are used to generate separate transgenic rat lines, which are subsequently crossed to obtain double transgenic rats that would have all of the VH regions used available for the recombination process. Crossing these rats to homozygosity for both loci would double the number of VH regions available for recombination (see FIG. 3 karyogram with one locus integrated on chromosome 6 and one locus on chromosome 15). Having multiple copies of an integrated locus would increase this number yet further.

The procedure of introducing distinct loci separately, by the transfer of multiple different $V_H$ regions in conjunction with one constant region array, allowed unconnected and multiple translocus integration. This was followed by breeding to generate an animal that expresses antibodies from both separately integrated loci.

The same procedure is also applied for the light chains, where one line of animals is made with a kappa locus and another line is made with a lambda locus. The loci are combined in animals by crossbreeding.

PCR and RT-PCR

Transgenic rats were identified by PCR from tail or ear clip DNA using a Genomic DNA Mini Kid (Bioline). For IgH PCRs <1 kb GoTaq Green Master mix was used (Promega) under the following conditions: 94° C. 2 mins, 32×(94° C. 30 secs, 54-67° C. (see Table 1 for primers and specific annealing temperatures) 30 secs, 72° C. 1 min), 72° C. 2 mins. For IgH PCRs >1 kb KOD polymerase (Novagen) was used under the following conditions: 95° C. 2 mins, 32×(95° C. 20 secs, 56-62° C., Table 1) 20 secs, 70° C. 90 secs), 70° C. 2 mins. For Igκ and Igλ PCR, all <1 kb, the above condition were used except extension at 72° C. for 50 secs.

RNA was extracted from Blood using the RiboPure Blood Kit (Ambion) and RNA extraction from spleen, bone marrow or lymph nodes used RNASpin mini kit. (GE Healthcare). cDNA was made using Oligo dT and Promega Reverse Transcriptase at 42° C. for 1 hour. GAPDH PCR reactions (oligos 429-430) determined the concentration.

RT-PCRs were set up using VH leader primers with rat µCH2 or rat γCH2 primers (Table 2). Amplification with GoTaq Green Master mix were 94° C. 2 mins, 34×(94° C. 30 secs, 55-65° C. 30 secs, 72° C. 50-60 secs), 72° C. 2 mins. PCR products of the expected size were either purified by gel or QuickClean (Bioline) and sequenced directly or cloned into pGemT (Promega).

The sequences of the primers used in the PCR and RT-PCR assays to detect human IgH and IgL integration and expression are provided in Table 3.

Characterization of Antibodies in Immunized OmniRat Animals by Next Generation Sequencing A total of 6 OmniRat2 animals were immunized with beta-gal and B-cells were isolated from draining lymph nodes. After pelleting the B-cells and removing supernatant, total RNA was prepared from lymph node derived B-cells. RNA was reverse transcribed, and the resulting cDNA was used as template to amplify the full variable region of the Ig heavy chain rearranged locus (the VH region). This amplified product was then prepared for next-generation sequencing (NGS) and the full VH repertoire of each animal was determined by NGS.

After post-processing and quality control of the raw NGS reads, the V-gene usage of each animal was determined by aligning each unique VH sequence to the germline V-gene reference sequence. The percent V-gene usage was calculated as the number of VH sequences using a particular V-gene divided by the total number of VH sequences in that animal.

Protein Purification

IgM was purified on anti-IgM affinity matrix (BAC B.V., Netherlands, CaptureSelect #2890.05) as described in the protocol. Similarly, human Igκ and Igλ was purified on anti-L chain affinity matrix (CaptureSelect anti-Igκ #0833 and anti-Igλ #0849) according to the protocol.

For rat IgG purification (Bruggemann et al. *J Immunol* 142, 3145-3150 (1989)) protein A and protein G agarose was used (Innova, Cambridge, UK, #851-0024 and #895-0024). Serum was incubated with the resin and binding facilitated at 0.1 M sodium phosphate pH 7 for protein G and pH 8 for protein A under gentle mixing. Poly-prep columns (Bio-Rad) were packed with the mixture and washed extensively with PBS pH7.4. Elution buffer was 0.1 M Sodium Citrate pH 2.5 and neutralization buffer was 1 M Tris-HCl pH 9.

Electrophoresis was performed on 4-15% SDS-PAGE and Coomassie brilliant blue was used for staining. MW standards were HyperPage Prestained Protein Marker (# BIO-33066, Bioline).

Flow Cytometry Analysis and FISH

Cell suspensions were washed and adjusted to 5×105 cells/100 µl in PBS-1% BSA-0.1% Azide. Different B-cell subsets were identified using mouse anti-rat IgM FITC-labelled mAb (MARM 4, Jackson Immunoresearch Laboratories) in combination with anti-B cell CD45R (rat B220)-PE-conjugated mAb (His 24, BD biosciences) or anti-IgD-PE-conjugated mAb (MARD-3, Abd Serotec). A FACS Cantoll flow cytometer and FlowJo software (Becton Dickinson, Pont de Claix, France) was used for the analysis.

Fluorescence in situ hybridisation was carried out on fixed blood lymphocytes using purified IgH and IgL C-region BACs as described. (Meisner & Johnson *Methods* 45, 133-141 (2008))

Immunization, Cell Fusion and Affinity Measurement

Immunizations were performed with 125 µg PG in CFA, 150 µg hGHR in CFA, 200 µg Tau/KLH in CFA, 150 µg HEL in CFA, 150 µg OVA in CFA at the base of the tail and medial iliac lymph node cells were fused with mouse P3X63Ag8.653 myeloma cells 22 days later as described (Kishiro et al. *Cell structure and function* 20, 151-156 (1995)). For multiple immunizations protein, 125 µg PG or HEL, or 100 µg hGHR or CD14 in GERBU adjuvant (www.Gerbu.com), was administered intraperitoneally as follows: day 0, day 14, day 28 and day 41 without adjuvant, followed by spleen cell fusion with P3X63Ag8.653 cells 4 days later (Meisner & Johnson *Methods* 45, 133-141 (2008)).

Binding kinetics were analyzed by surface Plasmon resonance using a Biacore 2000 with the antigens directly immobilized as described (Pruzina et al. *Protein engineering, design & selection: PEDS* 24, 791-799 (2011)).

Detection of Antigen-Specific Antibodies by ELISA

Rat serum samples were analysed for B-Gal IgG and IgM antibody and antigen titers using an antigen-coat, anti-IgG or IgM reporter ELISA. 96-well plates were coated with B-Gal overnight at 2-6° C., blocked with PBS-Casein-Blocker/Diluent 1×, washed with ELISA Wash Buffer, incubated with serum, washed with ELISA Wash Buffer, incubated with either a mixture of goat anti-rat IgG1-HRP, goat anti-rat IgG2a-HRP, and goat anti-rat IgG2b-HRP (each at a 1/5,000 dilution) or goat anti-rat IgM (1/5,000 dilution), washed with ELISA Wash Buffer, incubated with TMB Substrate Solution for 30 minutes and ELISA Stop Solution was added to the wells. Absorbance in the plate wells was measured at 450 nm. Except where noted above, incubations were for 1.5 to 2 hours at ambient temperature.

Determination of IgM and IgG Concentration in Rat Serum.

Rat serum samples were also analysed for the concentration of Total Rat IgG1, Rat IgG2b, and Rat IgM using a Double Antibody ELISA Sandwich assay format. Total Rat IgG1, Rat IgG2b, and Rat IgM concentrations were calculated using standard curves generated individually for each isotype. 96-well plated were coated with the respective isotype specific capture antibody (either mouse anti-rat IgG1, mouse anti-rat IgG2b, or goat anti-rat IgM) overnight at 2-6° C., blocked with PBS-Casein-Blocker/Diluent 1×, washed with ELISA Wash Buffer, incubated with serum, washed with ELISA Wash Buffer, incubated with the respective detecting antibody (either mouse anti-rat IgG or goat anti-rat IgM), washed with ELISA Wash Buffer, incubated with TMB Substrate Solution for 30 minutes and ELISA Stop Solution was added to the wells. Absorbance in the plate wells was measured at 450 nm. Except where noted above, incubations were for 1.5 to 2 hours at ambient temperature.

TABLE 1

PCR* conditions to detect human IgH and IgL integration and expression

| | Primers | Annealing Temp (Tm-5) | Fragment size |
|---|---|---|---|
| IgH | | | |
| Hyg (5' BAC6) | Hyg 3' F-459 | 54° C. | ~400 bp |
| V4-34 (BAC6) | 205-206 | 65° C. | ~1 kb |
| V4-28 (BAC6) | 203-204 | 65° C. | ~1 kb |
| V3-11 (overlap BAC6-BAC3) | 448-461 | 60° C. | ~500 bp |
| V1-8 (BAC3) | 371-372 | 60° C. | ~300 bp |
| V4-4 (BAC3) | 393-396 | 60° C. | ~750 bp |
| V6-1 (BAC3-Annabel) | 359-360 | 65° C. | ~350 bp |
| JH (Annabel) | 368-369 | 62° C. | ~250 bp |
| µ-γ1 (Annabel) | 583-535 | 62° C. | ~3 kb |
| Ura (3' Annabel) | 241-253 | 56° C. | ~3 kb |
| Igκ | | | |
| KDE | 313-314 | 66° C. | ~600 bp |
| cKappa | 307-308 | 64° C. | ~600 bp |
| V4-1 | 333-334 | 60° C. | ~300 bp |
| V1-5 | 329-330 | 64° C. | ~400 bp |
| V1-6 | 331-332 | 60° C. | ~300 bp |
| V3-7 | 309-310 | 66° C. | ~700 bp |
| V3-15 | 311-312 | 66° C. | ~500 bp |
| Igλ | | | |
| V3-27 | 215-216 | 67° C. | ~400 bp |
| V3-19 | 213-214 | 67° C. | ~700 bp |
| V2-14 | 211-212 | 67° C. | ~400 bp |
| V middle | 168-169 | 65° C. | ~500 bp |
| JLambda | 162-163 | 67° C. | ~800 bp |
| cLambda | 170-171 | 67° C. | ~500 bp |
| Enhancer | 172-173 | 67° C. | ~400 bp |

*For DNA extraction from ear and tail clips the Genomic DNA Mini Kit (Bioline) was used. For PCRs 1 kb or less in size GoTaq Green Master mix (Promega) was used under the following conditions: 94° C. 2 mins, 32 × (94° C. 30 secs, Tm-5 (below) 30 secs, 72° C. 1 min [50 sec for Igκ/λ]), 72° C. 2 mins. Annealing temperatures were set at the lowest primer Tm-5° C. (www.sigmagenosys.com/calc/DNACalc.asp). For PCRs > 1 kb KOD polymerase (Novagen) was used under the following conditions: 95° C. 2 mins, 32 × (95° C. 20 secs, Tm-5 20 secs, 70° C. 90 secs), 70° C. 2 mins.

TABLE 2

RT-PCR** conditions to detect human IgH and IgL integration and expression

| | Primer | Annealing Temp (Tm-5) | Fragment size |
|---|---|---|---|
| IgH | | | |
| VH1 Leader | 390 | 65° C. | ↓ |
| VH2 Leader | 391 | 65° C. | ↓ |
| VH3 Leader | 392 | 65° C. | ↓ |
| VH4 Leader | 393 | 60° C. | ↓ |
| VH6 Leader | 394 | 65° C. | ↓ |
| VH4-39 Leader | 761 | 55° C. | ↓ |
| Rat μCH2 | 345 | ↑ | ~1 kb |
| Rat γCH2 | 682 | ↑ | ~800 bp |
| Igκ | | | |
| HuVK1 Leader | 400/474 | 63° C. | ↓ |
| HuVK3 Leader | 401/475 | 63° C. | ↓ |
| HuVK4 Leader | 476 | 63° C. | ↓ |
| HuVK5 Leader | 477 | 63° C. | ↓ |
| Hu κ C region | 402 | ↑ | ~600 bp |
| Igλ | | | |
| HuVL2 Leader | 388/478 | 58° C. | ↓ |
| HuVL3 Leader | 398/479/480/482/483/481/484 | 58° C. | ↓ |
| HuVL4 Leader | 485 | 58° C. | ↓ |
| Hu λ C region | 387 | ↑ | ~600 bp |

**RNA was extracted from Blood using the RiboPure Blood Kit (Ambion). RNA extracted from spleen, bone marrow or lymph nodes used the RNASpin mini kit (GE Healthcare). cDNA was made using Oligo dT and Promega Reverse Transcriptase at 42° C. 1 hour. PCRs using the GoTaq Green Master mix were set up as follows: 94° C. 2 mins, 34 × (94° C. 30 secs, Tm-5 30 secs, 72° C. 1 min [50 sec for Igκ/λ]), 72° C. 2 mins.

TABLE 3

Primer Sequences

| Number | Oligonucleotide sequence 5'-3' | SEQ ID NO: |
|---|---|---|
| 162 | GGGGCCAAGGCCCCGAGAGATCTCAGG | 12 |
| 163 | CACTGGGTTCAGGGTTCTTTCCACC | 13 |
| 168 | GTGGTACAGAAGTTAGAGGGGATGTTGTTCC | 14 |
| 169 | TCTTCTACAAGCCCTTCTAAGAACACCTGG | 15 |
| 170 | AGCACAATGCTGAGGATGTTGCTCC | 16 |
| 171 | ACTGACCCTGATCCTGACCCTACTGC | 17 |
| 172 | AAACACCCCTCTTCTCCCACCAGC | 18 |
| 173 | CGCTCATGGTGAACCAGTGCTCTG | 19 |
| 203 | GCTATTTAAGACCCACTCCCTGGCA | 20 |
| 204 | AAAACCTGCAGCAAGGATGTGAGG | 21 |
| 205 | GCTCCTTCAGCACATTTCCTACCTGGA | 22 |
| 206 | CCATATATGGCAAAATGAGTCATGCAGG | 23 |
| 211 | CTCTGCTGCTCCTCACCCTCCTCACTCAGG | 24 |
| 212 | GAGAGTGCTGCTGCTTGTATATGAGCTGCA | 25 |
| 213 | TGGCTCACTCTCCTCACTCTTTGCATAGGTT | 26 |
| 214 | GATGGTTACCACTGCTGTCCCGGGAGTTAC | 27 |
| 215 | ATCCCTCTCCTGCTCCCCCTCCTCATTCTCTG | 28 |
| 216 | TGATGGTCAAGGTGACTGTGGTCCCTGAGCTG | 29 |
| 238 | AACAAGTGCGTGGAGCAG | 30 |
| 241 | GTACTGTTGACATTGCGAAGAGC | 31 |
| 243 | TGGTTGACATGCTGGCTAGTC | 32 |
| 253 | TGTCTGGCTGGAATACACTC | 33 |
| 275 | AAATGAGCTTCAAATTGAGAAGTGACGCAAGCATCAATGGTATAATGTCCAGAGTTGTGAGGCCTTGGGGACTGTGTGCCGAACATGCTC | 34 |
| 276 | CCAGCACTGTTCAATCACAGTATGATGAGCCTAATGGGAATCCCACTAGGCTAGTCTAGTCACCACATTAAAGCACGTGGCCTCTTATCG | 35 |

TABLE 3-continued

Primer Sequences

| Number | Oligonucleotide sequence 5'-3' | SEQ ID NO: |
|---|---|---|
| 278 | TGACCATTGCTTCCAAGTCC | 36 |
| 307 | GAGGAAAGAGAGAAACCACAGGTGC | 37 |
| 308 | CACCCAAGGGCAGAACTTTGTTACT | 38 |
| 309 | TGTCCAGGTATGTTGAAGAATGTCCTCC | 39 |
| 310 | TGGACTCTGTTCAACTGAGGCACCAG | 40 |
| 311 | GGCCTTCATGCTGTGTGCAGACTA | 41 |
| 312 | CAGGTCGCACTGATTCAAGAAGTGAGT | 42 |
| 313 | TTCAGGCAGGCTCTTACCAGGACTCA | 43 |
| 314 | TGCTCTGACCTCTGAGGACCTGTCTGTA | 44 |
| 329 | TCACGTGACTGTGATCCCTAGAA | 45 |
| 330 | CACTGTTATGCCAACTGAACAGC | 46 |
| 331 | CGTAGCAGTCCCCATCTGTAATC | 47 |
| 332 | ATGTCAGAGGAGCAGGAGAGAGA | 48 |
| 333 | CACGCCTCACATCCAATATGTTA | 49 |
| 334 | ATACCCTCCTGACATCTGGTGAA | 50 |
| 345 | GCTTTCAGTGATGGTCAGTGTGCTTATGAC | 51 |
| 346 | TGGAAGACCAGGAGATATTCAGGGTGTC | 52 |
| 359 | TTGCTTAACTCCACACCTGCTCCTG | 53 |
| 360 | TGCTTGGAACTGGATCAGGCAGTC | 54 |
| 368 | CACCCTGGTCACCGTCTCC | 55 |
| 369 | AGACAGTGACCAGGGTGCCAC | 56 |
| 371 | TGAGGAACGGATCCTGGTTCAGTC | 57 |
| 372 | ATCTCCTCAGCCCAGCACAGC | 58 |
| 383 | CCTCCCATGATTCCAACACTG | 59 |
| 384 | CTCACCGTCCACCACTGCTG | 60 |
| 385 | CTGTGCCACAAACATGCAAAGATAAGTTCCATGTGACAAGTCTGAACTCAGTGTTGGAATCATGGGAGGCGGCCGCGTTATCTATGCTGTCTCACCATAG | 61 |
| 387 | TGCTCAGGCGTCAGGCTCAG | 62 |
| 388 | TGCTCAGGCGTCAGGCTCAG | 63 |
| 390 | ATGGACTGGACCTGGAGGATCC | 64 |
| 391 | TCCACGCTCCTGCTGCTGAC | 65 |
| 392 | ATGGAGTTTGGGCTGAGCTGG | 66 |
| 393 | TGAAACACCTGTGGTTCTTCC | 67 |
| 394 | TCATCTTCCTGCCCGTGCTGG | 68 |
| 396 | GACTCGACTCTTGAGGGACG | 69 |
| 398 | ATGTGGCCACAGGCTAGCTC | 70 |
| 400 | ATGAGGGTCCCCGCTCAG | 71 |
| 401 | ATGGAAGCCCCAGCTCAGC | 72 |

TABLE 3-continued

Primer Sequences

| Number | Oligonucleotide sequence 5'-3' | SEQ ID NO: |
|---|---|---|
| 402 | CCTGGGAGTTACCCGATTGG | 73 |
| 412 | GGCGCGCCAAGCATCATGTCCTACCTGGCTG | 74 |
| 414 | CAAAGTACGTGGCACCTCCCTCGTCTTTCTTCCTCCTGCTCCAGCCAGGTAGGACATGATGCTTGGCGCGCCGTTATCTATGCTGTCTCACCATAG | 75 |
| 429 | CAGTGCCAGCCTCGTCTCAT | 76 |
| 430 | AGGGGCCATCCACAGTCTTC | 77 |
| 448 | CTTCACTGTGTGTTCTTGGGATAC | 78 |
| 459 | GTGTAATGCTTTGGACGGTGTGTTAGTCTC | 79 |
| 461 | GCATAGCGGCGCGCCAAGCATCATGTCCTACCTGGCTG | 80 |
| 474 | GACATGAGAGTCCTCGCTCAGC | 81 |
| 475 | AAGCCCCAGCGCAGCTTC | 82 |
| 476 | ATGGTGTTGCAGACCCAGGTC | 83 |
| 477 | GTCCCAGGTTCACCTCCTCAG | 84 |
| 478 | TCCTCASYCTCCTCACTCAGG | 85 |
| 479 | CGTCCTTGCTTACTGCACAG | 86 |
| 480 | AGCCTCCTTGCTCACTTTACAG | 87 |
| 481 | CCTCCTCAYTYTCTGCACAG | 88 |
| 482 | GCTCACTCTCCTCACTCTTTGC | 89 |
| 483 | CCTCCTCTCTCACTGCACAG | 90 |
| 484 | GCCACACTCCTGCTCCCACT | 91 |
| 485 | ATGGCCTGGGTCTCCTTCTAC | 92 |
| 488 | ATTACTACTACTACTACTACATGGACGTCTGGGGCAAAGGGACCACGGTCACCGTCTCCTCAGGAAGAATGGCCTCTCCAGGTC | 93 |
| 490 | CTGTCGTTGAGATGAACCCCAATGTGAG | 94 |
| 534 | GGAACTGATGTGATCTCAGTCACACAGCTAATGCAAAGGTCAGCAGGCTGTTTACTGCCTGGAGGTTCATCGCCCAATTCCAAAGTCAC | 95 |
| 535 | CTAGTCTGCATGGGTCTCCGCAAAC | 96 |
| 550 | CTGGTATAATCATAAGTCTCCACTTAATAGTTCTGTAGACAGAATCTTCATTTAGACTTACAGACCGCGGCCGCACCGCAGGGTAATAACTG | 97 |
| 561 | GCAACCCTTCTTGCCACTCATGTCCCAGCTCTCACCATGTGACATAGCCTGTTAACAATTCGGTCGAAAAAAGAAAAGGAGAG | 98 |
| 562 | AATGTTCTTAGTATATATAAACAAGCTACTCCCAATTCATAGTCAACTAAGTTAACATTCCACATGTTAAAATAGTGAAGGAG | 99 |
| 566 | TTAACAGGCTATGTCACATGGTGAGAGCTGGGACATGAGTGGCAAGAAGGGTTGCCAGACTCCCCCTTTACCTCTATATCGTGTTC | 100 |
| 570 | CTTAGTTGACTATGAATTGGGAGTAGCTTGTTTATATACTAAGAACATTTGTCAGAAGCTCTTTCTTGTTTATTCCCAGTTTGC | 101 |
| 583 | CATGTCCGTATGTTGCATCTGC | 102 |
| 682 | GGGAAGATGAAGACAGATG | 103 |
| 761 | TGGAGTGGATTGGGAGT | 104 |

TABLE 3-continued

Primer Sequences

| Number | Oligonucleotide sequence 5'-3' | SEQ ID NO: |
|---|---|---|
| 878 | GCGATCGCAAAGACGAAAGGGCCTCGTG | 105 |
| 879 | ACCTGGTGATCGCCAACAAATACTACC | 106 |
| 1066 | GCGGTGGGTCTCCCACGGGGGCAAACAGCAGTGGTGGACGGTG AGCGTACGGTTATCTATGCTGTCTCACCATAG | 107 |
| 1088 | CTGTCAGCTGGAAGCAGTTAAGGTTGGCCTTTGTCTGTATTCG TACGCACACGCTTTTCAATTCAATTCATC | 108 |

Results

The Human IgH and IgL Loci

Construction of the human Ig loci employed established technologies to assemble large DNA segments using YACs and BACs (Davies et al. *Nucleic acids research* 20, 2693-2698 (1992); Davies et al. *Biotechnology (NY)* 11, 911-914 (1993); Wagner et al. *Genomics* 35, 405-414 (1996); Popov et al. *Gene* 177, 195-201 (1996); Mundt et al. *J Immunol* 166, 3315-3323 (2001)). As multiple BAC modifications in *E. coli* frequently deleted repetitive regions such as switch sequences and enhancers, a method was developed to assemble sequences with overlapping ends in *S. cerevisiae* as circular YAC (cYAC) and, subsequently, converting such a cYAC into a BAC. Advantages of YACs include their large size, the ease of homologous alterations in the yeast host and the sequence stability, while BACs propagated in *E. coli* offer the advantages of easy preparation and large yield. Additionally, detailed restriction mapping and sequencing analysis can be better achieved in BACs than in YACs.

Sequence analysis and digests identified gene clusters of interest and ensured locus integrity and functionality to secure DNA rearrangement and switching over a wide region as shown in FIG. 1. As shown previously, overlapping regions may generally favor joint integration when co-injected into oocytes (Wagner et al. *Genomics* 35, 405-414 (1996)). Thereby, insertion of BAC6-VH3-11, a 182 kb AsiSI-AscI fragment, with BAC3, a 173 kb NotI fragment, and BAC3-1N12M5I8 (Hu-Rat Annabel), a 193 kb NotI fragment, led to the reconstitution of a fully functional transgenic IgH locus (HC14) in the rat genome. Similarly, injection of BAC9, BAC (14+5) and BAC3-1N12M5I8, led to the reconstitution of a fully functional transgenic IgH locus (HC30) in the rat genome.

Similarly, the human Igκ locus was integrated by homologous overlaps. The human Igλ locus was isolated intact as a ~300 kb YAC and also fully inserted into a rat chromosome. The integration success was identified by transcript analysis which showed V(D)J-C recombinations from the most 5' to the most 3' end of the locus injected. Multiple copies were identified by qPCR (not shown) and it is likely that head to tail integrations occurred. In all cases, transgenic animals with single-site integrations were generated by breeding.

Breeding to Homozygosity

The derivation of transgenic rats by DNA microinjection into oocytes, their breeding and immunization is comparable to the mouse. However, ZFN technology to obtain gene knock-outs has only been reported recently (Geurts et al. *Science* 325, 433 (2009); Flisikowska et al. *PloS one* 6, e21045 (2011)). Silencing of the rat IgH locus by $J_H$ deletion using ZFN KO technology has been described (Menoret et al. *European journal of immunology* 40, 2932-2941 (2010)) and a manuscript describing silencing of the rat IgL loci, targeting of Cκ and deletion of J-Cλ genes, is in preparation. We derived multiple founders with integrated human Ig loci and silenced endogenous Ig production; all analyzed by PCR and FISH with complete trans-locus integration selected and interbred (Table 4). Several founder rats carried low trans-locus copy numbers; with the rat C-gene BAC in OmniRat™ likely to be fully integrated in 5 copies as determined by qPCR of Cμ and Cα products (not shown). Identification by FISH of single position insertion in many lines confirmed that spreading or multiple integration of BAC mixtures were rare; an advantage for breeding to homozygosity, which was achieved.

TABLE 4

Generated rat lines: transgenic integration, knock-out and gene usage

| rat line | human $V_H$ VH BACs about 400 kb | rat $C_H$ (Annabel) 193 kb | human Igk BACs 300 kb | human Igl Igl YAC 300 kb | ZFN KO $J_H$ KO | ZFN KO Igκ KO | ZFN KO Igγ KO | FISH rat chromosome |
|---|---|---|---|---|---|---|---|---|
| HC14 | √ | √ | | | | | | 5q22 |
| HC30 | √ | √ | | | | | | 15q24 |
| OmniRat | √ | √ | √ | √ | √ | √ | √ | homozygous KOs |
| LC#79 | | | √ | | | | | 17 |
| LC#6.2 | | | | √ | | | | 6q23 |
| #117 | | | | | √ | | | 6q32 |
| #23 | | | | | | √ | | 4 |
| #35 | | | | | | | √ | 11 |

Rats carrying the individual human transloci—IgH, Igκ and Igλ—were crossbred successfully to homozygosity with Ig locus KO rats. This produced a highly efficient new multi-feature line (OmniRats™) with human $V_H$-D-$J_H$ regions of over 400 kb containing 22 functional $V_H$s and a rat C region of ~116 kb. DNA rearrangement, expression levels, class-switching and hypermutation was very similar between the different founders and comparable to wt rats. This is probably the result of the associated rat constant region accommodating several Cs and with the 3'E (enhancer control) region in authentic configuration. OmniRat animals carrying the HC14 heavy chain locus were bred with OmniRat animals carrying the HC30 locus to generate OmniRat2. OmniRat2 animals contain two heavy chain loci containing 43 functional VHs.

B-Cell Development in the Knock-Out Background

To assess whether the introduced human Ig loci were capable of reconstituting normal B-cell development flow cytometric analyses were performed. Particular differentiation stages were analyzed in spleen and bone marrow lymphocytes (Osborn et al. *J Immunol* 2013; 190:1481-1490), which previously showed a lack of B-cell development in JKO/JKO rats (Menoret et al. *European journal of immunology* 40, 2932-2941 (2010)), and no corresponding IgL expression in κKO/κKO as well as in λKO/λKO animals (data not shown). Most striking was the complete recovery of B-cell development in OmniRats compared to wt animals, with similar numbers of B220(CD45R)$^+$ lymphocytes in bone marrow and spleen. IgM expression in a large proportion of CD45R$^+$ B-cells marked a fully reconstituted immune system. Size and shape separation of spleen cells was indistinguishable between OmniRats™ and wt animals and thus successfully restored in the transgenic rats expressing human idiotypes with rat C region. Moreover, the small sIgG$^+$ lymphocyte population was present in Omni-Rats (Osborn et al. *J Immunol* 2013; 190:1481-1490).

The analysis of other OmniRat lymphocyte tissues showed that they were indistinguishable from wt controls and, for example, T-cell subsets were fully retained (data not shown), which further supports the notion that optimal immune function has been completely restored.

Ig Levels in Serum

Figure 4:
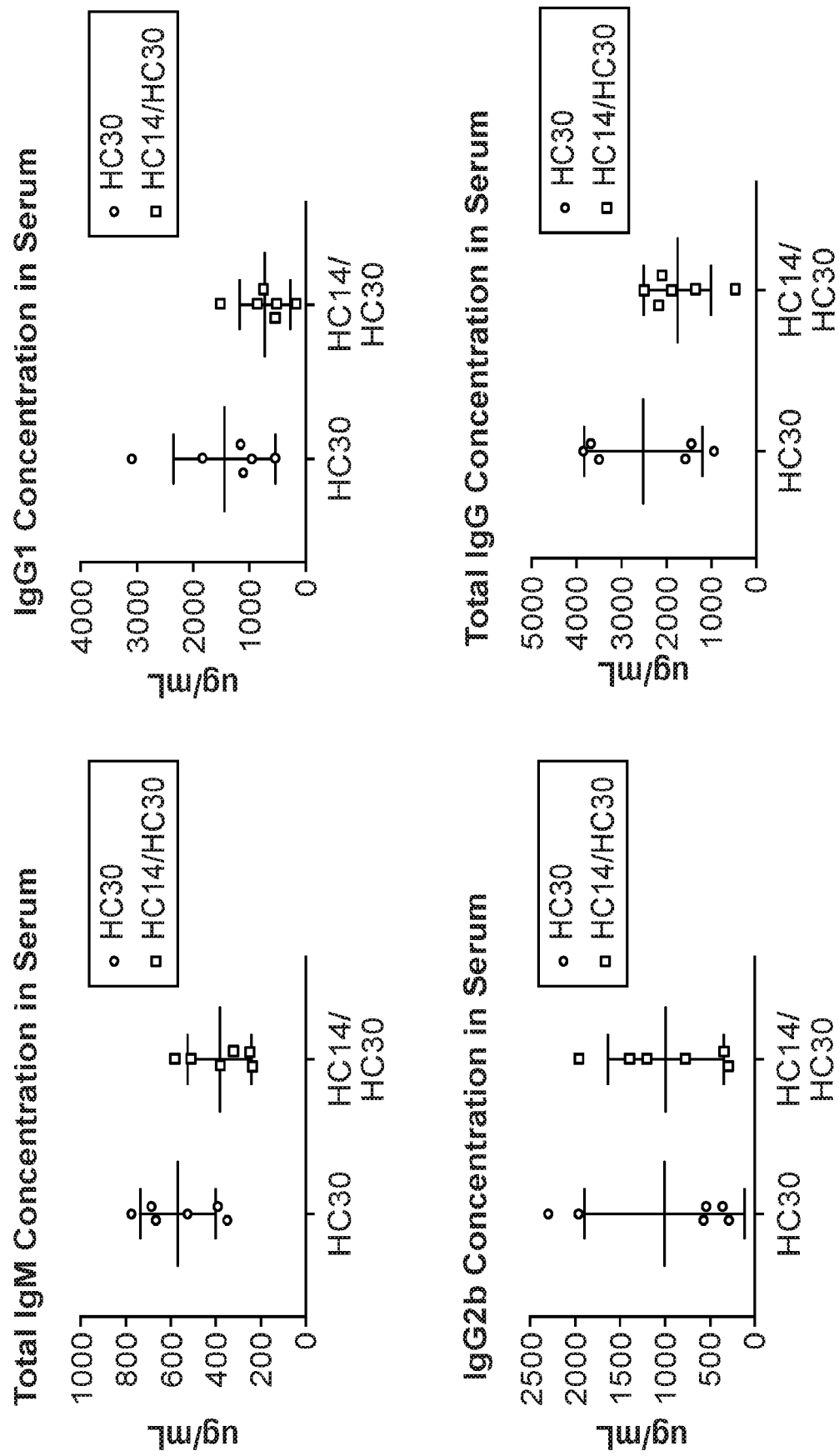
FIG. 4: Analysis by ELISA of IgM and IgG concentration in serum from HC30 and HC14/HC30 animals. Each dot (HC30) or square (HC14/HC30) represents the titre (µg/ml) of one animal. IgG is further analysed for the content of IgG1 and IgG2b.

To gain unambiguous information about antibody production we compared quality and quantity of serum Ig from HC30 and HC14/HC30 animals (FIG. 4) The results demonstrated that animals with one Ig locus (HC30) expressed similar amounts of IgM and IgG in serum compared to animals with two heavy chain loci (HC14 and HC30).

Figure 5:
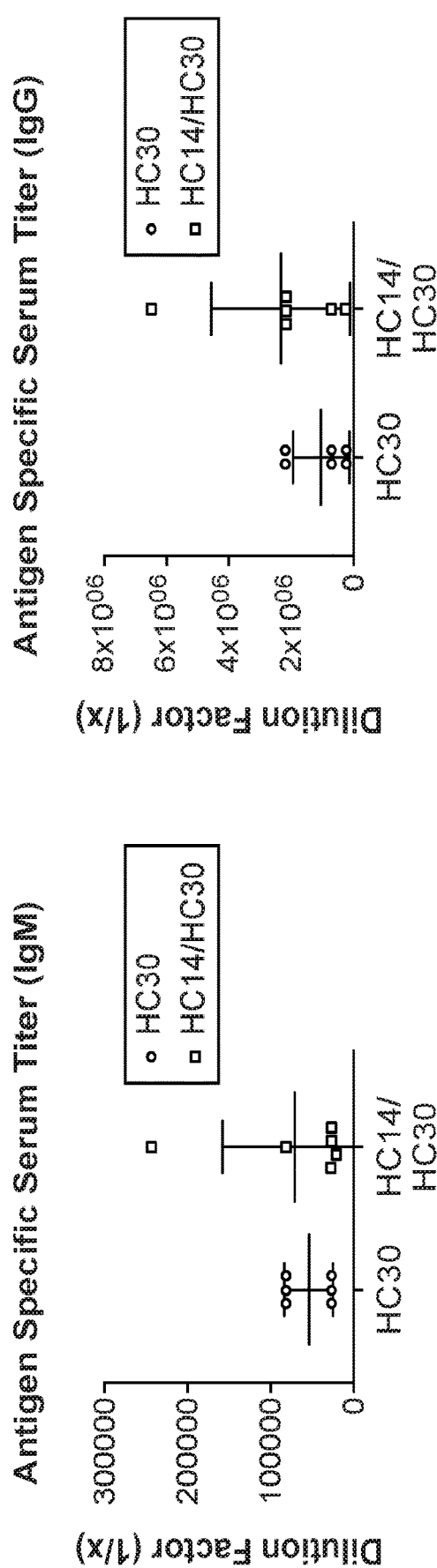
FIG. 5: Analysis by ELISA of anti-n-gal specific antibodies from HC30 and HC14/HC30. Each dot (HC30) or square (HC14/HC30) represents the serum titre (in comparative dilution) from one animal.

ELISA analysis of serum from immunized OmniRat animals with one HC locus (HC30) or two HC loci (HC14 and HC30) revealed similar titers of anti-beta gal IgM and IgG in such animals (FIG. 5).

Diverse Human H- and L-Chain Transcripts

Extensive transcriptional analysis was carried out using blood lymphocytes or spleen cells from transgenic rats with functional endogenous Ig loci. RT-PCR from specific human $V_H$ group forward to Cμ or Cγ reverse primers, showed human $V_H$D$J_H$ usage. For L-chain analysis group specific human Vκ or Vλ forward primers were used with Cκ or Cλ reverse primers.

In addition, B-cells from animals were collected, RNA was prepared and reverse transcribed, and the resulting cDNA was used as template to amplify the full variable region of the Ig heavy chain rearranged locus (the VH region). This amplified product was then prepared for next-generation sequencing (NGS) and the full VH repertoire of each animal was determined by NGS. After post-processing and quality control of the raw NGS reads, the V-gene usage of each animal was determined by aligning each unique VH sequence to the germline V-gene reference sequence. The percent V-gene usage was calculated as the number of VH sequences using a particular V-gene divided by the total number of VH sequences in that animal. Of the 43 total human V-genes introduced on the transgenes in OmniRat2, we detect 33 V-genes expressed at a level greater than 0.1% in a rearranged IgG transcript.

The results of the RT-PCR VH-gene expression analysis and NGS repertoire analysis are summarized in FIG. 1. These result showed the use of all integrated human $V_H$ genes regarded as functional (Lefranc & Lefranc The immunoglobulin factsbook. *FactsBook Series*, Academic Press, GB, 45-68 (2001)) in combination with diverse use of D segments and all $J_H$ segments.

The results clearly demonstrate that addition of more variable regions provided by the two loci (HC14+HC30) leads to an even broader antibody repertoire. In conclusion, we have demonstrated that antigen specific high affinity Abs of potentially any class can be produced in transgenic animals with one or two Ig heavy chain loci. This technology will allow the production of fully human Abs of any class or fragments thereof in response to antigen challenge for use as therapeutic or diagnostic agents in man. By using different loci our technology also allows for the production of high affinity matured antibodies from rodents for use as reagents, diagnostics or for the treatment of humans.

Discussion

A combination of human and rat genes to assemble a novel IgH locus has resulted in highly efficient near normal expression of antibodies with human idiotypes. Moreover, integration of the human Igκ and Igγ loci revealed that chimeric Ig with fully human specificity is readily produced and that association of rat C-regions with human L-chains is not detrimental. Advantages of using part of the rat IgH locus are that species-specific C regions and enhancer control elements are kept in their natural configuration, with essentially only the diverse human $V_H$ D $J_H$ region being transplanted. Furthermore, expression of antibodies with rat Fc-regions allow normal B-cell receptor assembly and optimal activation of the downstream signalling pathway essential for the initiation of highly efficient immune responses. In particular, the quality of an immune response to antigen challenge relies on combined actions of many receptor associated signalling and modifier components (see: www.biocarta.com/pathfiles/h bcrpathway.asp).

The approach of using YACs and BACs, and interchanging between the two, has the advantage of both, speed and the ability to check integrity when making constructs of large regions by overlapping homology. Several founder rats carried low translocus copy numbers; with the rat C-gene BAC in OmniRat likely to be fully integrated in 5 copies as determined by qPCR of Cμ and Cα products (not shown). Identification by FISH of single position insertion in many lines confirmed that spreading or multiple integration of BAC mixtures were rare; an advantage for breeding to homozygosity, which was achieved. Little was known whether extensive overlapping regions would integrate, such as to maintain the full functionality, essential for DNA rearrangement. Previously, overlapping integration has been reported but for much smaller regions (<100 kb) (Wagner et al. *Genomics* 35, 405-414 (1996); Bruggemann et al. *Euro-*

*pean journal of immunology* 21, 1323-1326 (1991)) and our results suggest that desired integration by homology or in tandem is a frequent event. This eases the transgenic technology substantially as no laborious integration of large YACs into stem cells and subsequent animal derivation therefrom has to be performed. (Mendez et al. *Nature genetics* 15, 146-156 (1997); Davies et al. *Biotechnology* (NY) 11, 911-914 (1993)) In addition, ZFN technology, also performed via DNA injection (Geurts et al. *Science* 325, 433 (2009); Menoret et al. *European journal of immunology* 40, 2932-2941 (2010)), produced Ig KO strains easily and may well be the future technology of choice for gene disruptions and replacement. Silenced endogenous Ig gene expression in OmniRats, containing human-rat IgH and human IgL loci, has the advantage that no interfering or undesired rat Ig could give rise to mixed products. Interestingly, immunization and hybridoma generation in OmniRats still producing wt Ig revealed that many products were fully human, human-rat IgH and human IgL, despite incomplete Ig KOs. Here, despite the extensive number of wt V genes, it was remarkable that the introduced human genes amplified readily and thus showed to be efficient expression competitors. This is in line with the observation of generally good expression levels of all our integrated transgenes, which favorably compete with the endogenous loci. Previously in mice expressing a human antibody repertoire, Ig KOs were essential as little expression of human products was found when wt Ig is released (Bruggemann et al. *PNAS* 86, 6709-6713 (1989); Mendez et al. *Nature genetics* 15, 146-156 (1997)).

It is possible that the production of fully human Ig loci even in Ig KO mice is suboptimal as strain specific cis-acting sequences are required for high-level expression. In the mouse an enhancer region downstream of Cα plays a vital role in class-switch recombination (Vincent-Fabert et al. *Blood* 116, 1895-1898 (2010)) and it is likely that elements in that region may facilitate hypermutation (Pruzina et al. *Protein engineering, design & selection: PEDS* 24, 791-799 (2011)). This may be the reason why immune responses and generation of diverse hybridomas at high frequency may be difficult in mice carrying even a large fully human locus (Davis et al. *Cancer metastasis reviews* 18, 421-425 (1999); Lonberg *Current opinion in immunology* 20, 450-459 (2008)). As the chimeric human-rat IgH locus facilitates near wt differentiation and expression levels in OmniRats, it can be concluded that the endogenous rat C region and indeed the ~30 kb enhancer sequence 3' of Cα are providing optimal locus control to express and mature human $V_H$ genes. Another region, Cδ with its 3' control motif cluster (Mundt et al. *J Immunol* 166, 3315-3323 (2001)), has been removed from the chimeric C-region BAC since silencing or a lack of IgD did not appear to reduce immune function 37. Normally, mature IgM⁺IgD⁺ B-cells down-regulate IgD upon antigen contact, which initiates class-switch recombination (Chen *Immunol Rev* 237, 160-179 (2010)). Thus, switching may be increased without IgD control, which is supported by our finding that IgG transcripts and serum levels are significantly lower when the Cδ region is retained in transgenic constructs (data not shown).

The production of specific IgG in OmniRats is particularly encouraging as we found that in various immunizations mAbs with diversity in sequence and epitope, comparable to what was produced in wt controls, could be isolated via spleen and lymph node fusion. V-gene, D and J diversity was as expected and nearly all segments were found to be used productively as predicted (Lefranc & Lefranc *The immunoglobulin factsbook. FactsBook Series*, Academic Press, GB, 45-68 (2001)). This was in stark contrast to mice carrying fully human transloci where clonal expansion from a few precursor B-cells produced little diversity (Pruzina et al. *Protein engineering, design & selection: PEDS* 24, 791-799 (2011)). Since the number of transplanted V-genes is only about half of what is used in humans we anticipated to find restricted immune responses and limited diversity when comparing OmniRats with wt animals. However, this was not the case and a comparison of CDR3 diversity in over 1000 clones revealed the same extensive junctional differences in OmniRats as in wt animals. The few identical gene-segment combinations were further diversified by N-sequence additions or deletion at the $V_H$ to D and/or D to $J_H$ junctions and also by hypermutation. Thus, it is clear that the rat C region sequence is highly efficient in controlling DNA rearrangement and expression of human $V_H DJ_H$. Extensive diversity was also seen for the introduced human Igκ and Igγ loci, similar to what has previously been shown in mice (Nicholson et al. *J Immunol* 163, 6898-6906 (1999); Pruzina et al. *Protein engineering, design & selection: PEDS* 24, 791-799 (2011); Popov et al. *The Journal of experimental medicine* 189, 1611-1620 (1999)). Hence, substantially reduced efficiency in the production of human antibodies from mice (Lonberg *Nature biotechnology* 23, 1117-1125 (2005)) has been overcome in OmniRats, which diversify rearranged H-chains reliably and extensively by class-switch and hypermutation to yield high affinity antibodies in bulk rather than occasionally. The yield of transgenic IgG and the level of hypermutation, impressively utilized in antigen-specific mAbs, showed that clonal diversification and production level are similar between OmniRats and wt animals. Routine generation of high affinity specificities in the subnanomolar range was even accomplished by different single immunizations and again compares favorably with wt animals; results that have not been shown in transgenic mice producing human antibody repertoires from entirely human loci. (Mendez et al. *Nature genetics* 15, 146-156 (1997))

In summary, to maximize human antibody production an IgH locus that uses human genes for antibody specificity but rodent genes for control of differentiation and high expression should be regarded essential. L-chain flexibility is a bonus as it permits highly efficient human IgH/IgL assembly even when wt Ig is present. For therapeutic applications chimeric H-chains can be easily converted into fully human Abs by C-gene replacement without compromising the specificity.

All patents and patent publications referred to herein are hereby incorporated by reference.

Certain modifications and improvements will occur to those skilled in the art upon a reading of the foregoing description. It should be understood that all such modifications and improvements have been deleted herein for the sake of conciseness and readability but are properly within the scope of the following claims.

SEQUENCE LISTING (112 sequences)

SEQ ID NO: 1 - DNA, 30702 bp, Rattus rattus
  modified_base (12962)..(13011): a, c, g, or t
tgctactgagccaccttgcctgcccctactccttaaataaactctgtgctcatccaaagtatccctgcacttccatccagtgcctgtccatcatccttagggtctacaaaacactgggaggggtcagggcccagggaaggaggaacccccaccacctgagcttgtaaggcctcagagactctgaaggacctacatgcctagagtatatgtgtatgcatgtatacgtattagtgagtgcctttgcgtgtgtacctgtgtgtaacaagagaggagtgagtttgtgcgtgcctacgggtttatataggtatgtatatgggcataagtgcatacgcctttaagtgtgagcatatctgtgtccccgtgagcacatgtgtgtctgtgtatgcctatgagtgtgcacgtatctgtgtatgctcatgttggtggaaacatgtgtgcctatagtgtgtgtacctgccaggtggatgtgcaatgaaagggaggtgagaatgggggtgaagtccgagatgagcagattcagccaagacaggcaaacctcaggggagagtcccaagagcagtgggttgctgcagaggtactctgaatggtacttctgaatggtggtgtggctgtctgagtataagattacagcttttgtcccaaacaagaaagggatagatggagcaagagagtagcaagaccaaggctggtactgcctgggagtcacaataggaacggtagaggagtgaggagatgaatccaaggggcactgggaagaagatgccacccaccctcagtgggccagccctgaatggagacgtgcatagccactcagggtgaccactgactcatgagaaagagacataacatggcacagacagccctcagcagcaccctgctctgcatatatgcacatgggcatacaccctggtctgcatacaggtacatgggcatacacgcacatacatttgcacactcacacagacccgaaccctggaggaggacgaagttcacagcccacacgcagcttctggaaagcaatgggagtcccctcccaagcccaaccatgacaactcatggacaagtctataagctcctccaggtggcccctttctaacctaagtctcccttcccatcctgagcccaagtataacaaaccagaaacagggtatgtggcaagctgggaaaagacaggagcaggccatagagaccactctcacacaggccttggcctcctccatgggcacccctagaacacaaagttctacaaccaggtacacttggcacccagatgcccacaagagggcagtggggcccctgctcctgtctcacgggccttcagaacctctccaggggcctggtttctagcaacttccctctgctgtcagagcaaggcccatgcacaccctggataccctccagcttgaaagtccacttccccgaggatagcaaaagcgacaggccagctttggaaacctgacccagaaaagcacgatagccacccatggaacccaaggcctggtccaaaacagaattctagtaaggaggagccaataggtgaaagactgaacacacacagggagagaagacagaggagcacgatagtcgagagaggggggctggtgggtgaggcgatgagtgagtgactggaacaaggttgggtggatatgcagatgaatgatgggaatggtggatggactgatggatggctgcagtgacagaaatatgagtgactgagtatcggcacacagtccctacctccacttaaaatcaaagttctatgcgcggagactctgagggcagtggggttgtctctaccgggagactttagtgttggttaacccccccccaagttctttataatgcaacagaatcctctgaccacatgtccaccccttggtattccaacctcggcccagaaatcaccttggcctgtatctgtttgagagtgtccgatcttaccgaaccctagtacccaggccaagttcaacctaagaactggggcttttgtgaggtgttgctaaatgtctagagaggtctgagacaagtggccttgggctcaaactcttctcagagcctcaaagacagaaacaactctcttaccatgatagttctctaattaagatcccctgagggaaagagagagagtcaggtcttggggggcatctcaagaacttcaaggattccagccccttacctgggaccctgccttctcattatcccagaacaagtcccttctcagagataaggaacccctgccaccaccgtccccaaagcccaagggggcatagaaacagaggccttaagcctgagcccccatccccatgggtttggatctagaaggtcatctatgtcttacagaatgccaagagccaccttcctacgtgatactggaccagtcacaagacatcctggaggaagagaccccgggtgccagtctgtggcccaccgctgtgaccttcctcaccctcttcctactgagcttgttctacagcacagcactcaccgtcacaactgtacgaggcccatttggcagcaaagaggtcccccagtactgaccaggagccagccacaggtggctgtcatggagacggtggggtacagggtgggggcaggggccttgaggatttactcagcccctccacatgtggccttgcaacccttcacagacatcaaggaagtggaaggaagtagaaggaaattatggcagcacttcctgggtttaacccagtcttccagaagccaggctgagacctcagcaaaagcaaagacataacccaactccaggatcctcccctctggctgaccacttgtgtctttgcacggatgaagcttggagaaagtcctctatgtttcagagactgatgtgacagcttcccacccgactcccatactttgctgagcaataaactggtgcaaaagcacagtttcttactctcaaaaacaaaagttaacaaaggattgggtgagggggtcagagatagtgtggtggtgccatgctaaactgttgcttacggtatagaatgtggcagcattgggcagggcagacacagggtgaccactgtctagtatccgagacaaccgtgtgtagctgtagccaagatgaacactgactgacttcaacaagtatttgtggcctcttcagacccaataccaggccattagcttgatctctggacctgacttctaaacatttggcctctgtgaacacccttgccaaacactggtcctggttgtgaaccttggtcctgaatactgagccttatcttggtaactgaaccataatcctgatccctgacctcagtcacgatcatgaaaccctggtcctggccactcgttccaataactggtccctagtcctgagccctgagtcctggtccaggtcactgaatcctggtcatgatcaatgggtttggtcctcattcctgagcctagtcttgatcactgatcactggttctgatcattaacaactaacctgatcactagtccccattcctaatcactgggccgcgatactgatcactgaaccctgtttctaaacaatgtgtagtgaaatgtatggtaaaacctttgcatctggctttgagtgaaatgtttcggcagacctttgctatgttttgggttagtcaggaaaggctgagaaatggttttgaggctgtttgaaccttgaagaaatgttgtctccctggacaatctgcacttggtactacattaaggtttgcagttgcacacaccttggtcctaaacactcctggcagacttagaactcttacgtttgattatggctagccatagttgaaaagggctgagagttgtatgggtggtctgctctctctcgcagcaagggcaagatgactttggtagttgaaaactttcccagccccaactaactctgtataatgtttgaataaagtaacggcagtaggctagttgtggttaatttttattccaagaagaatgaacccctctgctccttcagaaaaggaaggcttagcattttggtgagcttctctctactgaggcacctatgaccaactcagtgttctttgattcctgtcaccacatccagtcttgatcactaagtgccagtcctcatcactaaaccctggtctccaccagtctgcttgggttctgataatcagactcacattctgataactgggccctgattctggtcactagctctttgccctggtcatggacatttgaccctagtccacggcactgagttctgggcatggaccctgggccctagtcctaggtactgggttctggttctaacaactaggtcctgtactgatcaatgggccctgacctagacattgggccctggtcctcaacatcaacttctaagcctgaactctagccccaaattctgcttatcaacactggtcctggaccttggtcctcatcacacatccattctctgagacccaaggaatcagtggtattttgcaagaagtccctttgatattccaagcctcattctcattaggaagatctcttcaggggattcctgcagaaggttccagaatccccaccacactgttcacatactgggctgcaactgggacagtgaccccttttgctcatggaaacaaagcaggcccaggccctgtgagctggagcctctggcctggggtctacagatgtggggtcagcattgtggagaaggtttgcagggcaggtgtgggggtagggcagggatggtcacattagcatcttgtttttctttcttctgaagtctctgttttctatcacctgctgaaacattcaaagtagctccaagctgaggccagctgagtcatcctgagcctatctcagcccaggtgcctcaaaacagagctactgttctgagaatcacaccaccctggaccaggccaggtgggtctggggctggatgaggggtcagagccaggggagccctgacagggactgagaaggccccaacccccatcactcaaggttctccacaaccatccacagtcatgccttagtgaggccatgttctgtcccaatgagaacaagtccaattaagattaagtctggtcttcccagggtcattcagtgtcaaggagtgtcaaccaaggccagccaaggccagcctgaggtcagccagcatcacccaaggacacacaactattctagtagacaactagaatagtcagctcaacagggccctggtgatgcaaaatggagagtgtattcctgccagacagggctccacagataggctccctcactgcatatgacctccctgaatgtttcccacactgcagttggttctagactacttcttgataagcatgcagaaagataacaggataagaaattttatgcagagaacagaagtatctacggaatagaatagaagatagatagtagaagtctgctacaggccccagtggagtctctttgtagagtcaagagatcaaacctaaactgagtctcaggattgagtccagtacagaagcaaccttcaggatgctaaagaccatacaggcaatggacagaatggagtccagacagaccaatgagtggacagtccaatctcacataatgaaccatgtcaagagcagatagtgagccaaagaaggctctgggacactcggagattctcggcctctggatctcctgatgtatataccaggtgatcaagtgacagtctagtggagccattgccatcacagtgtcaggtgtcctccccttcatgggttccggtgaggatgtggcacctccctttagttggacgtgtacaataaattctcaggcctggtatgatttttaatgatccatgtgtttctatagtcttaattatctttaataaaattatagggtgacaccaaatttagggataagttatttatcaggctgtgcctttggaaggtgacgttatttacatagccaccaaggtgcccagtcatcggcccatcttccaaacggagtcaagggccatttgaaacagtgaaatccctcagggcaagggacacaacatggaggaatttaaaacagagtacagcttgatcttaacacacacacacacacaaacgtaagagatggaaaaggggatcaagggacacagaagtacagagaaaacaagacagtaagggatgtagagatgagaggtaaccacagggaaaggtgagacacaaagacgagaggagaaagacacagggacagaaagacccatgcaagcaagagagacagacataaggaagaaaaggcgagaagagacagacaaaggtgcagcaatgtggcccacctggtactcacaagaaggccctggcacacactccgatgagagccatgcacctacaaacacgtagacacagctccacacagacacacacggcatctgcacaactgtctgaacctcaaacaggtctgcccactccctctcctccaggcctttgtccttaggaaggcacgctgagggtaactcagtcgggatacttctgattggggctcactgaacagcctgaggctgggtccacagttgctctcactgtctggccctgtaccccaggtcatgcttcagagggaattaactgaatgcagtaaacaccgtctgtggtcagcatgtactaagggatagaaccctatcaggatttgtccaactaaggtccaaatacagagtgaagaagacgatgggggagatcagatggcagatgggagcactctggatagagctcagggatatggtggctgaggaacattacagctgccaggcttggcctttcatctcagctctaggtcaaggggaactacccaggtctctgctttgttgctggtaactatacctaagtctaagaacctcagtaagacacagaaccagtaagacgacagcctccatcgataagaaagaaaggagaaaggcagaatggataagtctctggacagatgagagcctacacccaaaaacagttcgttcagccagttaatagggtgtagccctagcacacgagagaaaacagttccacaggtgtaagggagtaaatctgtgcgaaggggtactgcttgagctcctcatggcctggtccagaagcagaagctgggcaggggcaaaggacagggtaaggcagggagacaggggcatgaaggagcctttgggactgtgtggtgagaactaggctgtgcttttactgagcctgagtttgtggcagttgcctcatggggaaggcacccagaggtaaggcagaggaaaggagtaactagggctgagggcaccacagggtctgaggaattagaggcagctatgacccatttgtcatggtatttggacatgtacttcatggacacagatctgagaaccaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgtgggtggggacaagctgtagagtgtccccatgaggggacaggctgagatagggactgaagtccatctacaggcttaccacactccatgctctggatgagagcactgagctctgccaccctacaacagcaggcagagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctgggaataacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctagggaaagcttttatttccccttgaattttaatcattgtctgggtgtaataccctgggttgagagctgtgttctttcagaacttggactacgtctatccaggcatctggctttaaagtttctactgtggggctgcagagatggctcagtggttaaccacacatttcttcttgcagaggacttgggcttgattcctagtacctccgtggcagctaagaaccatctgtgactccaactgcacaggattcgatgcccttttctggaggtcatctggagtagtcagctcaacagggccccgggatgcagcatggagagtccatgctgacaggcagggctccacagagagagaaagacagaaacacaggccactgaaagagacagtaatggactgaggggacagagagaaacacacggacagacagacagagataacaaaacaccgacactcatagacacagagaagagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcgattcccagcaggctcatggcagctcatactgcaatcccagttccagagtgccctgaaggatccttcatgcatgtggagcacagaagcgctctctctctctctctctctctctctctctctctctctctctctctctctcagatgaaagccatgaaccagaagacagagacatgagtgaacactcctcagagacatagccacagcactcacacccagttccacacagacacatacagcacctgcctgcctgatccaaaccccaaacccattgacccactccctctcctccaggtctttgttctcagagtagcacactgagggtagctcagcctggatacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtcttcctggcacagtctatccctggtgcaggcttcaggtcaggcccaagtgtgaagagtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcctatagcagggcatgcctctgggcatcagggagtcacacagaggcaggtaagactctagacctggggactgagaggggaaggcatgtacaagagggcctcatccttaggacacagggattcgaggcctctggatagccagtgagcaacatatgcagagtgatgaggccccaggagtctaatggacgccaggaggtcacagagctagaggcctggagggctagagtctgtgggaagggggactgcttaggttcttcccacccatgtccaggagcagaggctgggcagggccacaggacagggtaaggcagggagacaggggcatgaaggagcctttgggactgtgtggtgagaactaggctgtgcttttactgagcctgagtttgtggcagctgcctcatggggaaggcacccagaggtaaggcagaggaaaggagtaactagggctgagggcaccacagggtctgaggaattagaggcagctatgacccatttgtcatggtatttggacatgtacttcatggacacagatctgagaactaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgcgggtgggaacaagctgtagagtgtccccatgaggggacaggctgaggtagggactgaagtccacccaaggctcaccacactccatgctctggatgagagcactgagctctgccaccctacaacagcaggcagagcggcctccatgctaggaaagccaggcagcagggacagagttcctggatgggacaggtggaattgtctctgctctgcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctaggggaagcttttatttccccttgaattttaatcattgtctggctgtaataccctgggttgagagctgtggtctttcagaacttggactttgtctatccaggcatctggccttaaagtttctactgtggggctgcagagatggctcagtggttaaccacacatttcttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagagatagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctctctctctctctctctctctctctctctctctctctacactgtccccatgaagggacacgctgacgtacggactgaagtccacccaaagctcaccacactccatgctctggatgagagcactgagctctgccaccctacaacagcaggcacagcggcctccatgctaggaaagccaggcagcacggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaagcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacnnnnnnnnnnnnnnnnnnnnnnnnnnnnnnnnnnnnnnnnnnnnnnnnnncagtggcacacacacatacacacacacacacacacacacacacacacacacacacacatacactctaatgaaggcagtggcgcacacacacactctcagatgaaagccatgaaccagaagacagagacatgtgtgaacactcctcagagacatagccacagcactcacacccagctccacacagacacatacagcacctgcctgcctgatccaaaccccaaacccattgacccactccctctcctccaggtctttgttctcagagtagcacactgagggtagctcagcctggacacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctgggacagtgtccctggtacagtctccctggtacagtctccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtctccctggtaaagtctgtccctggttcaggcttcaggtcaggcccaagtgtgaagggtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcgtatagcagggcatgcctctggacatcaggaagtcacacagaggcaggtaagactctagacctggggactgagaggggaaggcatgtacaagagggcctcatccttaggacacagggatttgaggcctctggagagccagtgagcaacatatgcagagtgatgaggccccaggagactgatgggcaccaggaggtcacagagctagaggccgggagggctagagtctgtgggaagggggactgcttaggttcttcccacccatgtccaggagcagaggctgagcagggccacaggacagggtaaggcagggagacaggggcatgaaggagcctttgggactgtgtgatgagaactaggctgtgcttttactgagcctgagtttgtggcagctgcctcatggggaaggcacccagaggtaaggcagaggaaaggagtaactagggctgagggcaccacaggatctgaggatttagaggcagctatgacccatttgtcattgtatttggacatgtacttcatggacacagatctgagaaccaggcctggctctcactaaccggcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagggtgcgggtggggacaagctgtacagtgtccccatgaggggacaggctgaggtagggactgaagtccacccaaggctcaccacactccatgctctggatgagagcactgagctctgccaccctacaacagcaggcacagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccatgtcctctggagagctgcctactgtcacagatacctttcttctgtttctgctaggggaagcttttatttccccttgaattttaatcattgtctgggtgtaataccctgggttgagagatgtggtctttcagaacttggactttgtctatccaggcatctggccttaaagtttctactgtggggctgcagagatggctcagtggttaaccacacacgttgttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagacagacagacagacagacagacagagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctcgctctctctctctctctctctctctctctctctctctctctctctctctctcagacacacacacacacacatacacacacacacatacactctcaaatgaaagccatgaaccagaagacagagacatgtgtgaacattcctcagagacatagccacaacactcacacccagttccccgcagacacacaaatcacctgcctccctgttccaaatcccaaacccattaactcactccctctccttcaggcctttgatttcagagtagcacaccgagggtagctcagcctagacacttcccatgggacctggttacatagcgtgcacagggccacctcttgttggccctataacccatgtgatgattcaggaaaagatgttgtctgagagcagggcctggtacagtccccctggtacagtccccctggtacagtctctctggtacagtctccttggtacaggcttcctgatacagtctctctggtacagtctctctggtacaatctgcctcgtacagtctccctgatacagtctgcctggtacagtctctctggtacagtctgcctggtacagtctccctggtacagtctccctgatacagtctgcctggtacagtctctctggtacagcctctctggtacagtcggcctggtacagtctccctggtacagtctccttggtacagtctccctgatacagtctgcctggtacagtctgcctggtacagtctctctagtacagtctgcctggtacagtctgcctgatacagtctgcctgatacagtctgcctggtacagtctccttggtacagtctgcctggtacagtctgcctgatacagtctgcctggtacagtctctctggtacagtctccttggtacagtctccctgatacagtctccttggtgcagtctccctgatacagtctctctggtacagtctgcctggtacagtctccctggtacagtctccttggtacagtctccctgatacagtctgcctggtacagtctccctggtacagtctccctggtacagtctgcctggcacattctatccctggtgcaggcttcaggtcaggcccaagtgtgaagggtgcagaagacagtgggcagagctgagagagcgctagtcagttttgttcagagaacagtgatggctgctccaggctactggacatcccaggtgtgcttcttacacttctcaaagctgtgggaacacaaccaaccctctacccaattcattgtaattgtctatagcagggcatgcctctgggcatcagggagtcacacagaggcaggtaagactctagtcctggggactgtagaaggtatgtaagtacaacagggcctcatccttggaacactggtgtctcaggcttcaatacagccagtgagaaacacatgcagagtgatgtggccccaggagactgatgggcaccaggaggtcacagagctagaggcctggagggctagggtctgtgggaagggggactgcattcactcttcctatgcttgcccaggaacaactgtctatgcagggccacaggacagggtaaggcagggagacaggggcatgaaggagcctttgggactgtatgatgagagtctaggctgtgctctgactgagcctgagtttgtgacagctgtctcatgaggaagacacccagaggccagacagaggaaaagagtaatcagggctgagcggaccacagggtctggggacgtggaggtggctggcctggctcccacaggccctcagatggagctgcacatcatcccatagcatatcactctggagggcttatcaaaatggttgtgctgtgggactgggtctcaggactgaggcctgagatactgggtagcagaacatgttcagtatacagggtgctcagagtacgggggggggggggacaagctctgcagtgttcctccatgttgggacaagcagaaagaggtcttgaagctgtttgtccatccataggcctaacccatactggccctgctcatggccctagcttgggccacatatctagtgcccactgaatcatcaccatgaagactgttggaaaaccagagcctctgatgtcttcctgccttgcttgctctccctgactctcatagctcacacaggctctgccctggtccaccactgtcctcaactgtaaaccatgccaggcacagagagcaaggaatgtggtggtctcagactgtcacacacaacaatcttgtgcctttcacatccacacgcacaagcatgctcatacccctctgtcaggggtcagtggggtcttccttgggctcactcccatttctagctgctccttggtattggtgactgcggctgctgtgtcggtggctgccagagatgcttgatcggcatgacctcagatataggaatggcctggggtcaacagagtgcacacacttagggcactggccagagttctatgtagaccaaggcctctcttcctagtgtgttatttcacaaaaccttatgcaacaacatcttctattccttttattcctctttgtctgctaatggggaattttctagaaagagtgtcccctctctgtcttcctgctgtgtagacagatcttgtaggtgtgatcacagagtggtgtttcccttcttggccattttcaggccaggaactcagggccagagacagaaagtcaggaaggtaggaaagacagggagacataataaaggtgagatggagacagagaaagacaaagggagaaaagcacaggattgcagggagagacaaggagacgcccgacggaaacagacatcagggaaaagacatgattgttcctttagtaaattgctttccggagaaaagagacagcagagagacatggataggcacacaaagatacaaggagagagacaggaaacagagaaagagagaaacagagatggagaaacaacgagggagagagaagagtagagagaaagacacggagaaaaaaaatcaagaaacagaaaagacaaaagataggaagacagagaaataggccagaaatacagacagacagagagatgcctgaagatgttctctctcacctagagaaagaaagcacaggcagagataatacagagagagagagagagagagagagagagagagagagagagagagagagagagagagagaggagagaaagaggagagacacggtgttagaggagaaagcattatgttttgatagagacagagatacagcaactgaggaacagactgagcagaaagaatcccactcagagagagacagaggctaagctgggagaggcaggggtggccagagagggagacagaggagagcctgtgggacaggtcagacaccatcttggaagacccagtgacaagccagggaggtgacaggttagtgcagtttctaccccacagtccacaggctggagccacaggcctgtgtccatgtggccacaggctagctcccagcctgccaagcctgtctgtggagggattgcggagtggggctgggctgaggcaggccaggatttttccagtggagcagccagtgactgggctgagggtcactgcccaccatccccgtgattctgggtagacccaggacctggagcacacacagccttcctgtctctcccacttccctggggtgtttggaccttgcctatctcctgtcattccctcctagggtcagattccagcagtgtcgataaatgggaaaacactgaattcaatgtcaccgttaggggtcatggaacccccagccccatccccaaagctggtcaacctggccagggtggggtgaacctgcagctgcaggtgggggaatcattgatgctatttttggctcagagaatgagaaacatgtttttctgcatggaacaaacatccatttgcatgtgccccgagggccaaccctgcacagagtgagtcactcggcaggtgtgtgtgtgtgtgtgtgtgtgtgtgtgagagagagagagagagagagagagagagagagagagacagagacagagacagagacagacagagagacagagagacagagagagagacagagagagacacacacagagacagagagacagagagagacagagacagagagagacacacacacagagacagagagacagagagagagatgttgtgagcaagccctgtttcaggtactgatatctgtgcccccgtgccccagcccatgtggaaaaactacccttaggggcccattaactcatcacagtccaggccatcatggtgagccctagctgacctaagcaggttccaccctaaacatgaaggaaaataataaaggccatctgttacccagaatcctagggatggtgggcagtgaccctcagcccactcctggccgctccactggaagaatcctggcctgcctcagcccagccccactccgcaatccctccacagacaggcttggcaggctgggagctagcctgtggccacatggacacaggcctgtggctccagcctgtggactgtggggtagaaactgcactaacctgtcacctccctggcttgtcactgggtcttccaagatggtgtctgacctgtcccacaggctctcctctgtctccctctctggccacccctgcctctcccagcttagcctctgtctctctctgagtgggattctctctgctcagtctgtcagccatagttggagagagtccatctatgtttgcctctgtctctgccaattccatcagaggtctctctactaacacttgcctctgcatgtgtctcttggtccttctcctgtcttcccatctctctatctcctcatctctctgtctttctgttactccctgtctctgtctctctgtcttttctctcactgtctttatctctctgcctgtttcatggacttttctctgtctctctgtctctgtctctctgtctctctctctgtctctctctgtctctgtctctctctgcccctatctcttggtctctatctctatcttcaactccctatctttgttcctcatactcacatttacctctttcccaagcccccagtctccaggtctgcctgtttctgtctctcccttgccatgtttccctgttttattctctctcctcctgaatgctctggcttgaaactggccaagaagggaaacaccactctgtgatcacacctacaggatctgtctacacagcaggaagacagagaggcgaccctctttcaccctacagtgtctggacttggttgattccaggttactcctatactcaagtccgggactatggtggtcaagcatctctggcagccactgggacagcagctatagccaccaacatcgagccctgttagctaccaacattagctcctcaaagaggttgggtctataggcctctggtgtgaggagatgttgacagtgagaattagttcccaaggaggacaccactgtttcctgttagatggagaactacagtgggtacgaacatgcttgaacacatgagtgtcaaatgcacaagactgttgggtgtgtcacccttcccctctctgttcatggcatgactgcacactgaacacaatggtggattgggacagagtctgtgtgagttgagaatcatgaagagtgtagacacttcaaggatagtgtagacccttctagttcgtggtgatggctcacttggcactgagtttctgaccccacagggaccatggacaagggcagtatgggctgtgcctatggatacaaaagagacttcgaagcctgtattagcctgtcccctcatggaggaacacagcacagcttgtctctacccacactctgagtactctacgtcctggacacctctgtcacccagtgtcctaggtcccatccttggctcccacatcacatctgcctttcagacagatcttccagtgtgacagacccatttcatggtgctgaacaacataaacccatttcctgagggttggtgagagccggcctggttctcagatctgtgtccatgaagtacatgaccaaataccatgacaaatgggtcatagctgcctctaattcctcagaccctatgggccctcagccctggttactcctttcctcggcctggcctctgggtgccttccccatgaggcagctgccacaaacccaggctcagtcagaacatagcctagttcctaccatacagtcccaaaggttgcttcatgcccctgtctccctgccttagcctgtctgtgctcctgcacagacaagagttcctgggcaagcataggaagagtgaatgcagtccctcttccaacagaccctagccctccaggcctctagctctgtgacctcctggtgtccattagactcctggggcctcatcactctgcatgtgttgctcttgtacatgccttcccctctcagtccccaggtctagagtcttacctgcctctgtgtgacttcctgatgtccagaggcatgccctgctatagacaattacactgaagtgagtagagggtcggttgtgttcccacagctttgagaagtgtaggaagcacacctgggatgtccagtaacctggagcggccatcactgttctctgaacaaaactgactagcattctctcatctctgcccactatcttctgcacccttcacacttgggcctgacctgaagcctgcaccagggacagactttaccaggcagactgtaccaggaagactgtaccagggagattgtaccaggcagagtgtgccaggcagactgtacaaggcacactatatcagagagactttaccatgcagactgcaccagggagactgtaccagggagactgtaccagggagactgcaccagggagactgtaccaggccctgatctcagacaacatcttttactgagacatcacatggattacagggccagcaagaggtgggggctgtggaccagaggctcatactgtgttaccaggtcccatgggaagtgtccaggctgagctaccctcagtgtgctactctgagaacaaaggcctggaggagagggagtgggtcaatgggtttggggtttggatcaggcaggcaggtgctgtgtgtgtctgtgtggaggctgggtgtgagtgctgtggctatgtctctgaggagcgttcactcatgtctctgtctctggttcatggctttcatctgagagagagagagagagagaaagagagagagagagagagagagagagagagagagagagagagagcgcttctgtgctccacatgcatgaaggatccttcagggcaccctggaactgggatttcagtatgaactgccatgaacctgctgggaattgaatctggattctctgtgaaagcatccagtgctctcaacccttttggggtctctgtctcttgcagtgtctcctctcagactctgtcttctggagtcactctctgtatgtattgcctctgtgtctctctcacctcctacccattgctctcaaaacttccctgtcccctctgttctctgtgtctatgagtgtcggtgttttgttatctctgtctgtctgtctgtctgtctgtccgtgtgtttctctctgtcccctcagtccattactgtctctttcagtggcctgtgtttctgtctttctctctctgtggagccctgcctgtcagcatggactctccatgctgcatcccggggccctgctgagctgactactccagatgacctccagaaaagggcatcgaatcctgtgcagctggagttacagatggttcttagctgccacggaggtactaggaatcaagcccaagtcctctgcaagaacaacgtgtgtggttaaccactgagtcatctctgcagccccacagtagaaactttaaggtcagatgcctggatagacaaagtccaagttctgaaagaccacatctctcaacccagggtattacacccagacaatgattaaaattcaaggggaaataaaagcttcccctagcagaaacagaagaaaggtatctgtgacagtaggcagctcttcagaggacacggggagtaatgcctcagactgaagagaaacacccattcacatgaggggacaggggctaaatcaagcgtgaggaggtgtggggatgggaagtgctgggtggcaggaggcttagccccagtgaagggttcctgcattcaaatctgcaaacctccacacaagaaaaaaataatatgaggggacgtagaacacaggcagcttgaaaatggaggatgcttttagcattaaagatttaagtgtagataacagggatgggggaccggggagaggagaggagaggagaggagaggagaggagaggagaggagaggagaggagaggagaggagaggagaggagaggagaggagagatgttcagttatccaaaactaaggatccatgaagaagccttatggaaatccactattttgtaaatgaactaacatttattaaggaattttaactcagtgtatggctgggtgaacagtgttgttcccagaagaatgggttagattgtgtgtggtggcacaggctttactcccagcatttattagaaggcagagacaggaggatgtcccaagtttgaagccagcctggtctacacagggtgttctaggatacccaggactacacagaaagcccgtgttatacatagagagatgtaagttgtcacatgaaacatggaggcctacaagttattgatcaggaagtctccagaggaatccaaacaaagcaggctgttcattgactatgttcctggctgtccaccatgactagacagtaagaccttactgctgaaggtccacttagtttgatgccgagcagagacaattccacctgccccatccaggaactctgtccctgctgcctggctttcctagcatggaggccgctgtgcctgctgttgtagggtggcagagctcagtgctctcatccagagcatggagtgtggtgggcctgtggatggacttcagtccctatctcagcctgtcccctcatggggacactgtacagcttgtccccacccgcaccctgagcactctacattctggacacctctgtcacccagtgtcccagaccccaggcctgggctcccacctcccaacatcagcctttcagacagatcgtccagtgtgagaggcccatggcatggtgtgctgaaagacctacagccacaagtgggacacctcctgccggttagtgagagccaggcctggttctcagatctgtgtccatgaagtacatgtccaaataccatgacaaatgggtcatagctgcctctaaatcctcagatcctgtggtgccctcagccctggttactcctttcctctgccttacctctgggtgccttccccatgaggcagctgccacaaactcaggctcagtaaaagcacagcctagttctcatcacacagtcccaaaggctccttcatgcccctgtctccctgccttaccctgtcctgtggccctgcccagcctctgctcctggacatgggtgggaagaacctaagcagtcccccttcccacagactctagccctcccggcctctagctctgtgacctcctggtgcccatcagtctcctggggccacatcactctgcatatgttgctcactggctatccagaggcctcgaatccctgtgtcctaaggatgaggccctcttgtacatgccttcccctctcagtccccaggtctatagtcttacctgcctctgtgtgactccctgatgcccagaggcatgccctgctataggcaattacactgaagtgagtagagggtcggttgtgttcccacagctttgagaagtgtaagaagcacacctgggatgtccagtagcctggagcggccatcactgttctctgaacaaaactgactagcgctctctcagctctgcccactgtcttctgcactcttcatacttgggcctgacctgaagcctgcaccagggatagactgtgccaggcagactgtaccagagagactgtaccaggcagactgtatcagggagactgtaccaggcagactgtatcagggagactgtaccaggcagactgtatcagggagactgtaccaggcagactgtaccacacagactatactaggcatcttgtaccagagagactttaccaggcagactgcaccagggacactctaccagggacactgtaccagggacactgtaccagggacactgtaccaggccctgctctcagacaacatcttctcctgagacatcacatggattacagggccaacaagggatgggggctgtggaccagagatgcttgctgtgtctccaggccccttgggaagtgtccaggctgagctaccctcagtgtgctactctgagaacaaagacctggaggagagggagtgggttcatgggtttggggtttggatcaggcaggcaggtgctgtgtgtgtctgtgtggagctgggtgtgagtgctgtggctatgtctctgaggagtgttcacacatgtctctttcttctggtgcatggctttcatctgagagagagagaaagagagagagagagagagagagagagagagagagagagagtgtgttgctgccttcatttgagtgcttggtgggctccatgctgtacctctgccttccctgtgtgtctgtccttttgcctctcccttcctttggcctgtctctcttgtctgcatctgtctctcttgtctctccctctctgtgtctcttttctctcctgtctctgtgtctcttctttcctgtggtctctcctcatccccatgtctgcatcagtgtctatcagtctttaactctgtgtcctcttgttcccatttctgtccctctggatatttctgtctttctgtgtgtctgtcctcatctctcccagcgtccatgtctttgtgtccctttgtccccacacagtatcttctcaaatactctgtgtgcctggtcccctgtctctcattccttttctcactgctcccatcagtgtttctctgtgtctctgcttctgtgtctctgtgtgtctgtctcatgctatctctttctctctcattatctctgtctccctcagacttctctgtctttcttggtctctgtctccctctgtgtctctgtctttctgcatgtctaatgtctctgtgtctcccttagctcatctctgtctctctcaatattcccacaatcccctttattctttgtgtctctgtctctgtggtgtctctttctcagtctctctgtatttcgctctgtctctcagaatctctgtgtccctcatattatttttcgaagtgtctccctatctctttcagtaacactatttctgtttttctcagtctctctctctctctctctctctctctctctctctctctctctctctctcagaaagtctatggcacctcttctatgtgtgtcccactctggacctggatcaatcttccttcttggacctcagtttcatcagttgtgagacgataccttgccagaagtccagaggactgtctgtcctccatagtctagaccacctgtgatctgagagatattgggacaacggatgtgcagtgagggacctgcctttctgtggagccctgtctggctggaatacactctccattctgcatcaccagagccttgttgagctggctattctagttgtctactagaatagttgtgtgaccttgggtgatgctggctgacctcaggctggccttggctggccttggttgacactgaatgaccctgggaagaccagacttaatcttaattggacttgttctcattgggacagaacatggcctcactaaggcatgactgtggatggttgtggagaaccttgagtgatgggggttggggccttctcagtccctgtcagggctcccctggctctgacccctcatccagccccagacccacctggcctggtccagggtggtgtgattctcagaacagtagctctgttttggggcacctgggctgagataggctcaggatgactcagctggcctcagagtggagttattttgaatgtttcagcaggtgatagaaaacagagacttcagaagaaagaaaaacaagatgctaatgtgaccatccctgccctacccccacacctgccccgcaaaccttccccacaatgctgaccccacatctgtagaccccaggccagaggctccagctcacagggcctgggcctgctttgtttccattcagtgcctctgggaaaggcagatgagtaaaggggtcactctcccagttgcagcccagtgtgtgaacagtgtggtggggattctggaatcttctgcaggaatcccctgaagagatcttcctaatgagaatgaggcttggaatatcaaaggtacttcttgtaaaataccactgattccttgggcctcagagaatggatgtgtgatgaggaccaaggtccaggaccagtgttgataagcagaatttggggctagagttcaggcttagaagttgatgttgaggacctgggcccattgatcagtacagaacctagttgttagaatcagaacccagtgtctatgaccagagctcagtgatagggaccaagtcccaaggccaaatgatcaagaccaggacccagttgccaggaccaagatccaggtttcacaaccaaacctagttacgcagaccagaaaccattcgttggaatctggatctgaatcagagcccaatcacactactctaaaccagagttcagtgttgaggaccagggtacgtgatgagcccaagattcagagatcaagaggtggattcagtaattaagaccaggattcagagatcaggatcagggctcagttagcaggatcagggctcagtcatgtggtcatgggctcacggtccaatgtccatgcccaaaacacaactaaggacccagtggtcagaaccaaggcctgatgatcagagacaatacacactgctcagagctgaatttcagtggcaaggatgaagacataatgataaagactagggatcagtgagcagaaccagcgatgaggacccagacgcatctctgaagactagagtcagtgaccatgaccagttcaacgatcatgagtaggacttaattctgatcatacgagttcagtgatcacgaacaaggctcagtgatcatgacaagggctcagggaacaagagtgaggctcagcgatgaaaactggacctcagttatgagcccagtgatgagtaaccaggtctcggtcattagggccaggattcagtgataagaaccaagggtctctgcagggctcagtgcatcctctccccctgagactggacaaagccgcccagccacagggatggattctccagacaggcaacagcttcagggacagcccccccgtgatgcgccagagtaggggatacccaggggacttccacactctcaaagaagaaggggagaatggaacatgaagaagggactgtgaggggggaccgggaagtgggggacacagtgactgggatataaagtgaataaataaattaatggaaaatatcacatgggtgtagggaattttgaaagaataaataaaatgttaaaaatgaaaagaaaaaaagaccaagggtcaatgatcagggtgataataaataaataaataaataaataaataaataaataaataaataaataagaaaggaaagagagaaagaaaggaaggaagaaagaaagaaagaaagaaagaaagaaagaaagaaagaaagaacaaacgaactgaatgtcagaatttagggtaagatctcagtgatgaggatcagggatcagtggtttgaacgcagacacactgcccagggccattgttcaatgacgagagtcagggatcagctatcagaaccagggccagtaacgaaagccagggcccagtgaccccaaccaaaaaccagtgactaaaaccaaataaaatagaaactaggcagccacgatggtgcacacctttaatcccagaactcaggagtcaggggcagggggagttcaagacaaccctggtctacacagtgagttccaagacagccagggctacccagagaaaccctgtctagataacaaagactagaaaccatgagctcagtgatcagtggcagttcttgatgactaagaccatggtcaagaggactgatcagcaggactcagtggttagactcaggacatggtgatgatagcctctgttccagggatcagaaccaaggccaagggccaaggccatgactgagtcatcagaacagggcctctccatgagcactagtcaggcgcagccaggcctagcatgtcaatcaggcaaaattgggtatgtgtgtggtggtatgactgactatacatcgtcttagtatctgtctgaccccaccaccatcttccctgcctccgtccactcacagatctctg

SEQ ID NO: 2 - DNA, 525871 bp, Artificial Sequence
  Description of Artificial Sequence: Synthetic polynucleotide
  BAC6-BAC3-Annabel (FIG. 1a after integration)
  modified_base (474423)..(474552): a, c, g, or t
  modified_base (506441)..(506490): a, c, g, or t
  modified_base (518064)..(518468): a, c, g, or t
  modified_base (521625)..(521632): a, c, g, or t
atcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataaagatcccccgaacacaacccacagctaccaccatcaacaatatttatatatataacgtacacatagaaatcacacaaacagagtatttattcttaactacatgaactaccatcagaccgtctgggccactatataatgtgccattcataaacgtgatcactttacgtagcaggcaaccccaggtgaaaatttttcagcgagctgccagattgtcaggtgaaaaactgaaaaaaacttctgggcgatgagcttgtggcgggaaattaagtatataaagcagttagtttcttctgcttcttgtggttctgggtattcttgtaatatttggaagaatagaaaatcaagactactgcctttcttttcatattatagaggaagaaatacgcacgaacacgatatagaggtaaagggggagtctggcaacccttcttgccactcatgtcccagctctcaccatgtgacatagcctgttccccctttgccttccatcatgattgtaaagtagatcctggtgccatgcttctcacacagccttcagaactgtaagccaaatgtgcctcttttctttgtaaatcacttggcctcaggtattaatttataggaatgcaaaagagactaacacaccgtccaaagcattacacagattcaactctatttttatcaaatgaccaatataattgattacatatttagaaaaaaaatactaaaattcctatagaatcaaaaaagagtctgaatagcaaaagcaatcctaagcaaaaagaccgaagctggaagcaccacattctctgacctcaaattatactacatgaatataataagaaagacagcatgctactagtagaaaaaaatagcccagaaagaaagccaaatatctaaaaccaactgttgtttgacaaaactgacaaaaatatacactggagaaacaaccctctattcaataagtggtgccgggaaaattaggtggcttatgtggaagaatagaactagacttccatatcaccgtagacacaaattaactgaatatggattcagtgtttaaatttataaactaaaactataaaaatacttgaataaaatctaaaaagagtcctctggacattggtctaagcaaacaatatatgactaagacttcaaaagcaaatgcaataaaaacagaagtagacaaacaggatttagttgaactaaaggtcttctgcacagcaaaagaaataaccaacatggtgaccagacaatctgcaaatggaaaaaatatctggaatctattcatcttgcaaagggctaatatatagaatctacaagtaactcaaataagtcaactaaaaattacaaataacttcattaaagaatagacataaacagacatttatcaaaagaatacacagaagtggccaacacaaataagaaaatatactcagcatcaccaatcatctgataaatgtaaattagaaacaacatgatacggcatcttccaccagtcagaatggctgttattacaaataaaaacagcaggtgtttgcagacaaacataggaaaaataatgatttatatatgcttggtgagaatgtaaattagtacaacctccatgaaaaacaacatagaaatttctcaaagaactaaaattagaattaccatttcttccagtaagctgtcccagtaggcatgttcctcccaaacttttatatcagagaatgttgcctgcactcatatgtttatttcaacaccattttcaatagaaaagtcaaataatctaagtgtcaatcagtggatgattagataaaatatgatatatgtaaatcatggaatactatgcagccagtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgcagatcagcagcctaaaggctgaggacacggccgtgtatgactgtatgagagacacagtgtggaaacccacatcccgagggagtcagaaaccccgagggaggaggcagctgtgctgagctgaggcagtggtgcagcagtttctttaacttccatatgatctcattttgcatcatcttctacttttatattagctaagaacttggggtagacaggtgctcctaagagatccttaacttgcccattttgatgggttttccagaagacgtgagaagccactttgttagcaaagcatcccaaatccatgccctgttctagatacatgtgagcccatttcctggtctttgcttaactgacaagctctcatcagtgcacctgggctaatttcacatcaggtagaggaacgcgttataaaggaaagctaatgttgtaatagcaattcctgcttaaaaaccttcagcttcattgtttttgtgtaatccatcagcaaattatgttagttcaaggttctcaatgggagtttctaataaatagaaaggatgtataaagcttcccctaattaaaatgaaacaattgtgaacacaacctcggtattcagccatgtctccacccttcacacccttcgccacaaaggaattttcacctctcctggaagctgggttcattttcaaattagttatttttttcaatgtaatatctcaagattatcgtatatgactattttagcagaaagtgaattatgggaacttgaactaaacaactgaaaacaaattcacaactaattaaacaagatgccagaatgtgattggctccaggctttgtaattcagcagttcatgtacccagactggaaatttacatgtcttcttgttaccttcacagcacagtcaactcccattatgtaagaaatggtgactgcattcccaagggttatgcatagatatgaaaatagactgggtaaggtgaggagttgattgtttaaattcccctctgaagaagcagcatcaactcaacaaaccacctctcttcactctgtgactagagctatgtcacaggccacatggacctaaatccttgatggatataacatgactacataaattgggctgatcatttttatgctataaaattaatagatgacactgcactccagcctgcacaaccaagcaagtcttcatctgtaaaatctaaaaaagaaaaattaataggtactgacttcgaaatttttgataataatattttcaccacccaaatttaatcacacccacatgttacctgcatcttcactgaaaagttcccagtcacgatgagttccttcaatgctccatgtgttcaaatctggacatcaagagagtccagagaataaaacacaatgacggcagtgaaactgatatatattcagcacctcttaactcaggaggactccatacaccctggcacacagctgcttttctaaatggctcacaatgactccagctcactcacagagctcagacagaaacctcccttcagggtgggagctgggtggcagggggcactcagtacccgcagaggtgaaaatgagctttcagatggaacttccctgtcacctcaacatggaatttattgtttcatttcattacctctctttccataatggttcatttcttttggcctgttcattactgatatttttcagagcaatctcacttgaatctttactcttttgcattttgtctccttgacaatgttgggaagttttacctccagcatcataacatgatctagtgatctgacacattgtgcaaacaatacctacaaattcagaacctctttgtttttctttccacaaaatataattctttctgttctgtgtatgagcatgtcttagcaaccctgtacacacccacatagatgtctacaagcctatgaattgttctctgtaaataaaaatttatctcaaattccttcaatgttcataattctgagagtgaggaaggtccttctcaatctgttcaaacaaaatgcccagagaccatccagtaggtaaggagttcacctggctctggtgtggggtctgtctctttccctctgttgtcccacaggtcagcccagttgttcacgtcctaacaagaaagcccaggtttgtcctgattttaaaacacatcaaacttctgatgactctcctgttacccacatccatggagatagattatttattatataattcagcaaactaatgtcaaatgcccaagttgcaataccgcacatcctagggtatgttcatgcaattcaatggaggagaaaatctttcagagacagatggatctgaaatgataaatatgtgggtaaggactctgggcttgagtatcattgtccagccatgtttcacaagtgtgtcctgtcagggaaggatcagagttccttgtgctctcagagggaaggggtcacagagttcctctctggttcccaggaaaggtaatcgcactaatcttcatgatcttcatgagactatcctccagtgctgacctgttacggagtttttgtctgaagttctcactgcaatccccaatctacatattttcaatcagaagtgtttagaggccaggacacatcttcaaggtcacacattgagaagtatggagatatgtcccactaccttctcctacgatctcagacagaatcccaaatttcaaaaggacacagaaggacagctctcaggtgcttttaaaaaatgacccacttccagggacagtgagcttccctgtaaccatggtggatgttctgaactacaataaacattggatggatccagtattgtttgaagtcactgtcattattacattcagctgttgtttcaatgtgtctgaaagggtaaatgactatttagatggcctgggtgtgtggttggttttatatgaatctttaagggttgaacagtactgaccctattccaaaatctgtccttgatccaggatcacactcatctctcagaccagctccttcagcacatctctttacctggaagaagaggactctgggcttggagaggggaggccccaagaagagaactgagttctcaaagggcacagccagcattctcctcccagggtgagctcaaaagactggcgcctctctcatcccttttcactgctccgtacaaacgcaccacccccatgcaaatcctcacttaggcgcccacaggaagccaccacacatttccttaaattcaggtccaactcataagggaaatgctttctgagagtcatggatctcatgtgcaagaaaatgaagcacctgtggttcttcctcctgctggtggcggctcccagatgtgagtgtttctaggatgcagacatggagatatgggaggctgcctctgatcccagggctcactgtgggtttttctgttcacaggggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacacacagtgaggggaggtgagtgtgagcccagacaaaaacctccctgcagggaggctgagggggcgggcgcaggtgcagctcagggccagcagggggcgtgcggagctcacggaatacaaggccgggtcaggagcaggtgcagggtgagcggggcttgctcatcttctcagtcgtctccctcctcgccagcacctcagctttccgtagaggtcctctttctttattgtgtgtggttctacttcctcacatccttgtgccaggaaagaaaggagtaaggcaaattttcctgttacaattgaagtttcaccaattactaagaactttcctgcaagtacctgcacagcccattataccttatttatatatgtatatattctaatgcttctcaccatctcttgatttgtgtcatcaatttaattgtgccctttttgaaattcatatgctgaaactttaaatccaatggatctatatcggaattttaatggtataattaatgttaaatgtggtcataaatgagaccctaatgcaatagagctgttgtctttataagaagaggaagagacaccagatacctctcacttctcacatgcactcagagaagaggccacgtggagacatagtgcactagaaggtgggcctctgcaagccaggaagaagccgcaccaagaaccaaccctgccagcaccttgatcttctacattcagactgcagaattgtaagaaaatcaatatttgttgtttaagccacccactccttttgtcttcttacgaagacccagacaggctaataccacacaactctgttagctccgtctcctggagggagaagcagccccctgaagctgggcacatcgctcagattttcacatgaattaggcaaaaacagtagctctcatataaaaactgtcacgtccctgttgggacaaggtcttttaaacaagccctggggctttgtcacaaatgttgcattttatcctttattaggacttaactaattgacaatgagtaccagctggatggaaactgaccactgaccatcttctgctgtctccttattatatcacagaaaaccacagcaacattactctatgtcttcaactttctaaatttgtactgaatctattgctaaatgaggagctacatggggtctgagttttgttaccttcttcccagtcttccccaattaccaagcatagaagatactttcagtgaaatttagctgtcaatgcccccgacaccacatcatgttttaaggtccaaggactttctttggggggctattgaaaaacacttttgaatggaaaatcctaaagcatacaacagctgaaagaatggcccctgtgcacatgaaggctgaagggatggatgatagggtacgttcctccaaggtgttcctgggcatgtgatggttggatacctcatgcatacgaaaacaaggactgaactgagatagaaacaagggccatatcctataggaaaacaagaaaaaaacgggcatccctgaagagagttaattagacttggtgggtttaagatgaatttttttccaaagttttttaatgttctaagctaaatatgaatattttcaataaactgcaaattaaaaggagaatgaatttagaagtttagacagaaaaaagccatgagggtgtagaaagcaaatccacacaaaactgtcacatggcagaggccagaatggagctgatgcagctacatcattattctgcagacctagttgagaccctttggtgtttaaggcaggtccagcagtgaagaactcctttattttttgtctggcaaagttctaatctaatcttcatttctgaaaaggatttacatggtaaagattcgtcttggcaggttttatttatttttagtcccccccaacccacgtcaatttgagtaaagtcatgtgttacgtaacaatgctgcagtcaacagtagaccacatatatgtttgtggccacataatgttgtaataccatattttcactaaactttttccatgttttgatgtgtttagatagagagatacttaccatggtgtttccatttcctgcagtgttcagtgcagtaacacgctgtacaggttagttgtctgggaaccctgcgctaatccacataccctgtgtgtagtagggtattccttgtaggtttgtgaaaattcacccttgatgcttgcacaatgatgaaattgcccagggacacatttctcaaaaagaacctctgtcaataaaccacacaccattgaatacaatccctgtgccttctgaactgaaaaccttctgctgagaaatctgttccttttctttctgttttctaaagcctcttttatttccagcaatgtggttttaaactgtgtcacattttttgtcattgggtttatcttacgtaaaatttatagagcttcttcattgtggatgaatatttgcttcccttctccaaatttggaaatattttttgctattattttgaataatttatctcttctctctctctctctctctctctctctctctctctccctctctctctctctctctctctctctctctctctctctctctctctctccccctctctcccttcactaccccttttgtcttgtctttgtataactcctcaaatgcgtagttgagtgtttagtgtctttcctggcccataagtcttgaactcttttttatttctttcacttaaatttttcttctctgtctctactatttcaaatgatctttctttgagtttactgtttcttctattacttgatctagtttggtctaaaatcttgttaaaatttttggctgtattcttcaggatcaatatttttgtttagtcatcttttaaatgttttatctttattaaaattctcacattgttcttgcatgctgccactagctcattgaacatgtttctaacatttactttaaagtttctgtcaggtaatccatgttcttccttttcattgatgtcagtttatggaccttttggttgttcttctgtttggaccatgttcccctgcttcttcattttccttgactgtctttgttgttatctgttctttataacaaaagccatcatatacttcttcaaagactaggctcatagagatcaccctcaccaatcagcccagacagtaattgtgggtctctcaaaacttgataggattcaaacttctgtctgttcttagtggcccctaggttttagaggatgatagattgtgccaggactcacaggtaagggaggtagaaactatgtactcatgaccatggggtctgtgctgatctgagcttctcttgtcatcactctcaatattcaacttccccgtggatcaggctcagctgtggctgctccacgtggggctgttctcagtctgttgcctctgtgtgtgcagaagtcctctgtgaagttaactagtggagtcagacaggaaaatactacagaccaagaattctcagactgttctgcaaagcccctggattcactgaaaaaagaacaagtttggtccagcaggattcatggcaagtgttggtgagggagataacagtaattcaagtggaagttctcaatgggactcgccttcagtacaaagaagattaacagtcctcagagacactgttcagaagattctcttttaagataataaaactgagagcccaagacaagtctgtgtattactgtgagggacacagtgtggggacatctatgtgagcacagacacaaaagtccctgcagggagacaggaggggactgcatgttagttgctgctcagaaccaccagggggcattcaggacaccagtaggcactcagaaccaccaaggagagctcagaatcaccagggggcactcaggaaactggcaggtgctcagaaccaccaaggggcgctcaagatcccagcgggagctcataaccaccagggggcgctcaggacactagggggctcagaaccactagggggcgcccaggaccaccaggtctctcaagacaggagggcgcactcaggacactagggggcgctcagaaccatcagggggcaatcaggacaccagagggacttcagaaccaccagggggcgctgagaaccaccagggggtgctcaggacatgaccggccctcaggaccaccaggggatgttcagaacaccaggaagcactcaggacaccagagagcgatcagaacaccagggggcactcagatcctccagggggcactcaggacaacagggagctctcaggacaccagggtgagctcagtaaaccagtgttcgctcagaaccaccagggagcactgaggacaccaccgctcccttaggaggcagctccacatcaggtccctggatccgggcagggagggcggttccttttggatcttgccactaaccttttgggagttttcctgcttcctttgtggtttcaagaatcatttgcagattcttctcatgtacaaagctctgctttcttggattatgtaatgtttttggctttggatgctaccagaattacgttgtactgtgagaggattcattcgtggtgtgtgcaatagtgaatgaaagctccaatgttaggggtggctttgaaagctacgttaggggtggctgagggcagttagcagaaaatgatcatcactatagaaggctactcatttctttgcacatttgcataaacaattgtagtttatgccctaaaaactgcatgttttcttggccctttttcttaaatggctccactctaagtccagtaatctaattaagctgtgtttcaaagaccaccaatcaagttaattctgtttaatgcaacactttgtaaagaaaatgtacatctgttttttagagtcagctttaaattttacattactttacaaatattgatttgtcaaatttagtctcataactatcttcagtaatttaaaatcttagtcatgtcatgttaaattaagtaatcctaggtttctcacttgaattagggttactaagaattagaatagtaaaagagtataattagcttttggtgaggtttataaagaaagatgaggatttttttttttttttgcttaaaaatattctgttttccagtttacagggcttttcaactggttttaagataaccactgtttacatctaaacttttttttgtaaatgactgctgagtttctatacatattccatagctagagtttcaaagtaaaagctctagtatctttgtattagtgtgtgtatgcgtagatgtgttaatatgtgcatgtatatatatgtgtgtgtgtgtgtgtgtgtgtgtgtgtgtgtgtgtgttgtggctactaggtacaaaattggctttgaaataaatattttcaaattaagtaaatgagcccaatgcatttgaagtacatgtgacttaaataaatatttaataaataagttggctttaaaattattggtaaaaacaaattagagatattttaacaattatcagcataccttatagtttatattaattcatcaagtgattttatatttaaaatcacagctagatattatatggtgtcaaaattttttatgatgattataaaattattaacctcgttggccatatgcggtggctcacacctgtaatcccagctctttggaaggctgaggtgggtggatcacgaggtgaggagattgagaccatcctggctaacatggtgaaaccccatctctactaaaaatacaaaaagaaaaaaaaaattagctgggcatgctggcaggcgcctgtaatcccagctactctggaggctgaggcaggagaatgcttgaaccccagaggtggagcttgcagtgagctgagatcgcaccactgtactgcagcctggatgacagagcgagactccgtctcaaaaaaaaaaattataaacctcattaaaaccagaatgatctttgtaattttttgacaaatatgatgtttaatattgttgttttaataaaaaacaggtaaatagttattagaaaaacaattatttgcttaattataaggtttttactcaggcaagcacctgaaattcatgggttataacatggttaacagagaaaaaactttaaaggatgaattacaattttcataagtaatctagataagctacttaaataaaatagggaaatgtaatcaaataaaccttttaaataaacttgttctacaatttaaaaatctaaagtttaattaaataatagatattgactaaatgtttaggtcattactaattgttttaaaaaatatataagaaaatatttttcttaaaaaattattcttagaaaaataatgtaattcaaagttatttatataacatcataaaaagtaagagagttttaaagaaatttattgacatagagaagtacttttggtaagaaaggttaaaataaaaaaattttatatgagaaataatcttgcatggtaattttttatcctaaaataaaatgactaagaaagaatgacgtttagaataaaacaagatgttcaactatgccataaatggtttgtgtaagtgaaaataagatttataaaaagttaatttattaaaaaaccttcatattatcaagttgactataattgaaagggaagtatttataatagtctttatagagatctggcttttatataaaatatagtaatacactgaagactggttagaatgacaaaattgtcttaaagtgttgatttactaaataaaattataagatattttaattttttaacccccaaatttaacttttattgcatcttgccattttgattttttccctttgagaagacttgagaggctctccattttttcatcacgtcctttaacattttttttcttacagcgattagcttcttactgacttaacttctaactgttgttagcttttaactgctattattgtctgatgctaaaaacattttatctttaagttctaaataaaatgttttctttcaatataacattctacactcttggcttatctttaaatgtctacatttttctatgaaaccaaagtcttcacgtgtaatctgagtcacattcttggtatgtctaattaattcaaatgcttttttcattagagttgacctgcaggttatctacatgcattttccaatagggaaaagcaatcacactgtaaaaggttttgctttgctatttggtaactggcataaaacaaattttatattttattgaaataattcctatgttactgttattaaggtttccaacttactgagattttaagaaaatataaattaatgttattacattcatgtagctatctacattacttttaaaggccttgtgctgccacattactgacctttgactcctaggtctaaaaaggacacacagcattttgggagactaaggcaggcagatcacctgaggtcaggagtttgagaccagcctggccaacatggcgaaaccctgtctttataagaaatacaaaaattacccaggcatggtggtggatgcctgtaatcccagctacttggaagcctgaggcagggagaattgcttgaacctgggagacagagattgcagtgagccaagattgtgccactgaactccagcctgggtgatagagcaatattccatctcagaaaaaatatataaataagagaaaaaggacactaagtcctgctaaatcttaaacactgacagtaattaaagccccatctacagacctggaagaaaatgacaataaaaattcatcatactcttaagacataaggccagaaattgaaactactcaacaactccaggcccagggactattacagaagtggatttgtaagattgtaaaagctaattttgagatataatattacttgagagtttctttataagttaagcattaatattaaatgcacactaatggaagtctagcatctgggcccctgtgacagattgacaagggtttcttgaagaagtaatccactctttagcttaaaaaattattaaaatttataaaagacctatgaaaattatattttatggtaaaagtagttataatttaatagacttatttctcagaattgagagatagttttaatttttctcatgatgttcttataaggggttattgtttagaaaattaattctttcaaaaataaaagtttttgcttttttaagaaatcactgagttttcacttggctaaataaataacttactttacaataatctgtaattccattttgtaatatcaagtgttctaaataaacctttgatatttgacctccttcacaaaataaaagtctaaattcagtcatttgacctcattattcttttttgatatttgatctcctgaagccaaaaagaaacatatttagcttctttggtacaattaaattatactggaagcaatgtcaaatttgaaatggtgtttaactttggactatatttatataaatgtggactatataattggagtatattcatataaattaaagagtacatgttctaaaatggtatgaggttcaattgactttgatatgtcagtatattttgtcagtagtacttatgattattatataaaatttttgttcatcacagaaataaccaaactttctcctcaattctgtctttaaccgtggctattctaaaacttcagccatccacaattgttttcctttgattctttatcaggtggcttataataatctatagaattttgaggggtactcttaaatacacaattgtgacaattttataaattgtgccatttatatacagagaaaaacttccaagactctcatggagacctgatgcatttatgatggttgttaatataatgtcaaacaggacaggacttaattgcatgaactgaactaacaggagcctgaaataaattttatggcttattctttaaagcatttgctaattacttacattttgtttttcagaatcaaaaaaaaaattctcttaagctattcattgtttttaacaattgagtatagtatattctagtgagaaaattcaaaaacacaatttcttcttctctacataatttctccaaaatttggaaactgtgagtattgttatatcaaaatattaattcacataggttcaatataaatctgctttcttccgtaacagggcacaattggagacaatgatcattttaccaagactttaacttgaatgacatattttcatatttactttataaaatgaatttaagctggatagctgataaaagccccttgggaaaactggcatgtaacctgttttgttcagggccctgagctgtagtaagtcaataattttactttctgacagacccaggaatcccaagttgtcttggaaaattgaaaaaagaagaagtaacccaattcatatagctgtctgaaggcacagatgaaacaatgtctgggcttgatgcttttaaagattctacccttagatttcttataaaaaatttccagcaaggtcaatttatgaattaaatagcctatgtacaaaaaatagaaaaaaagagagctaatatgttaaattactatttttgcctcatcttatacaaaaaaattaagcctaaaacttatattacaaataaatttgccctactatgattgtgtctctaataactttggggaattatagagagaaatactgtttcaaaataaacaacagtgcatctgttattagattctaaccttgtccacttgtttttcaatttatattattttctacaatttatattagtttctacaatttatattagtttctataaaaatttatatttgcagaagcctccaaaatatttttcctgatttaaaattaccagaagttaaactgtgctttcttatagctagacatcttatactctaaagaaaataaaatcaatgacatgatttggctctgtgtccccaccccaatctcatcttggattgtaataattcccacatgtcaagtggaaaaaggtgggaataattgaatcatggaggctgttttctccatgctgttctcctgttattctcacaagatctgatggttgtataaggggcctccctcttcccttggcacttctctcttgcagccatgtgaagaagcacgtgtttgctaccccttccatcatgattgtaaatttcttgtggctttctcagccacgcagaactgtaagacaattaaaccttttttctttataatttacccagcctcaggtatgtccttatagcagcatgaaaacggacaaatgtaagcaacttaattatatacaaaaactcttttatacctgcctactgtgaaaggaaaataagtcttgagaccgcaaaatcaccaagctaaatggaagagtcaaactggtgttacaggagatagaaagaaattattttggtagatagttaggatgacagaatttctgccgaaaacatttcttctaacaaaaatcagcttggcaattacttattttctattcacacagagttcaaagaaatcacttctaacaaaaagcagcctgaaagatcaggctgtaaaacatataagcaactctgccacagagagggtgtttctgggtgtaatcaccaaacttcacatacatacactgggccctagtaaaaacagtgggccttaatgagcacattcctttccttttctgggggcactataacatcagaaagctggaaacttgcacaagtttaggatgcctgcacttgcaaggaggtacctgggacctagcatggaaaatcctcttcccctttttagcactctgggagtggagccccagccttgggattcccaggtgtttcccttcagtgatcaggactgaacacacacaactcatcatgcagtttgtgctgagctgggttttccttgttggtattttaaaaggtgattcatggagaactacagatgttgagtgtgagtggacatgagtgagcaaaacagtgggtttgtgtggcagtttctgaccttggtgtctctgtgtttgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatacacagaggggaagtcattgtgcgcccagacacaaacctccctgcaggaacgctggggggaaatcagcggcagggggcgctcaggagccactgatcagagtcagtcccggaggcaggtgcagatggaggctgatttcctgtcaggatgtgggacttcatcttcttccaacagtttctctaatgaacctccctaattttagaattctgtggttcctaatgtcatctctacatattttcaaaagatcattttaatatgaggacataacctctcatgtaccaaatgcacattgatgcttacaaagatgaaaagttctcaaccattgtcaccaggatcgcagtcctgaggaagctcacgggtgtctgatgagtctcctccattcaggcccaggacagaaacctcagggagactcctggactagaacggcagggattctgatcacagccaatagagagcctgggccagggtcagtgtcctgtagaagctcacagggttcacatctgacccttctcctgaccctaaagccaatccgcatcagcactgatctggtgctccttttgctcccaatacatgttctttctttggagtgtttgttctcccttttttatttgcttttctttcttcctgaaaaagaaacacatggtctctatgctctacactccagggctcaaggcattttcttagaactcaggcaaggctcaggcttggctactccagcccacgtgggagaggctgatgggatttccttctctccccatattctcagggccctcctctgtgttgtgtgtagactcatctgggaatgcaattggccgttaatagtgaaggggataaactcatttgatcaaaatgggatgtggatgtggaattaaccctgttctatgcacactgtcagagtcatcttcttcagaagtagtgttagaaagagcttgtgaactttatcagaatcaaaatggatccacttgtgttaaaaccctaatgaatgaagctggggaaggccatgaaggagggttctaacacacatattcctgataagaagaactatcataaatagaccctgcacagccacaaccttttacacagaggccaccacagccttaaaagctttatttctccaagtaaatctgccccgcaactgcctattcaaccttacaccgctatctcaaaatagctgctgtcaccctcctcatttttccttaattctcttttttattattttttaaattatactttaagttctagggtacatgtgcacaaagtgcaggtttgttacatatgtatacatgtgccatgttggtttgctgcccccattaactcatcatttacattaggtatttctcctaatgctgtccatcccccttcccccaaccccactacaggccccggtgtgtgatgtttcccaccctgtgtccacatgttctccttaattctttatcttccttttcctacctgaatgtacccatacatattttaattgaaacgcacatcctagaaaaaatattattatactttagagtctctgtctgttattcaggttgacatgacaagctacagacggacatgccacttttctgtgagacatagaggatgacagtttttggagatgtctaggaatatccaatgtccataagatcagccatcaataagtgcagactggaggtcccagagagaggcgaagctgctgaatcatcgtggaatttcattttctccagttctgctctgatggaatcaggcccacccattttatcaatgacaatctacctaacctagagtcagctgatgacagtattaatatcatctattaagtaaagtcataactatatatatagtgagagagggagagagagagagacggagtctcgctctgtcacccagggtggagtgcaatgtcgtgatcttggctcactgcaacctctgtctccggagttcgagcagttctcctgtctcagcctcctcccagtatctgggaatacaggcacacaccaccatgtccggccaatttttgtatttttagtagagatggtgtttcaccacattggtcaggctggtctcaaactactgacctcaggtgacccacctgccttagcctcccaaagtgctgggattacaggggcaggccaccaagtccagctaatttttgtatttttagtagagaccaggtttcacgatattggtcaggctggtctcaaactcctgatctcagcctcccaaagtgctgggattaaagatgtgagctactgtgcccggccaacaccacctatattaatgttggattgaataactacaaagtctaccctaaccaagtgtaccatcaaacttaccattacccagaggaaagaatctttaacatgagatctatattcttaaatgttttaaggtgtaaaactgaccacagtacaatcacccaattatgattttgctaatgagttgtagaaactgcatgtatattttggatattaacactttttcagatgcacaccttataattatattctctcattctgtaggttgcaattttttccacactttgcggcatctttttgttgtgatgtagttctgcttgttcaattctgcttttattatctgtgactttaatttgaaatatagaaaatcatccttttttatatactttaaattttagagtacatgtgcacaacatgcaggtttgttacatatgtatacatgtgccatgttggtgtgctgcacccagtaacttgtcatttaacactaggtatatctcctaatgctatccctctcccctccccccaacccacaacaggccccggtgtgtgatgttccacttactgtgtccatgtgttctcattgttcaattcccacctatgagtgagaacatgcggtgtttggttttttgtccttgtgatagacttctgagaatgatgatttccagcttcatccatgtccctacaaagggcatgatctcatcattttttatggctgcatagtattccatggtgtatatgtgccacattttcctaatccagtctatcattgttggacatttgggttggttccaagtctttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgccttccacaatagttgaactagtttacagtcccaccaacagtgtaaaactgttcctatttctccacatcctctccagcacctgttgtttcctgactttttaatgattgccattctaactggtgtgagatggtatctcattgttgttttgatttgcatttctctgatgaccagtgatgatgagcattttttcacgtgtcttttggctgcataaatgtcttcttttgagaagtgcctgttcatatccttcgcccactttttgatggggttgtttgcttttttcttgtaaatttgtttgagttcattgtagattctggacattagccctttgtcagatgagtagattgcaaaaattttgtcctattctgtaggttgcctgttcactctgatggtagtttcttttgctgtgcagaagctctttggttcaacatactcaaatcaataaacaaaatccagcatataaacagaaccaatgacaaaaatcatatgattatctcaatagatgcagaaaaggcctttgacaaaattcaacaaccttcatgctaaaaactctcaaaaaattaggtattgatgggacgtatcttaaaataataagagctatctatgacaaacccacagccaatatcatactgaatggacaaaaactggaagcattccctttgaaaactggcacaagaaagggttgccctctctcaccactcctattcaacatagtgttggaagttctggccagggcaatgagacagtagaaggaaataaagggtattcaattaggaaaagaagaagtcatattgtccctgtttgcagatgacatgattttatatctagaaaaccccattgtctcagcccaaaatctccttaagctgataggcaacttcagcatagtctcaggatacaaaatcaatgtgcaaaaatcacaagcattcttacacaccaatcacagacaaacagccaaatcatgagtgaactcccattcacaagtgcttcaaagagaataaaatacctaggaatccaacttacaagggatgtgaaggacctcttcaaggagaactacaaaccactgctcaatgaaataaaagaggataaaaacaaatggaagaatattccatgctcatgggtaggaagaatcaatatcgtgaaaatggccatactgcccaaggtaatttatagattcaatgccatccccatcaagctaccaatgactttcttcacagaattggaaaaacctactttaaagttcatatggaatcaaaaagagcccgtattgccaagtcaatcctaagccaaaagaacaaagctggaggcatcacgctacctgatttcaaactataccacaacgctacagtaaccaaaacagcatggtaccggtaccaaaacagagatatagaccaatgaaacagaacagagccctcagaaataatgccgcctatctacaaccatatgatctttgacaaacctgacaaaaacaataaatggggaaaggattccctatttaataaatggtgctgggaaaactggctagccatatgtagaaagctgaaactggatcccttccttacaccttatacaaaaattaattcaagatggattaaagacttacgtgttagacctaaaaccataaaaaccctagaagaaaacctaggcaataccattcaggacataggcatgggcaaggacttcatgtctaaaacacgaaaatcaagggcaacaaaagcccaaattgacaaatgcgatctaatatgaaattcttaatgagttctatagttataagtacattatttctccttattaaaactaatcttttttgctgaatgggtggaagatggtggcttccctccaaaagaaaacatagttggttctgtaaagagttcacccatttcttccactataggcctgccctggcataatacaagctcccaacttaagaacttatgattttccatccatgggagaagccatcttttccatctattataaaaacagaagacacttcattaatatcactcccaaaataggctatgtcatatccagtgaggtaggatggctgacagtggtgagaatccaagtaattggtcaagcactgctatgtgtgaagaaacaccacagcatactctacactgtcactcatgatatggaattgttgcctcctcagcaatgtaactgagcccttaatatgtggctgggatgacaaagcaatgccagcctgcagagtggaacctgttcttccttctgggattagccaaaggccggtggcactcatggctgaccctactttccttacaactggacgaagcgaagcaactggatatgaacttctatcccaggatgtaactgtccaaagtgccttctctttatgtcaactggaaaagtgtgaaagacagacactattctcataaacggatatcctagttattccacccactagccagctcttccccccaggtggcagtcatagatttagaattgcaagtagaggccctggctaagcataccaccagtccctttaacaacacctaccataccatcatcattcttactgaagaaacctcacagatttgacaagtgacactatgaagctatatgaccctaggtattgcaactacagccaaaggtaacacttgtgtattaatgaaccctgaatgttgcatatatatacaagattagtcccacaatataactcaagctatgcaagcattagatacccatatttctgctagagatggatgccctctctcaggaccctgcgacagcatggtttagttgacttcctaacacatggaagactttcatatatagtagagctggtatactcttcattgctatcttcagttgctgtggattttattggtaccttgcactttaagtgagaatgtaatactgaccttctcaaaaactcctaggtccttgcaccataatgctccaacaaacacctactgtaattccggagactccagaatatttccaactccagtttaatggattcccttccaatatatacaagctatgccctttctaagaagtagccagattgactatgacacacgttttccatagaaacaaaatggaatttgacagtggggaatgatatacaggcagcttaatttcaaaatgcattttaaacttattttttgaggttttaatattattttcatactccttgaaacctgaaatttcacacttacattctaattgagacttaataacaaataaccagaacacatgaattgcctgtaatctctataccttgtattgtaagccacatttcaagtgtaaccttacttgtcagcacagtatgtttaccataggcataattgcttgtcctgactgtccagaaggcagggtggtattaagtatgcggcctctggagctgggaagtctggctttgtatactgtctctgccactgctaactgaaggacaatgggccagttacttcctgtaccccagttttgtcatatgtaaagtagggttgttgtaagaatgaaattagttaatatttagtacctaacaactagtaggcattacgtggtagctattcgtattgctatcgtcagagaacacacaggagtccattgttatttttaccctccccctccaaacaaaatgtgtaagacactagacatggtagctctgtaacggggttcgtcatgtattaaactgtgtacccaaatgatatgtcaaagtcctgacaaccagcacttcagaacacgtccttatttggaaatatggtagctggagatgttattagtgaagatgaggtcttacttgagcagggcaggccctcaatgtgggaagatgggtgtctttctaagtacaaggaaatttggacacagagacagagacatacagtgtgccatatgacagcagaggcaaagatcagagtggtgcagcagtaaaccaatgcatgtccaggattaccagtcacctccacaagtgaggaaagggcaaggaagaagtctcctgagtctcagagggagtgcagcccagctcacacttgattttggacttctagtctctagaactgtgagacaatacagtcctgtcatttttaagccacccagtttgtagtatttcattttggcagccctacgatattcatacagagttcttcacccaaaaggaagcactctttctcacaaacagtcaaagtcctggatgacggacaacctggagattgcaaacctccaaggaatcaaaggaggttctataaagtctaggagccccatctttcaaaggctgctcctcaagtccacacacacactttggaaggagaatcctgctcttggacatgggatccttagtgagccaactgccaataatccaacatcatcatgaattaaagatctctgacatttcctcgtcaccaacgggaattctgtcaagtagtaagtaaaacccttcttcaggaatctccacaccaaacagttctgcatggcttgggacgcctcaggaaacttataatcatggcagaagaaaaaggggaagcaaggcagtcatacatggtggcagaagagagaggttaaacttttcagtctctcttgggtgtaaagatacaatcttgaggcaaacagcagaatcaattttcttatgccttgaaattctccctttcaccataaatattcccttcacattaatctaactttatgtttgcatcgaactatgtgcctttttggaagttccggaagctaatttgagacagatagacaaagtcgggagaccctgatgcagaattccagaggtgacttcaatgttgctagttaacaacccaggcattgcccagatgatgccagcccaagatccaggtggactgggatgccagagagctgccagaacaagacgcacagacctggttctcagcccaaatcttgcatgcctttcttaccaactttcccttttttaaacccctgcctttccttcaaaattgaagtggttgcttgggatgggaatgcgttcacttcccctttaccattatggttaatacaataatttttgtaccagatctctctcttgttaattggatcctgcaggtggcagattccggaccagagtgacgttagaaactgaatgcacatactgggtggttcacagacacagtgttctgtgaagtttatgggtggattcctggggaagcctgcaagcctgttagtgattagcagaaccgcatccagctactgggatctgcacgccaggtgccgtgagcccctcaccatgttccctggtcccagctgcccgcggatggttcagccttgacaacgggctcggtgttctgggtggtgggagagcaagggggccccttgggcagcgtgctacagggctgtgaatccaggggcccacccggtgttccctgtggagtcactgagggaatgaggggcttctcagggcacagagctgtaacgcctttgtgcagtggtggctgaatacagtgacactgggcgcgtggtgagaagcggggcaaggtcagttcactggaccctccgccctgagcctcagatgagtcgggggtccccagacaggcccggcctctgccctgcggcggacactggagcctttgctgtggccgccaccgaggagccttgacctcaaaggagggggaacctctctacccacctcggaaacctgaagggagcggcggtctctcccagacaggatctcgccggcctccgcgtctccaggcccaaccctgtaccacataaaggaagtccgcgctgagctaccgggacacagcgccgttgggtgggcgggcgcggcgcggcgggaagcaccggggcagctgccacagagatgcgcggggactgtcgggaagtgggcggtccgggaggcgcggggctgatgggacgtgggcggtccggggacgcgcgggggatggcgggacgtcggcgatcccgagatgccagggggcagctgggacgtgggcggtctggagaggcgcgggggcagctgagatgcaggtggtccgggacgcgcgggggctggcgggttgtgggaggtccagggatgcgagggggcagctgggacgtgggagttccggggacgcgtggggtcgccaggaagcggggtctaggacttagatccgccttctcttcaggccatgcagccccgaagctccgaatcctgggatgactcctgtccatgttggaagggaccctgccagtcctggcaaggttcaacggccttagggcaagaaatgttagtagagtcctggaagacgatgtggggaacgggtagcggccaccggatggtgatcgttcttctacaagaccttgacatggatggggagaaacagagaagaaccttccaagtttgtcccactggacatgcccaccacactttaccagccctttctagaaggcctgtgcgtaacacatgaaaaagctgctctcgacctttccctgaccttttaaaagaaaacatttgctgcatctaatccgcctagatgtaaggaggttcccaaatgtatgacagagtcagacaattacatgtcttgtaagttaccatgtgcttgtcttttgttttccgttttttttcgtttttttgttttttgtttttgagacggagtctcactctgtcgcccaggctggagtgcagtggcaggatcttggctcactgcaacctctgcttcctgagtttcaacaattgtgctgcctcagcctcccgagtagcttggattacaagtgtgcaccaccacgcctggctaatttttgtagtttttagtagagatggggttttgccacgttggccaggctggtcttgaactcctgacctcaggtgagccacccaccttggcctctcaaagtgctgggattacaggtgtgagccaccgtgcctggccgtaagttaccgtgtgctttttaaacaaatcatagcaaaggggtgtcttctggaaatgacattttgaaatggagttactagaccacccctggaagggacacagtaaccacacgtccacgttcgttcagtgggtgagaggacatggaggggagacctgggcaggaagggaagagggttccatgccaggctgctcatatttaaaagacattttcattgtagggacatggatgaaattggaaaccatcattctcagtaaactatcgcaagaacaaaaaaccaaacaccgcatattctcactcataggtgggaattgaacaatgagatgacatggacacaggaaggggaatatcacactctggggactgtggtggggtggggggaggggggagggatagcattgggagatatacctaatgctagacgatgcgttagtgggtgcagcacaccagcatggcacatgtatacatatgtaactaacctgcacaatgtgcacatgtaccctaaaacttaaagtataattaaaaaaaaaaaagaaaaataaaagacattttcatatcgttgtcattgttttcttgtgtgcattttattcctcgctattgtatacatcattggaaattctaagtattcttttgaaatatctagtctttctagatgttctgaagtgcctgatgtatgttaaaattacaggtggtaaaataataaattttgtaaatgtctttttgttaaaattcatatgcagtgttttattttattttgatgttggtggggggtggggaggatggccaaatccctgcttgatcaacacacattgcgtttgtgctctggttcaggggaggagagaggaggagaaagtgcagacttccaggcctctgtgcgcaccgggaggagagattaatgatcatctcttctgtctgtgtgtttgttttatttatctatggatatcctgtgtataaaggatgaacaagtcctatttataacatctaatcttttcaggtgttaagttgccagcgtatgacggaagtagcattattaaacgaatgcagcttgtacatattgtgttaaaattcataaaaagccagtcttctgaaaagaacccttgggccctccctccgcagcctccggcgccagctgcaggaagacctggccaggggaaggcgggcggcagaagctgctgctggctgtggggaaggcggtggagcccaggcctccacaggctccccacaggctccccacaggctcgcgcggctctggttgctgggctccgcacgggccgcgtgggggcgcctgctgggagcgaggaggcgccatcctggctcgcctgctccaggaggacgctctgggcctgcgcagatgcagttctccaggatgggcgcgggcgctgggggcggcgctccttgggctgctgcgcctccactgagccgcctgggtgtgaggacctcgcgccggcgcctccgggaaggacgcggagccgccgcggccgatcccagggctgcagctgctgcccgacgcccgcgggaaggcccttccgccaccgcccgggggttcgaacttggagcagctgctgccagctgaggcgccagcggcgtcgggagctcctcagagtcagtgttttgtgctggattcggcatgtcctctgaaaactcgggaatttgtcactgaaatggtgacaggaggtgagaagtttttttagacgttgccttcgctggcctggcgcggggctcaggcctggaatcccagcactttgggaggctgaggcgggcggatcgcttgagctccggaggtggagaagctgccttcgtggtaactgtggtcttaagttcagctgagaacgataaatggcttttccttgaattggctgcttttgtgatttctctcaggctcatcttttgtcagttaaaaatccagtggtaggtgtagcttagagacgggaaatttttggttttgttttggctacacgtaagtgttggaaattattttcttttacgttccagtgtgagcaaatccagaaggatgtcagattaaacaccgaatttaacaaattcagccgggcacggtggctcacgcctgtaatcccagcactttgagaggccgaggcgggtggatgatgaggtcaggagtttgagaacagcctgaccaacatagtgaaactccgtctctactaaaaatacaaaaattagccgggcgtggttgtgcgcgcctgtaatcccagctactcaggaggctgaggcaggagaatcgccgagattgcgccactgcactcagcctgggcgacagagcgagacttcgtctcaaaaaaacaaaaaaaaatcaatcattggaatactgttgttcattacaattaatgaacgtttgatagacgcataaacgaactaaattcacaagtacatataagtaaaataagccaaaaaaaaaaaactacatcccgtatgatgacacttttatacattctacagaatagaaactaaagtgatatgaaggttgggagttgaatggagaaaaggtgagcgaaaagagggaggacggaggagttgcaagagaacaagagaaaatgttgagggtaattgatctgttttctatcttaataatggttatggttacatcaataatttctaaattgtacattttgtgtgttaattataattttatattattcaagctattacaaataaatacctgtataaatttcttagggacggtttaagggagatggataaatcacataaaaagtcagatatttctgaatgtacaatgaataacccttagctctatctttattttttggtaattctaaaatgcagcagatttttttaatgtttttattacaagaagggtttcttcaaaccacaccaggtgtgtgtaactctgggctaaagttggttaagggagcagtgggatccggtggagaggagcacaggcctcgatcctggagcccattcttgtcacatgtgagctcctggacacatctcatagctccctcatgcttctgcgtttacattctcatctgtaaatggaggaccaatgggcatctgcctctaacaatgtattttcatgtgttaagatgatgtatgttaagtgtttactatagcacaatcttttaataagaaattacatttttttccaaatactatcattgtcttcaagccccaccacccaccagaaaacttaatatgctctgtgccctgccctgtcctcagacatccagcccaagagacttttatatagtaggagatatgcaaatagttccctccctctgctgatgatgaaaaccagcccagccgtgaccgtgcagctctgggagacgagctcaagtgccaggattcccaagtgttttcacttggtgatcagaacttaacacagaggaatcaccatgttgtttgggctgagctgggctttcctttttactattttaagaggtgatacatgaagaactacagatattgttcgtgagtggatattagagaaacagtggatatgtgtggcagtttctgaccaggatgtctctgtgtttgcaggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggctgtgtgagagacatggtgaggggaaatcagtatgagcccagccagaaacctccctgcaggaaccctggggtggggggaaatcagctgcagggggcactcaggacccactgatcagaatcaaccccagaaggaggtgcacatggagattaggggctggattccttccaggatgtgggacttcaacttcttctgacagtttccccagggaaccgctctaagtttagaattctgtgtcatctctatgtatttaaaaaagatcattttaatgtgaggaactaactattctcacatgcacaaaatgcagattcacactcacagagatgaaaagtcctcaactgtggtcactaggatcagagtcctgaggaatctcaggcgttcctggtgagtcttctccaatcagacccaggacagacacctcagtgagattccatgactagaacaggctttatggattttaaaaaaaatagactgagccagggtcagtgtcatgtagaacctcacaggtttcacatctgacccttctcctgacactaaagtgtgcaaatcagcatcaatactgatctggtgctgcttttgctcccaatctgtgttctttcttgagttgtccctttttcatttgcttttcctgctccctgaaaaaagaaagatgttgtctctgtggtctaaattccagggctcaagcccttttcttggagctcaggtgggtctcaggttgtggctcctgcagccacgctggggaggctgatgggactttcttctctcccattgctcagggccctccactatattgtgtggagactcatctcagaatagatgtggccagtgggagctgaaggggacaagcttgtttggtcaaaatgagatacaaatatggaattcaccctgtgctgtacaaactgtcacagagtcactttctgaaacaatagtgttagaaagaacttgagaaagttgtcagaatcaaaattgggtcacttgtgttaaaactctgctgaatgaagctgggaaaggccgtgacggaatgttctcatgctcatatccctgataccaagaactatcgtaaatagactcttaaaaccacaatcttgcacaaaggtgcccacaaccttaaaagaattacttctctgagtaatcttcccagcagctctctgtgtaagattggactgatgccacccttgttattgattcttctatcccggagaagttgtctcaaaacagcttatgtaaccctcctcatttttctttaaacctttatctttctttacctgcctgagtgaacccatgcatgttcccattgcaatgtccatcttcaaataattatcattttactttagagtctctttttgtctgttattcagatttgacaagctgcagatggacacatcacgtttctgtaagacttaggggatgacagttttgaggcatggctggggaagtacaatgtccataagattgaccctcaataagtgcaggctgtaagtctcagagctgaagctgctgaatcaccatagaatttcatctttagttctgctctgatggaatcaggcccacctgtgtaatgaatgacactctacctaacctagagtcaactgatgacaggttaaatatctagacagcaaatttgcaacaccacttagattagtgtttgaataactacaaagtatagccgagccaagtatatcgtaaagcagactattatacatggagaatctttaacatgacatctacaattcttaattttttttacgtataaaactgatggttttacaatcaggctgtcatgattttgctaatgagttgtagaagttacatgtatgttttaaatattaacagttttttcagatgcctggtttgcaactatattctcccattctgtagatttggaattttttccatgctttgcaaaatctttatattttgatgtagttccagtccttcaattctgcttttgttgtctgtgcttttaatcttaaatttaggaaatcattgctaaccttttggtgggagagaattttacaattgcaggctatacatttaactgtttaacccatctagagttgattttttgtgtttattctaacctaatattcttaactatttgcaagtgaaaacccagtttgtttaacaccctctttaggggagagtatgatttagccgttgtgtagaaaatgttataaatcactttgccttcatattggttctcaacttgaaaatgagtttgccatcaatacgtgggtttatttctgagctctctatatgtatttatgccagtaccatcctgttttgattatgtttgtaattaattttgaagtctgagagtaaaatgcctccaagtttattcttgcccttttgcagatattagacaaaatattttaacatttcaccatgaagtatgataacagctatggcttttcataatgaattttattgtgtttaggttattttcttgtatttctattttgggtagagtttttatggtgaaaccttgaatttttttaatgttattttctgtctgagaagttaatgggaccttcttcgtatttaatttggcataccaaatgtattgatttgaggattttgaatcatctgtgcatctcaaaaataaatttgagttggtcatggtgtatgatccttctaaagtcctgtggaacttagttgactattatttggtgtgtggagggggctcatttatgtctactaggaatattggtctgtagtttacttttttgtgaccttgtctattactgaaaatacggtaatttgggccttatagaaagactggaaggttggcatctcaccaatttttgaaaaagttagagaatggttggcattacttctttaaatgttgagagtcctttttttacttaacatgtgacctatcatggagaatatttagtctttgcttcggaagcatacatattacactgctcttggttggaaggttctgtagatgtctattaggtcaatttgttcaatagtgttgttcaagtccactgtcttcttaagaattctcttaatgatgttctatccatcattgaaagtgaggtgctaaagtcttctcctaatttttattattttctatttatctctccatatctcttaaggtttgcttaatgcagttatatttatttttgtacaaatatgtaaaaaataaatgaaataataattgctaagtaattttaatggcaaaatcacataataagaaattatattttcccaaatgctgtcattgacactaagctcctccaggaatctcacatctgctctggacacggctctcctggtgtcctaccccagagcttgctatagaggaggagacatgcaaatagggccctcactgtcctgatgaaaaccagccttgcctgcgtctacgggagaagagccccagtccagaagtaccaggggtttccatttggtggtcaggtctctgaacacagaggactcactatggagtttgggctgagctgggttttccttgttgctaatgtaaaaggtgactcatggagaactagagatattgagtgtgagtggacacaagtgagagaaacagtggatatgtgtggcaggttctgaccagggtgtctgtgtgtgtttgcaggtgtccagtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactgtggtggcattgtgtgcatcccttgtttaggtacatgcagagatgctgctttggtgtgttcaggggctcctgttttggggacaccaattttggagtttgcagtatccttgagtccagtacgttcatggtggcattgggtctggggtgtgcagtggcaatgagtccaggatacatgcagctgatgccgtatcttgtgaggacaagaacaactacaaaacgatcctattaataaataggcaaatgacttgaatacacatttttcaaaaaatacatacaaatgacatatagatatataaaatgttaaatatgagtaataatttttaaaattcaaatgtaatctacaataaattatcaccccatacctgttagaatagctatttttaaagaagatgaaagataaccagtattggggcagaagtggagtaaagggagcctatatatattgttactgaaaatgtcaattagtacagacattatggagaatactatggaggttcctcaaaaaataaaaatagaactaccatagtttccaacaagcccactactggctatgtatccacaggaagtgcaatcagtatgtcaaagagacatctgtgcccccacgttcattgcaggaatatttatgatagtaatgatgtgggaacatcctaaattaccataaatggatgaattactaaagaaaatgtagtatgtacccaatggagtaatgttcatcctaaaataagaagggaatcctgcatttgcaacagcaggcatgactctagaggaccatatgtgaagttccacaggcaggcgcagaagacgagtaattcgcgatttcactgtagtttgtttaaatggtagactcacagaagtagagtggagtgttggttaccaggggctggaggggtggactggaaaaggcgagattttggtcaaagggtgaaatgttccagttagacagaaggagaaagttacagtgttctaatgcacaagatggaaaatatggctaataatgcattatatatttcaaaatggctaaaaatgcaaatgttaaaaattttctcactaagaaatgatacagcctgggcgcggtggctcacacctgtaatcccggcactttgggaggctgaggcgggcgaatcacaaggtttggagttcaagaccagcctggccagatggcaaaaccccgtctccactaaaaacacaaaaaatagccaggtgtggtggcacgcggttgtaatgccagctactcgggaggctgatgcaggagaattgcttgaacccgggagacagaggttgcagtgagctgagatcatgccactgcactccagcctgggtgacagtgagactccaactcaaaaaaaaaaaaaaagaatgaaatgatagctgtgtgaggtgatggatatgtcaaatagcttgattaacaattccataatatatacatgtatcatagcatgtgtgaggtgacctgtatgaaggtgaagtgacctgggggctgtgtaagattacctgggggtatgtgtgaggtgaacacggcacatatgaggtgaccagagacacatgtgaggggacatgggagatatgtcgggtaagccagggggatttgtgaggtgacacagagcaagtgtgaggtgacgtggatgcatgtaaggtgatttggggcacatgtgaggtgacgtgggggatatgtgtgagctgacctcgggtgagtgtgaggtgatccaggatggatgtgaggtgacctgggggtgtgtgtgaggtgacttgggcacatgtcaggtgacatcggggattggtggtgatgtgggtgtgtgtgaggtgacctaaggaggtatgaggtcacctggggcatctgtggggacctggaaatgtgtgaggtgggtacaggtgaagtcacctagggcacatgtgaggtgacctgtggaatgtgtatggtgacctgggaccgtttgaggtgacatggggaatgcgtgaggtgacctggggcatgtgtgaggtgacaaagggcatgtgtgcagtgacctgggtgcatgtgaggtgacctggtgcatgtgttaggttacctgggggatgtgtgaggtgaacaggggcaggtgtgaagtgcctgaggaatgtgtgaggtgaactggtgcatgtatgtggtgacctgggggatttacgaggtgacctgcgggatgtgtgaggtgaccttgggtgagcgtgaggtgacctgacgtatgtatgaggtgaccagggtgtgtctgaggtgatgtggggtatatgtgcggtgacctggtggatgtgtgaggtgacctgcaggatgtgtaaggtgacactggggatgtgtgaggtgactcagggcacatgtgaggtgaaattggggatgcgtgaggtgattcagggcatatgtgaggtgaccttggggatgtgtgaggtcaccttgggtgagtgtgtggtcatctgggatatttcccaacttcgtaaggaaagcctgcaacaacacatggcattagaagcttcacactctagcaccattaatgcgtacatcctcaaggaactctaaatgttttgaggttagcttaaatgccatggagcggcaccttccccaggcacactcatatatgcatcctgggtctccctgccaagctatatctcctcaaatttacagtttatgtttgctctgtgacatcaactctgatatgttcaagtgtgtttttttttctttatttgtagttgttcaggcttgttgtttcactctcattactctgggctcagtcctctcctcaggtgtcccacttcagagctcgctgtgaaataggagacatgcaaatagggccccccctttcctgataaaaagcagcccagtcctgaccctgcagccctgggagagaagcaccagccctgggattctcaggtgtttccactttgtcatcagcaacaaacaaattaccatggaatttgggctgagctgggtttttcttgctgctattttaaaaggtgattcatgaagaactaaggatattgagtgagtggacatgagtgagagaaacagtggatttgtgtggcagtttctgaccagggtgtctctgtgtttgcaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaacactgtgagaggtcggaagtgtgagcccagacacaaacctcctgcaggaacgttgggggaaatcagctgcagggggcgctcaggacccactcatcagagtcaaccccagagcaggtgcacatggaggctggggtttgtttcctgtcaggatttgggacttcctctgcttctgacagtttctctagggaaactctttaattttagatttctgtgcccaccaatgtcatctctacatttttttaatcattgtatatgaggactcgttctcacatgcacaatatgtatattgccacctatgggaatgaaaggtcctcaaccatggtcaccagcatcagagtcgtgaggaagctcaggggtgcctggtgagtcttctccagtcagactcaggacagtaacctcaaggggattcccttgtgagaactcacacattttcatgagaacagcaccaggagtcagttctaaaccattcatgaaagacccactccatgacccagtcacctcccaccaggtcaccccttcacaactggggattataatacaacatgagatttggggcaggacacaaatccaaaccatatcagatacacattgtgaaatacgcatggtggtcaggtaatttgtatttctatcacctcacagcgctaccattttattattttttttaatttactgcatgagtgagtgtctgatgagaacacctaagatctaccctttcagcaacaatcatttttacaatacagtattaactataggaccattgctgtacgttagatctccagaactcatccaacctgcacaactgaaactctgtacaatttaacacacatcacccaatttccctcacctcccaggtcctgggacccactattctactctctgctttcaagagcttgaatattttagatcccacatgtaaatgagatcatgcagcatttgtctttctgcatctggcttattcaactcagcatcatgtcctccaggcccatccgtgttgttgcaaatgtcagaatttccctcttttcaaagccaaacaaaatacagatgtatgtatacacattttctttatacattcatccatttacagtcattaaattattttacaaatctacactattattaataatcttgcaatgaacatgtctttggcaaagtaattttatttcctttgcatatataacaagaagtgggatcaccagattatatgatagctttatttttaacttatcaagtaaccaatcctaccacaggatatttccctttcccccacattcttgccaacatttgtcatctgttacatttctgataatagccatattaactagtgtgagttgatattgcattgtgcttctcatttgaattcctctgataattaggaatgttgagaactttttcgttttctgtttgccatgcatgtatcttctgaaaaaaattatccaggtttttgcccttttttatcagttcatttgttatttgctgttgaggtgtatgggttatttatacatttggacagaacttcttgtcagatccataattgcacatagtttttcctgtgctttgttattaaattcaaagaaatcagttccgaattaatggcaggaattttttttgctccatgtcatttatgagtttatggcttcaggtattatgtccatttttagttgattttttttttttttgggagacggagtcttgctctgtagcccaggctggagtgcagtggcgcgatctcggctcactgcaagctccgcctcccgagttcacgccattctcctgcctcagcctccgagtagctgggactacaggcgctggccaccgcgcctagctaatttttttttgtatttttagtagagacggggtttcactgtggtctccatctcctgacctcgtgatccgcccgcctcggcctcccaaagtgctgggattacaggcgtgagccaccgcgcgcggcctattagttgatttttttatatggagttagagaaggcctaattttatttcttttgcatatgaatgccagttttacaccattattgaaaagactgtcctttctctactgtgtgctcttggcacacaaaatcaggagagacataatgacaaaaaaaatatgagatcaatagtcctgatgaacatagacctgaaagtcctcaacaaaataccatcaaattgaatccagaagcactttaaaatgtgatacatcatggtcaggtgggctttacccctgggatgcaaggctcgttcaatatccacagtaactctgattcacaatgtaaacagaataaaagcaaaaagcatatgattatgtcaatagatgctgagaaagcttccgataggatctaacatctactcatgataaaaaccctcaacagactagacatcaaagaaacatacttcagaataagagccatctacaacaaacccacagttaacatcatactaaatgagccaattaaaacacttatctttataaatgacccagtctcgggtgtttctttacagtgcgagaatggactaagacagcatccaaataggaaaggaagtcaatccgtccatcttcactgatgatataattctatatctagaaaatcctaaaaactctgccaaaataattctagaataaacaactttagtaaagtgtcaggatacaaaatcaatggacaaaaattaccagcatttctataagccaaccacatccgagctgagagtataatcaagaacacaatcctattcgacttacagtatccacaaagaaaatgaaatgcccgggaatacagataacaaagtgaaagatccctacaaggagaactatgaaacacagcatacataaatcataaatgatacaaataaatgggaaaacatttcatgctcatggattggaagaatcaatattgtaaacattgtcataatgcccaaaggaattcagattcaatgctatttacataaaactatcatcatcattcttcacagaatcagaaaaaaatctattctaaaatttatatggaaccaaaaaagaccctgaatatccaaagcaatcctaaggaaaaagaataatgccagaggcatcatgatactgaccttaaactacaccataacgtcttgctaacaaaaacagcctgtactggtacgaaagcagacctgcaggaaaaaaaatagatcaaaatagaagacagaaataaagttgcacacctgcaaccctttgatctttgacaaagctgacaaaaacaagcaatggaaaaaaaaaactctgtgttcagtaaatggttctgggataactggattctggcaggtatgcaaaatgcaagagtgaaggagcctgtgcagcttctacctagatttcagatgtgtagagagccctgcatgcccaggaagaagcctgctgcaggagtggatccaccacagaaagcctctactagagcagtgccaaagatggggaaagatggagttggagcccccattcagagtccccactagggcacttcatagtaaagttgtgggaatgtggccacaaccctcaagaccccagaatggtagagctacgggcagcttgcaccctcagcctagaaaagcttccagcacttgactctcacttgtgaaggcagccccgtggtctgtgcctagcaaacctatagggattggctgcctgaggttttggggacccaatccttgttccagtgtgccctggttgaagtacataaagtcaagagagattattttgtagcgttaggatttaatatctgcagtgctgggttttatatgtgtgtggggcctgttggttgttcctttggccaatttatccctttgggattggaattatttacccaatgcctgcatcatcattgcaccttggaagtaaacaacttttattttttaaatttgcaagctcacagctggagggacattgccttaagactcagatgagactttgaaaatttgagttggacgttgatgaagttaagattttgggcactattgaaaaaaggtgattatattttgcaatgtaagaagaatatgagaactttgggtccgagagtgcaatgatataatttaggggttttcccctccaaatatcatggtgaaatgtgacccacaatgttggaggtggggccaactgggtggtttgggtcatggggaaagatttttcaggactggcttggcatccaccccatggtaattagtgaattcttgctgtattagctactgtgagatctgattgttcaaaagagtcttgcaatcctgctaccctctcatgtaacccctcctcacaatatgacacagccttctccccctttgccttccaccatgactgtaagcttcctgaggccctcacaagaagcagatgctggtgccatgcttctcacacaacctgcagatctgtaagccaaataagcctcttgtctttgtaaatcacttggcctcaggtattaatttatagcagtgtaaaatagactaatacactgcccaaagcaatatacagagtccatgcaatttctatcaagtaactaattaattatgtatttttaaaaatcctaaaatttatatagaaccgaaaaacactctgaatagcaaaagcagtcctaaccaaaacgaacaaagctggaagtaccacattccctgacttcaaattacacagcacaaagataataagaaaggcagcatggtagtggtagaaaaaaaatcaagagcccagatatatagccaaatatctacaaccaacagttctttgacaaaactgacaaaaatatacactggagaaacaaccctctattcaataagtagtgctgggagaattagatagccttatgtagaagaataaaatgagacttctgtatcatcatagacacaaattaactgtgaatatggattcaatgtttataaactcataaaaatacttgaaaaaatctaaaaataatcctctggacattggcctaagcaaataaaatatgactaagacttcaaaagcaaatgcaatgaaaacaaaattagacaaacaggattaattgaaccaaagatcatctacacatcaaaagaaagaaccaatatggtgaacagacaacctgtgaatggtaaaaaaaaaaaatgtgcagtctattcatcaaatatatagaatctacaagtaactcaaataagtcaactagaaataacaacttcataaaagagtgagcaaaaacgagatatttctcaaaagaagacatacaagtgttcaacagaaataaaacatgctcagcatcacaaatcatctgataaatgtaaattacagacaacatgatatagcatcttccaccagtcagaatggctattaaaaataaaacagatgtttgcagagaagcataggaaaaataatgctttttatatgcttgatgagaatacaaattggtacaacctctatgaaaaacaatacagaaatttctcaaagaactaaaattagaattaccatttgacccagtaacccctcctggtgggtatgtttctcccaaaaggaaacttctatataagaaaaagtcacctgcattcctatttttattgcaacactattttcaatagaaaagtcaagtaatctctctaagtgtcaatcagtggatgattaaataaaatatgatagatgtaaatcatggaatactatgcagccataaaaaatgaaattgtgtctttcacagcaacatgaatagagttgaaggacatttcctaaataaaataactcaaattctcttttataattggaaagcaaacaatgggtacacatgtacatagagaaaaacaatagacactgggtactgcaaaagaaggcaaggtgagaggaaagtgagggttaaaaaatcagctattggctccaatgttcactatggggtaacagttacatcagaagcacaaacctcacctttatgaaatatattcatgttacaactctgcacatgtgcaccctgattctatgaaaataaaaacagaaaacatgaacagaattgttagactgctagctagattgaccaacaaacaagaaaaatgcaaaagtagcaattctttgttttgtaaccctttctcattttctggtaccataagaaattgtagactatcgtcctatattcttttctgaagtgctaccattagccatttctcaaagaaattctggttccttttttcttttattttctttcattttttttagacagagtctgcaacgtccacctcccaagttcaagcgattctcctgtctcagcctcccaagtagctgggattacagacgtgcaacaccacacctggctaatttttgtatttttagtagagatgaggttttgctatattggccaggctggtcttgaactcctgacctcaaatgatctgcccacctcagtctcctaaagtgttggaattatgggtgtgagccactgcacccagccgctggttccttttacagaagaatagtattaaaaactcatatcttgattcttgatgtactttttgttaatttcttgtagaacatctcaagtaatcaatacaggaagtatttgttgtgtattaacccatatatatatatacccacatctaaacggtttttatttatgttcctatattatgctaaacttgcaaatccactgagataccctaagttaataccacatgaatgattttcaccttccttctatgcctttccctaacctagcactccaaccgtggggaaccccctcccaccacacaccatccattccctttgtagtccatttccaggattcctgtagagtggaacccgattgtgtaagttgtgctcttttgtggaacatcatcaagtggagtccagtgctgacgtgcagtttcttttttctttaatcttatggactacactatttctgaacctacttagtacctcttttgatttcatacattagtataatggcataagatattttctatatagtctgcattccatcctggaattcctaatcacctatttttttaaaatttcttgtggattaagattgtattagtcagtgtcccctagagggacagaacaagtaagatacacatacacacacacacacacacggagtttattaaggagtattaactcacactatcacaaggtccacaataagccatttgcaagctgaggagcaaacaagccagtccaagtcccaaagctgaagaacttggaatccgatgtttgagatgaggaagcatccagcaggggagaaagatgtaggctggaaggcgaagccagtctaatcttttcatgttcttctgtttactttttattctggccacacttgcagctgattagattgtgccacccagattaagggtgtatctgcctttttcagcccactggctcaaaggttaatctccttcggcgacaccgacacagacacacccgggatcaatactctgcatccttcagtgagatcaagttggcactcagtatttagcattacaagtccaccctttgtcaacttgaacccatacacatctcctgagattatacataatcttcaaataaagacaagaataaagtcataattatgcctaataatacaattattcttcttacaactggaaacacaccaatccccaatccaaatggtactacatatgctccactccctcaaggacacagccaggatcatctgatgacttggtgtctagatggcttcagcacttttaattttacctccaatgttagactccactttatcaatgcagatgtagcagaatattttaagacattgatatgctgaaaaattcaacagttcataaaagttgccttcccaccacagccagtggttactactgaataaggacctgccatcctctagggagaagctataatggatggggtgcactgttggtggttatggaaatcgatccatcgtggcaaatggcagcatctttctttgataacattatattctattgtgcatatataccacattgtctttattcatttgtctatctactgacagattttttccatatgtttgctgttattaatagtgtttcaataaacataggatgcagatatcttcacaaggtggtaatttcatctcctttggatatactcccagaaacaggattcctggtcatacaatatttctggctttaattcatttaggagcctttatactgctttccataattgtgaaaatgtagaatggtatagccattatgaaaaacagtttcagttttgaggtatgatctgtaaacaaataatgtttgttatggctctcaatgagagtttctactaaatatgatggaaggtcaggaaggtctctcaccttaaagcagggatggattatgcctcttatttcctaaaagcaaaagattggaagcatgcatgatggaggtggttggcaggtttcaggatgatctcataagaggagaatctgttggataaaactgttgggttttcagtcatagacacacctacactcaatatgaaatgatgaaatcaagtgaggatctagaatgtgttcgcttgaagcaacagcatattctcaaaggcacctattgctccatcacaagggtgatgaacttttgaaaccagtaaagtgtgagagcacagtaagtgataaagttatcacatttacatgaagtttgtttaatgtgccaagggctcgcacagattaatcataaataaacacaatgtattttagcatacatagatgtctagagaagaatcttcttagagaaacttcttcaggttacagaaatctgtgtaagttgtagatctaatggagaagtgtctatgaatactggtctgtttttgaagtatggaaagatgatctcttttggagtaggcttgcgattgtgttgatttcttaattgtttcttgagttgtaacaaaagaaccaaaaaaatgactaaccggagtttcatggctgtgttgataaaaatttttcataagctttctgtcaattatttgagaccagatttcctgatttttttctccaatagatacatgttcacaagatctcaggaaaccacctctcaggtgctttagtttaaaagactagcttcctagaaaaagaagattctgtctaaccatgacaagttggtttcatctgcaaaccatcaagtttgagacctcattgtcaagaatcataaaaattttaactccaatgtactgaaaatcataaatctcgaatttaatgttgataggcattgacaaaatggttcattcttggatgcgtcctatgttgctggctcaacatatcagttaattgagaatcctcacttagctccctctgtttgtagcactgagttgattgtcaatcttcagagtcatccgttgaaggagagtcctgaggttcatgggattcttgtagacactcaggggaacaaaagaaagaaacagaattgagggctgccagccatttccacatcactaggaataattaccatctaagtataaaggtctgcatcattcagaacaccctgcatgacaggctgatgcaaaaaatccaaccctacagaggctccacagcaacctttacagttctttccgggaagaaataatctccaagttaagtgagtcagtaaagctgctctgagctacagtaaaaattggattgggcccgatttgtctgagttcagtgtaattattatactcagctgctgccccaatatagactgaggatggataatttaaatgagcctggctatgtggtttgttatatatctgaactaaataaacataaagggcctgtctggactagcgtgagggtgagagatcctgggagccccagccccccatactcttatctcccttcctccaggaacctctaggttctcagggtgagaatccacaagatccattcatggctctattaccaggagaccaaaatctctgaccttgttcatacagacaaacaggcgaaggacatttttagatccttatctatgtggcgaaaggcaatctatccccattacaagccttaccagcaaccttcctttgtcatgaaaatgggtaaaattagccaataggattacatttaagaaaattttcctgtgatgttccagccagaaaacagcaaaaatcagcttcacacctggagacttcttgcatcggtcacagcccagagaaagaagatcaccatagcattaaaatgcaactgtaagaacatgtaatgcttccatgttccacgcattacgtctcaccagtttagtcaatatggattaaatatgagagtgtggcaattcgcaaactctatctgaggaggaaaatcggataaaaaatgttatgaaaaataaagcaatttgaagcctctgacttcagcaacttcaccactaatgaaatgatgtaaccctcattggcctcaaatttagttttcacggggcatctgcagggttccaaagtgagaccaggtgaattcaatgtgcatgcacttcccaagtgtccacttgtattctgtttctttacttctgtttacagaaagtagacacatattcagtcttagtaccagtgtagggagcgctttccatgagatggataccagaaaaaaatggcaaacatgggatccgttaatataaaaattagccacgatgtatatatatatatgtgtgtgtgtgtgtgtgtgtgtgtgtacacacgcgcgcgcatgtgtgagttgaatagcagagttggagtgggtttctatccacatgtacctgcacctgcaggtattctcaggtgccataatcaactgtaggaccctaaaggaaataagagtctcccctcaacccctgaagagtgtttgggttcaccgtgtgtccaatgattctgtgcctcttgagctccaggaaagggctccctggtgatgcatgagatcttttcttggagtctctctgcagagttcactgggtttcctaaaggcaattcactatttcaaaagatggtgtgaggagcatgtggtgtccctaaaggagaattctgagccagggcacaaccactttatactgagctggatacactggtaggaatatactctgtcagctcagatagaaacctccctgcatggttggggctgggctgcagggggcgctccggatacacccagcacaggctcccgccccagagcaggtgcacaggaggctggggagaggttcctcccagggcctgggacttcctttaaaaatatctaaaataagtatttcacaaagactgctgaagtttgtataaatatctattcaattgtgagcatttatcaaactggatgttgtaatgagaaccacttttacaatggggatttcaaactctgctggaggtcaggaagagatcctttcttataaataaatgcaatttttggataaacacagtcattccctaaataacgcattcacatattatggtctagaaatgatgcaagttgaccctgagacagtcaaatgtggtttcaaagtgaggtgctgtccttgaggagcttgttctccagtgggggaagctctgtcaacacagagttcagggatgtgtaggggacacatggcctctaacaggattacggcttgaaccctcagcttctacagttgtgtcacccatgtgtctgtttctcatactgggtcaggaattgggctattaaatagcatccttcatgaatatgcaattaactgaggtgactatagtatctccgttccctgagagcctcacccaacaaccacacccctcctctggagaagcccctagatcacagctcctcaccatggactggacctgaaggatcctcttcttgatggcagcagcaacaggtaaggggctccccagtctcagggctgaggaagaaaccaggccagtcatgtgagacttcacccactcttgtgtccactccacaggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgcgaagtacacagtgtggaaacccacatcccgagagtttcagaaagcctgaggaaggaggcagctgtgctgagctgaggcagtggtacagcagttttctgaacttccatagtatctcattttgcattgagttccgctttaatattagccaagaatatgggatagacgggtgctcctaagagatccttaacttgcccattttgatgggttttcccaaagacgtgagaagccacttttttcgcaaagcatcccaaagccatgccctgctccagaaacacgtgtatccatttcctggtctttgattaactgacaaactctcatcagcgcacctgggctaatttcacatcaggtagaaatatgtgctttaaagcaaggctaacgttgtaatagcaattcctgcttaataaccttcagcattgttgttgtgtgctccatcaactaattacgttagttcaaggttctcaatgggagtttctaataaatataagggatgtatagaagttcccctaattaaaacaattgtgaagacaacctcagtgttcaaccatatttcaacccttcaccacaaaggaactttcatctctcctggaagttgggttcattttcaaattagtttttttattttaatatctcaagattattgtatgtgactattttagcagaaagtgaattatgggaacttgaactaaccaactgaaaatacattcagaactaattaaacaagatgccagaatgtgattggctccaggcattttaaattcaacaggttatgtaaccaggctttaaatttgcacatcttcgtgttaccttcatgacacagtcaactcccattatgtaagaaatggtgagtgcattcccaagggtcttgcacagttataaaaatagacttgatgaggtgaggagttgtttaaattcccctctgaagaagcagcatcaacccaacaaaccactctcttccctctgtgactagagctctgtcacaggccacatggacctaaatccttgatggagattacaggactacgtaaattggactgatcgtttttatgctgttaaattaataggtgagtctgcactccagcctgggcaacagaataatcttgtctgtaaaatacaaaagaaagataaattaatagatactgactttgacatttcggataataatattttcataaaccgaatttaattatacccacattgttacctacaccttcactgaaaagttcctagttatgttgagttccatcaacactccacatgttcaaatctggacatccaagagagtctagagaataaaacgcaatgagggcagtgaaacttgcgtatattcagcacctcttaactcaggaggactcaatacaccctggaacactctgcttttctgaatggctcacaatgactccagctcactctccaacctcctcaaacatctggcctctgtttgccctaagttcacgctctgctcttagtctatgttctgaagtctttgtagaggtgaaaatgagctgtcagatggatcttccttctcactgcaacatggaatttgctatttcacttaatgaccactctttccacaatggttgatttcttttggcctgttcattactggtgattttcaagggaatctcagttgaatctttactgttttgcattttgtctccatgacaatgttgggaagtttttcttctagcagcataacatgatctagtgacctgacacatttgcagcaaacaatacctacaaattcagaagctctttggttttctttccacgaaatataattcttgctcttctgtgtatgagcacatcctagcatccctgtacacacccacgtagatgtctacacgccgatgaaatattccctgtaaataaaaaaagtatctcagtttctctcaatgttcataattctcctgagggtgaggaaggtacttctgggtctgctcaaacaaatggcccagagaccacctggtaggtaggtaaggagctcacctcgctctggatattgagtctgtctctttccctctgtcgtctcatagaaggccagcccacttgttcagctcctaagaagagagcccaggtttatccagattatacaacacaaccagcttctgatgactctcctgttacaacatccatggagatattttgtgtattatataattcaccaaactaatgtgaaatgcccaagttgcaatactgcacaccctagggtatgttcttgcaattcagcggaggagaaattctttcagagacagatggatctgaattggtaaatatgtgggtacgaattctgggcttgagtgtcattgtccagccatgtttcacaggtgtgacctgtcagggaagaaccagagttccttgttctctcagagggtagagctcacagaggtcctctctggttcccaggaaaggtaatttcactaatcttggtgatgagactatcctccagtgctgatgtactatagagttttcatctgaagctgtcactgctatccccaatgtacatcttttcacacagaaatgtttagaggtcaggccatattctcagggttacacattgagaaggatggagatatattctactaccttctcctgagatctcacacacaatctcaaatttcaaaaggtctcagaagggcagctctcaggtactatttaaaaataacccacttcctgggacaggtagcatccttctaaccatgatggatgttctgaactacagtacacattgcatggatccaggtttgtctcaattcactgtgattattacactcagcagctgtttcaatatgtctgaaggggtaaatgacaatttaggtgacctgggtgtatggttggtgttatatgaatctttaaatgtagaacagtattaactgtattccaaaatctgtctttgatccatgatcacacttgtctcccagaccagctccttcagcacatttcctacctggaagaagaggactctgggtttggtgaggggaggccacaggaagagaactgagttctcagagggcacagccagcatacacctcccagggtgagcccaaaagactggggcctccctcatccctttttacctatccatacaaaggcaccacccacatgcaaatcctcacttaggcacccacaggaaatgactacacatttccttaaattcagggtccagctcacatgggaagtgctttctgagagtcatggacctcctgcacaagaacatgaaacacctgtggttcttcctcctcctggtggcagctcccagatgtgagtgtctcaggaatgcggatatgaagatatgagatgctgcctctgatcccagggctcactgtgggtttctctgttcacaggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcacagtgaggggaggtgagtgtgagcccagacaaaaacctccctgcaggtaggcagagggggcgggcgcaggtactgctcaagaccagcaggtggcgcgcggcgcccacagatcccgaggccgggtccggagcaggtgcaaggagggcggggcttcctcaacagctcagtggtctgtctcctcgccagcacctcagatgtccccaggactctctttctttattatctgtggttctgcttcctcacatccttgtggcagggaagaaaggaggaagacaatttttctgtttactgttgaggtttcaccaattactagaaactttcctacaagttcctgcatgactcattttgccatatatggattctcaccatctcttgatttgtttcatcaatcgaattgtgccctatttgaaattaacttactgaaaccttaaatccaatggatctatactggaattttaatgatgtaattgaggttaaatgtggtcaaagtgtgagaccctaatgcaataaaccgttgtctttataagaagaggaagagacaccagagacctctcacttttcacgtgcacacagagaagaggccatgtggagacgtagtgcactagaaggtggccctgtgcaagccaggaagaagccatactaagaaccaattttgccagctccttgatcttcgacattcagactgtagaattgtaagaaaatcaatatttgttgtttaagccacccaatcctgttgtcttcttacgaagacccaaactgactaataccacctaactctgttagctctgtctcctggagggagaagcagccccctgaggctgggcactgcatctctcagatttccacgtgaagtaggcaaaaatagtagttctcatataaaaatgtgtcatggctctgttggccatttttgagcatggtctctgaaaccagccctggtgtgtgtgtgtaacaaatgtcccttatcttttatttggacataacaaatagacgataggtaccagctggatggagattggccactgatcatcttctgttctccttagtatgtcacagaaaaccacaccaacatcaccagcatcactgtttttcttctaccacctcaaacggactacagaaatgatccctgcagtatggtctatttcttcggctttcgaaatttgcactgaatctcttcctaaatggggagctacatggggtctgagttttgttcctttcttcccagtcttccccaagtaccaaggacagaatagacttaaaatttggccatcaatgcccccaaacaccacatcactttctaaaatccacatcctgcatccatccttctctggacacccctcatcaggctacccaggaatggccagaatctggtatcagcttatgggctgaggccacgagttatacacatgtgtgatttcagtcacacacactctacttcaggaccacacctgtgttctgaggagctcaggcacctgctgatctcagtaattctctaataaatcacacacctcttattaataaaggtccagatggccccatcagctgcagagcagtggagtaaagctcatgggtgggtccatcaggcagaagtcagacaatggaagggatggctggtcacttccattttcactgatgttcgcaatgaattttaatggaataaaacaatattaactacaaagagacagaaaagaagactggctcgtcaagatatttaaggacaaggaactttatttggggggaaagtgaaagacacttctaaatggaaatccctaaagcacatacagcagctgacagagtggccactgtgcacatgagggctgaggagatggatggtagagtccattcctgcaacatgtctctgggtgtgtgatggttagactcctcatgcatatgaatataagagctggactcatggagaaaaaaagggccatatcccataggaaaggaagaaaaaaaaacagatgggcacccctggagagagctcattagatttggtgtgtttaagatgaaaatttcttccaaaaattgtaatgttctaagctaaatatgaatctcttcaataaactgagaataggagaatggagctaggacttgagagaggaaacaaatcttgagagagcagaaagcaaatccacaaaaactgtcacatgacagaggtcagaatggagctgatgtagctacttcactattctgcagacttattgaccatgtggagaaggggcttgaacaaatggagacgttctccaaccttctgaatcagcctccttcttatgcatgagtagaaatcatagttctgggggtgaccttcccaattttcctgtccatacctcttcccccaggggtagagtgtcttcccaaccacaatggtttctcaccagtgttctcagcttctcctccattgtacttaccctgcagattaagaatttcttctagatggagttctttgggaattttctgttttctttagtttctgttgactccaccacacccccataggatacaggttttattggatttcccctggaaatagtgggggtggatccaggcgttcaacagtcctcgctgttcttcccttcctgtcagcaccacaggacagcagataagggagttgactgtggatttttcaaattcctgggaaaagcctgcaaggactagtagattcacactctaataccattagcacatgtatccaaaaagaaacctcactaaatatttccaggttagcctgttcctctctcagtgccatccagtggcacctgccctgggttcacgaacatgtgggccccagtcctctctgctggcatctctctcctcacatttcagtcttctcgttagctctgtgaaagcagctcagatatgttaaaaggttttcttcttcatttattcagtttttcaggtttactgttaaggaggtcagaataagatcatagtttcctcatttttcacatttgcacgctgagtagccactttctatataaaagccagaaactaagggaacaaatcaaatatccatatccactacaggtgaacgttaaaaaatttgacatatgattatggactaaagtacaatgcagaattagaatcaaggcatcctcattctcataaaagcatgtctacattctcaaataactctgctgagtgaaagtagctgaagaattaagagtgcacttcataaacttctaattgtataaactgcagaaggtacaactattctaaagtaacagagcagatttgaaatttgggagaaatgggtgttgaaagtaattgggtggtgagatgaaattacagagaagtgacagaaagatttaggggttaacttaattgtacacaacctgattaaagtttgcacacatacgttaccattttccaaatggtgcagtgtagatttgaattaattattaattgtacttaaagcagtaacaaagaaacaaatgaatatgttggttgaggaggagcaaaaaatagatgggtatgaacactcaaaacatctcagactcttgaaagtacacatgcttgaacactggttttctctgtatactttaggtaaagagcagaatacattaaaagaaaacagagatgtcctggcgggggtggaatcctgcaaacctcactaggcgtgtcccacactgccctggagttgtctcaggggagcagtctcctctagtggtcagagacacaggcatggataatggggctaatactgtccagctgtgtgaccttgaacacattgtataaacactgttccatatgtaatttatcttccttaaaatgtaacattgacacttgcattaaatgtattctacaaatatgtcaaaaagaagatgacgactgctaaatgattatcaaggcacaatcatataatataatgatattttcctgagtgataagatgactaccaatctcccccagggcactttgtttgctctgagccctgcgcctcctcaggattcccatcccagagcttgctatacagtaggagacatgcaaataggtttctccctctgctgatgaaaaccagcccagtcctgaccccacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgtatgtgaggcaccaggtaagaggacatcagtgtgaacacagacacagtttcctgcaatgacaagggaggaggctgggctaaaaggggcactcaggacccactgaaaacgggcagctctagggcaggtacagatggttatcatgggctgctttccttcagggtctgtggcctcctctgcatctaccagttcccctcggagcctctggacatttatgtttctgtggccacccctgacatctctggattagaaaagtttattataggaagaggaaacattctcatttgtcccaaagcagatgtaagtaatggaagcaaaaaatgcacaggaggccaggcggggctgtagatactgtcaccccagaatgtcaatctcaccactagtactggagagggaagggagtttgatggaccttccctaacaaccctgtggtccaagataagtccaggaagaccattggtgcctcccagagcacagttgtccatcagggatgtccaatgcgtcccagcagcagccatgcctcagtgtctccactgtgcacagccactgtctgggaggagctcccaggatgggtgtctttggcacacaccaggtggcgggtgttagagtgcagtgcagcagctggctgcctgttctattgggctccctgatgctggagagatgggaggtgcattcgcagggccagcaccctgtttgtgaatttttatataaaaaccctgattttacttcatttttgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctggcacaatcagagcctgcagagacccccaggtgcagcttcagtgaagtcagacatttctccatgtgggcgacctccagtgcctgtgactgctgctcaggcctaattgttggttaagtattacgacaccctttaggtgatcacatctcaagcctattctgaaaatcaccatgaacagagatagttcaatggccattctcctgacataagtttctctttattacttggttccaagtatggagaaaaatgtgaccctatatttgtctgaatccaacatcagcatccacggcattacgctaggagactcactaattgagcacaagtgagctcgttattctcatagaaatgtaagtatttggaaatttcagcgtgttctccagaacctgtggctgccaacaactgtatttctcggtgcactcttggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaaagggtgcttggtacagcagggggctcaggattattgtggggattcagaaagagcaggttcaaggctcaacctcagggcatgtgcagctggtgtgaaaaggggctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctatgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtgggagtttcaaaccctatcaacccccctataaactgtcattaagaaagtttatcaaactccaccagtcatgtgatattagttcgttttcacagtggtataaagaactacctgagacgaggagtttacaaagaaaagaggtttagttgactcacagttctgcatggctggggaggccacaggaaacttataatcatggtggaaggtgaaggcgaagcacggcacatcacacagggcagcaggagagagagggggaagtgacacatagttttaaactatcagctcttgtgagaactcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcgcaggaaaatctaaaatggcttgaaagaagaggaaaggagactggctcagggtttttataatggtttagtggtggtggcacagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagcgacaacttattctaggtagcaagaataaaaataatgaaaaagaaataagggttcagtatgggtggacaagacccagatctacagaaatgagatgactttagaaatataaggaaataataatgagaaaaagaaggaggggatggggaattagggtcctggcctaatgtcttgggtagaagcttctcacaatcaaggactatcagcttattctgcaggtcttgggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgagctccggactcacgtaatcttcctgtattagcctcctgaatatctagaattagaggggaacgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattcttcagttgtaaaacatgaagccaataattaactgcctgactgttttgtgcagtgagttagttaaaagtttctgataagattccttccaatatgattcaagagcagtattttctgctgatgttcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagtttacattttattaaaattgataatttttatgtagcgatgccattttttaaacattcccagaaggttgtgagtgggattgactctgtcttctgtgaacaatgacagtgccctccatggttagataatattttaaactagattgagctagagtggtttctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacctagcactttgggaggccgaggtgggtggacccctcgaggttgggagtttgagaccagcctggtcagtatggtgaaacctcatctctactaaaaatacaaaaattcgccgggcatggtggtgtacactcgtaatcccagctacttgagaggctgaggtgagaggattgcttgaaccctggaggcgggggttgcagtgagccgagattgtgccactgcacttcagcctgggcgacacagcgagactccgtctcaaacaaaacgacacaaaaaattccaaagttgtgcaccctctaaaagcatatgtacttaattctcatttttaatttattaaacatctctaataagttcaatgtttcctgccttctgagttgatttcctaacacatagaagaatatatcctaaatgaaagtttgtgttcttaatacaaattactagttaataacctttacttttattattgaggtattatacatcaatgttaatcaatcctctcaatgggactcttacctaaagaatatataaaatattttcctgatcatgacatataatagatgtgaacacattcttagcattcagccatgtctcttgtctattaatattataaaccacatgctaactttgattttattggtaattgttctaatttcttttttttcccacttctctggttgttttttttttaactttaagttttagggtacatgtgcacaatgtgcaggttagttacatatgtatacatgtgccatgttggtgtgctgcacccattaactcgtcatttaacattaggtatatctcctaaagctatccctcccccctccccccaccccacaacaggccccagtgtgtgatgttccccttcctgtgtccatgtgttctcattgttcaattcccacctaggagtgagaacatgtgttgtttggttttttgtccttgcgatagtttgctgagaatgatggtttccagcttcatccatgtccctacaaaggacatgaactcatcattttttatggctgcataggattccatgatgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagggataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcggcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatttccaagccagcctgttccgatcttaaatgccatccagtggcatctgccccaggtacactaatacatgggtcctgcttctctctgcagcctcctctctcctcagatttcaggttttgtttattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaattaagagtaaattttacatgatacatttgtagaaattttagaagatgccactattataaattaacatggagaagatttaaatgtttctgagaatatgctattgggagtaatggggatgtgagttaaatttcagaggaataagagaaagatttagggattaattttttcaaaccttgattgaagtgctgagtaaatggttgcaaacataggtctacatttttcaaatcattcaccataaatttgaattatttattaattacactcgaataaagcaataaagaaactgatgagataatatttgactgaattgcatcaataaatagatcgatattaacacaaggaatataactgatttccaaaaacatacacatgaaccatggttcactctgcgtatttagataaattacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagacacagtgaggggaggtcattgtgcgcccagacacaaacctccctgcaggaacgctggggggaaatcagctgcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgattcttctccaatcagacccaggacagggacctccgtgagattccctgactggaacagtctttatggatcctggtcacagacaatagagaggctgaaccagggtcagcgtcatgtagaacgtcacagatttcacgtctgatccttctcctgacacgaaagtatgcaaatcagtatcagcaccgatctggtgcttcttttgttcctaatccatttactttcttttttcgtcgtttttctcctttttccatttgtttttcctgctttttgcaaaaggaagatgttttccctgtgagatgcaggggatgacaattttgggagatggctggaacatccaatatcctcagggccgaccatcagtaagtgcaggctagaagtctcagaaagagctgaagctgcttaatcaccgtggagttttaccttctccagttctgctctgatggaatcagggccaagcaggttatcaatgataatctacctaacatagagtcaactgattccagtttcaataacgtctgttaaaaattcacaccaccacctggattactgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccattttgacatgaaaactttttcagatatatggcatattatccaattctgtaagttgtagttattttgttgctttgcagaatctttttcataatctattcccacttgttcaattctgcttttttttgtaggtgatttgaatgtaaaatcctgaaaaagattgctaattttttgagtgttgagagttttacaattagaggtattacagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagcttgtcatcaatatgtgggtttatatctaagctctatataggtatttaagccaaaactttctatgtttttaataaatgttgaggcctggaagtgaaatgcctaaagctttcttcttgccttgttacagatattgtaccaaaatattctaaccttttactattgagtgtaataatagctgtggcctttcttaacggcttttattatgttcaagttgttttcttgtcttcctactttgttcatagttttaataatgaaactgatttttttcaaagtctttttctgtgtctgatgaaatgttactgagatattttttctttagttttttaatgtgtaccaaactgattgatttgagaatgttgaatcaagtatgcatctcaggaagaaatttgagttggtcatggtgtatgtcttctaaaacactttggagcttagtttactattgttggggattaattcatgtctactaatgatattggtctgtagtttcctttattgtggtgcctttgtctattactggtaatactatcatggtagtctcatagaaagagtttagaaggtgtatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttacctttcctatttatttttaagtttgtttttagacatatgcaatacattttgaggtgaaacctggtggaattttttccaataaattagtaaaaataaatcatttaattgactattttattcaggttgatttgtttaatatttgctaaaggccagttctttaagctatgacacataataaatcccaaatggcagtacctcattgtttacttagcttttgtacttatatttttcagaggaagaaccactactgtaaattgtaaatagccaatacataattgtattgtatgcaaatctgtgactgtttacagtgtcatctctgagaaacataaagtttatttactatatatatataaagagtttggaaggtggactccaccaatttttgaaagagttacagaagggctgctattacttctttaaatgttaaggttcattttatgatgtaacagataacctatcatggagaatgttcaatgtgttcttgagaaggatgtgtattacgtgactcttggttggaaggttctgtaaatatcattcagataaatttgttcaatagtgttgttcaagttcagaggcacattgagaattttctttctggatttgctaaacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaagtcctcctggagtctgacgtctgctctgggcactgccttcttctcaggcgtcccacactggagcttgctatagaggaggaggcatgaaaacagggccctccctctcctggtgaaatcaagcccagacctgaccctgcagctctgggagaacagccacagccctgggattcccaggggtttccatttggtaatcaggactgaacacagagaactcactatggggtgtgaattaagctgaatttttcttgttggtattttaaaaggtgactcctagggaactagagtgagtgagagtgagtggatatgagtgagagaaacagtggatatgtttgccagtttctgaccaggatgtgtgtgtattttcaggtgttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacataaggtcccaagtgaggaaatatcggtgtgagtccagacacaacatttcctgcaaaaagaagaaaggagtctgggccgaaggggacactcagcactcacaaaacaggtgcagccccaaggcaggtgcagatggagggagggtaagggctgctttccttcagggtctgtggtttcctctgcttctaatatttcccctctgaacctctgtatatttatgttttgtgcccaccatgaggtccctggattagaaaactaatttaaaagaggaaatattctcatatgtcccaaaaacagatgtaagttttggaggcataaaaatgcataggagccgcgtgagtctgtagacactgccaccccacaatgccagacccaaaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcagtatctccactgtgcacagccatcgtctgggaggagctcccaggatgggtgtctttggcacacacaggtgatgggtgttagagtgcagtgcagcagctggctgcctggtctattgggctcctggatattggagggattggaggtgcattctcaaggccagcacgctgtttgttaatttttgtataaaaaccatgtgatttaattcattttctcagatgacatagataattaataacacaatctgcaaacaattgtaattttcaactttaccccaagttcattgtttcttaattctgtgcaggatccagacatggtattgcccttctcatgagaaattgttcgacctaaactgaaaccagttgtttctcatatactttggttctccccacatgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtgggctcagaattaggacagtcttcaggttatcacagatcaatcatattctaaaaatcatcattatcacacaccgtggtaataattcaatgttcatttttctaaacagcagtttctcttttttatttggttgcaagtttgaggaaaggagcatgtgataatactttttaatctaacctcaaaatctactgaattgttctaggagactcacaaattggacaagagtgagctccttgtgctcataaaaaatgcatgtatttgggaatttcaccgtgttgtccagaaactgttaacatcaacaactgtgttttccagtgcacttctggcttgagacatcctcacagaccctctccctcacctgcactgtctctggattccccatcataaccagtgtgtcctgctagaattgtatctgcttgcccctagaagatggacaggagtggatcaggttcatgggttgtaaagggagcaaaaattacatcccacttctcaagagtccatatccagatccaagaaacagttcttacagctgagctctgtgcccagtgaacacacaactacacattttgaagcaaaagacgcaatgaagggccttcattgtgagcctagacacaaacctccctgcaggggtgaataggagcagcagggggcattcggggcagtatgggggcttagcatgattgttgggggtcaagatgagcaggatcaaggctcatcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatgtatacccaaatggaggtgcatccagttgtcctctccatcttatgtggaccttgtccatcaagggctaagttcctgtatttacttgattacctcatacattatggtcaaaacaggtagggtctcattttggcatggtctctcctcctcccttctctctgtcgcacaaaaacacatgaactgacacacacagagcttcccaacttcaattatctgatgtattgaagcaaattgattagtgtgcagcttttctgctttgcctgctattcatgttatgtaaaaataagaaccgtgtgtttctcagcttgttacttctctaagctaagtagcatctttgtttattatacccagagaccaaaagcgattcagctgttattcagcagcttaactggtaaacaaattgtggaaaattcatttactggaataatacccactgttacaatgaagtactgctggatacactcagtaccatgcttaaaataacaagtacctgaataagtaaaataagtcaaacaaataaaagtgcatacatatgattccacttctataatttctataaagtaaaaatgaacttaaagttacataaaaagatctgtagttgactggggacatggtacaagaagagaaggtatagaaaggagaaacgacaggagagcaaaaggaaatttctaggataattttttctctgttagtaaaagtgaggattatgtcactatttgtaaaattgtccactttatgtaaaggttcttatttgctaatttcacctcattaaaatattgcaaattttaaaatatctaatttggtagaaaaggtagtagagagagatgaataaaatacataaaattcagagagtcctgaatacacacatgaatggaccctgggtctcactgtacttttagggagacactagaatacaaaaacataatgacaggatttcagtacatgaaaggagcttctcagaccccaggaggcctgtccaactgcgtctgggagttaactcagggagcaggcatgtcctttggaaggagcaatgacaccaagctcccagcatccattgtagccgacaccatgccaatgccaagagatctcgactaaaattttctgtggatgttgagtgtgattatgccacacactcacaccaagtgagtatggaaaggatagttacctgcatccttaaggtgtctgctgagagcagggcaggtctctcattaaggtccaaagtggcttgatagagcagggaaggagactggctctgggttgttatcatggcttggtggggagcggggcagagcatcctacttgcaggaagggttttgtggggtttcaaggtcaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcacagtttaacttcctctatttgagtagctttacaattgtgtagagttcttaattaattaattttttttttggagacggagtctcactctgttgtgcaggttggactgcagtggtgtgatcataacatagctcacggtgatttcaaattcctggctcatagaatcctcccacctcaacctcctgactagcaagtagctaggtttccagggcccttcatctacacttggccggttcttttcattctttttttttttttttaggtggagtttccctcttcttgcccagactggagtgcaatggtgccatctcagctcactgcaatctccccctcccaggttcaggtgattctcctacctcagcctccagagtagctgggatcacaggcatgtgacaccatgccccgctaatcttgtatttttatcagagatgacatttctccatattggtcaggctggtctcaaactccctacctcaggtgatctttccacctcagcctcccaaagtgctgggattacaggcgtgaggcaccgcaactggcctcttcatttttattcatatgttccttcagcagccactatgtcttcccactgatttcttcagtttctgccttttccttttgaataaggcattattcctaagggaagtcgggaggtgggcctggacagggacttggtgcattcctctctcccgtcccagttcttattggtttctccagtggctgtagaacagcagttttgatggctttacctctgcagataatttctcttgcaatgtagtgctgatggggaggtgtgtctggatgcacttcacctatagttgctgttttgctttcccagacagcaccatcccaaggggtagagggtggagcattttgtgatgtatccccagtactgaagaaaaaggcttcaatagcaggaggaattcctcaactgtatacactctgagaatttaaacaataacttctctatcatactcaaattgaaaccatccaatgaatatgtctactttaatcgtgtgctaacttaaatggcatttggcagcctctgtgccagaaaagattatcatctgctcctgtttatttccctgcaagtccttatctctcttcagatttcagatatattgtttgtcctataacatcaaaaatttgatgtatatgtgctaatttgcagatcagtaagtttagtagctgttgtaagaataataacatatttttatggggtgcttacatctccaagctgagaagcacctctatgtgtaatactaagaaactagaaatgatacaaatatcaagaagatacatagataaaaagtaatggcatgctaatttactgtaataacatccatcatgagaatcaatacattgttgatgctcaacatgtttgcatcataagtagttatgtgcgagaagccacacaaatagaacacatactatataattcctgtataattcttgaaactcaaaactaaagcattaaatatgaaggactgactcagaatatggtggggaagaaaatatttgggaaggaggaattgtagaggaacacaaggaaacttttaagtgtaatttgtttgttcattatttggatggcttttggggatgcaaaggtgagcacgagtggaataacattttgttttgtttgtttgtttgtttttctgaagagatgtggtccttctctgtgacccaggctggagtgtagtggtgggatcatagttcaatgtagcctctaacttctggtctccaacaatactcctgcatctgccatctaagtagctggaactaccgttgtgtgccaggaggtttggcttggcttgagtacttattaaaccacacactttttgcaatatttaatgtatagtaataatgtctcaataagactattacaaatcaatgaatgaataatttgttcagtacagattcatggaaaaatagacactaacatgatgagtgtctgacatttatgaaaatacagctgcatgaaatgtgcttctctttacattcattaggtaaacacaatagtgcatacacatcacaccgtgctttcattacaggaagaaagttctgaaaatgtcactggggtgaaccacacggtgctgggcttggttcagggagcagtcaggcccagtgttgtgaccttcaaccacagaatccttaaaaaaaaaaaaaaaaaaaaaaagaggctgcctcaaagtccgcatcagttcccggactcgctatgtttctggatcgtatcagtgcatccggatctccctggtggctttagtgattccttgcttgccatgctgaggtctcgctgtagattatgttgggttttctaagaccgttttgctattgtaagatccactccctgggacagagcgattccctctaaacctgatagaggttctgaactaaaaataacattaagtgaatcctggtgtgtctgaactcaagtgattgttacattaagctgctgttccaatctgtttcctcacctgggaaaagaggagccaggacatagtgagttgaggccccaggaagataactgaattctcagagggcacagccagcatcctcctcccagggagagtctaaaagactggggcctccctcatcccttttcacctgtccatacagaggcaccacccacatgcaaatctcacttaggcacccacagaaaaccaccacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgatcccagggctcactgtgtgtctctctgttcacaggggtcctgtcccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagacacaatgaggggaggtgagtgtgagcccagacacaaacctccctgcagggaggcggagggggcgggcgcaggtgctgctcaggaccagcagggggcgcgcggggcccacagagcatgaggccgggtcaggagcaggtgcagggagggcggggcttcctcatcagctcagtgctctccctcctcgccagcacctcagctgtccccaggcctcctctttctttattatctgtggttctgcttcctcacatccttgtggtaggaaaggaaggaggaaggcaaattttcctcttacagtcaaagtgtcactaattactaggaactttcctacaagttcctgaatgtcccatttttccttcttaattaaaaaaaatatatattctaatacttctcaccatctcttgatttgtgtcatcagttgaattgtgctgtctttgaaattcaaatgctgaaaccttaaatccaattgatctatattggaattttaaggatggaattaaggttaaatgtgatcataagtctgagattctaatgcaatagatctgttgtctttataagaagtggaagagtcaccagagacctctcacttttcccgtgcacgcagagaagaggccatgtggagacatagtggactagaaggtgcaagccaagaagaagccgcaccaagaaccaaccctgccagcacctggaccttggacattcagacttcagaatggtgagaaaatcaatgtttgttgtttaagccacccactcctgttgtcttcttatgaagacccagacagactaataccacataactctgttagctcctggagggagaagcagctccctgaggctgggcacatctctcagatatccatatgaagtaggcagaaatagtagttctcatataaaaatgtgtcatggccctgttggccatttttttttgacggagtctcgctctgtggccaggctggagtgcagtggtgcaatctcagctgactacaaaccccgtctcctgggttcaggcaattctccttcctcaacctcctgagcagctgggactacaggtgtccaccaccatgccagcctattttttttttgtatttttagcagagacagggtttcactgtgttagggtggtctcaaatctcctcactgcatgatctgcctgcctcggtttcccaaagtgttgggattacaagtgtgagccaccgcacctggcccctgttggccattcttggggcaatgtctctgaaaccagccctggtgcctgtaccacaaaattttcttttatctttcatgtggatataacaaatggacaatgaggaccagctgcatggagactgaccactgaacatcttctgctgtctcctaagtaagtcacaggaaaacacaccaacatcaccaacataactgttttccttcaacttcctcgaacgaactatagaaatgatcccttaaagtatagtctattccttcaactttctcaatttgcactgaatcccttcctaaattaggagctacatagggtctgagttttgttccctttctcccagtcttccccaagtatcaaggacagaatagatttaaattaaatttggccgtccatgcccccaacaccacatcggtttctaacatccttgtcatgtacccatccttctgtgggcaccccacatcaggttggccaggaatggccagaaggtgtcatcaccttatgggctgaggctacaagttatacacacgtgtgatttcagtcacacacactctactgcaggacacacctgtgttctgaggaactcaggcgcctgctgatctcaggtcttctctaataaattacacacctcttatgaatgaaggtccagatggccccatcagctgcagagcagtggattaaagctcatgggtgggtcagtcaggcagaagtcagacaatgggataatagaagtcagacaatagtcactgaggttcccaatgtattttaatggaataaaacaatattagcaacaaaggggcagtaaagaagactggctcttgaaggtatttaaggaccaggaactttatttggggggaaagtgagagacacttttacatggaaagccctaaagcacatacagcagctgacagagtggccactgtgcacatgagggctgaggagacggatgataggttacgttgctccaagatgtccctgggtgtgtgatggttggactcctcatgcatatgaaaataagagctggactcagggagaaacaagggccataccccatagaaaaggaagaaaaaaagcagatgggcacccctggagagagctcattagatttggtaggtttgagatgaaaattacttccaaaggttttaatgttctaagctaaatatgaatctcttcaataaagtgagaattaaaagaagaatggagctaggagttgagagaggaaacaaattatgagagagcagaaagcaaatccacccaaactgtcacatgacagaggccagaatggagctgatgcagctacttcactattctgcagacctagttgaccatgtggagaaggggttcgaacaaacggggatgttctccaaccttccaaaacaacctccttcttatgcatatgcagtaatcatgattctcagggtggccttcccaagtttcctgttcttacctcttcccccaggggtagagtgtcttttccaacccacagtggtttctctgccatgtcctcagcttctcctccattgtacttaacctgaagattaaggatttcatctggatggagtttcctgggaatcctctgttttctttggtttctgatgaccacatcacaggccataggacacaggttttagtggatttcccctggagacagtggaggtgaatccaggcgttccacagtccttaccgttcttctcttcctgtcagcaccgcaggacagcagataagggagctgactgtggatttttcagatccccgggaaaaagcctgcaaggactaatagtttcacatctaacaccattagcacatgcatccaaaattaaaaaaaaaatcctcactaaatatttccaggttagcctgttcctctctcaataccataccgtggcacctgccctgggttcggtaacatgtgggccccagtcctctctgtaggcgtctgcctcctcagatttcagtcctcttttttgctccgtgaaagcaactcagatatgttaaaaggttttcttcttcatttattcataatttttcaggtttgttgttaatgaggaaagagtaagatcatggtttcctcatttttcacattcccatactgagtaactgctctctctctatgaaagccagaaattaagagaacaactcaagtatccatatccattacaagtgaatgttagacaatttgatgtatgattatgaactaaagtacaacacaggattagaatccaggcatcctcattctcataaaatcatggctgcattcacaaataactgtgctgagtgaaagtagctaacaaattaacagtgcacttcataaacttctatttgtataaactgcagaaggtacagctattctaaagcaacagagaagattacatattggtgggaactgggttttgaaagtaatggggtggtgagatgaaattacagagaagtgacacaaagatttaggtgtgaattgtacacaaattaattgaagctctgattaaagggttgcacacatgttaccattttccaaattatgcagtatatatttgaattaattattaattgtatttaaataaagcagtaacaaagaaacaaatgaatacatttattgaggtggagccaaaactaaatgggaatgaacactcgaaacatctctgactcttgaaaatacacaagcgtgaacactggttctctctatgtatttcaggtcaatagcagaatacactaaaagaaaacagagatgtcctggcaggggtggaatcctgcagacctcactaggcatgtctcacactgccctggagttgtctcaggggagcagtctcctctagtggtcagaggcacaggccgagataatggggctaactctgtccagctgtgtgaccttgaatgcattgtataaacactctgttctctgtgtgatttatcttccttaaaatgtgacattgacacttgcattaaatgtattctacaaatatgtcaaaaagatgatgactgctaaatgattatcaaggcacaatcatataatataatgatattttcctgagtgataagatgactaccaatctcccccagggcactttgtctgctctgagccctgcacctcctcaggattcccatcccagagcttgctatacagtaggagacatgcaaataggtttctccctctgctgatgaaaaccagcccagtcctgaccgcacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgtatgtgaggcaccaggtaagaagacatcagtgtgaacacagacacagtttcctgcaatgataagggaggaggctgggctaaaaggggcactcaggacccactgaaaacgggcagctctagggcaggtacagatggttatcatgggctgctttccttcggggtctgtggcttcctctgcatctaccagttcccctcggagcctctggacatttatgtttctgtggccacccctgacatctctggattagaaaagtttattataggaagaggaaacattttcatttgtcccaaagcagatgtaagtaatggaagcaaaaaatgcacaggaggccaggtggggctgtagatactgtcaccccagaatgtcaatctcaccactagtactggagaggcatgggagtttgatggagcttccctaacaactctgtcttccaagataagtccagcaagaccattggtgcctcccagagcacagttgtccatcagggatgtccaatgcttcccagcagcagccatgcctcagtgtctccactgtgcacagccactgtctgggaggagctcccaggatgggtgtctttggcacacaccaggtggcgggtgttaagagtgcagtgcagcagctggctgcctggtctattgggcctgatgctggagagatgggaggtgcattcttggggccagcatgctgtttgtgaatttttatataaaaactctgattttacttcattttcgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctgcacaactcagagcctgcagagacccccaggtgcagcttcagtgagtcagacatttctccatgtgggcgacctccagtgcctgtgactgctgctcaggcctaattgttggttaagcattaggacactctttaggtgatcacatctcaagcctattctgaaaatcaccatgatcagagatagttcaatggccattctcctaacataagtttctctttattacttggttccaagtatggagaaaaatgtgaccctatatttgtctgaatccaacatcagcatcaactgcattatgctaggagactcactaattgagcacaagtgagctcgttattctcatagaaatgtaagtatttggaaatttcagtgtgttctccagaacctgtggctgccaacaactgtatttctcggtgcactcttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaactatgtgaggaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaatgggtgcttggtacagcggggggctcaggattattgtggcgattcagaaagagcaggtccaaggctcaacctcagggcatgtgcagctggtgtgaaaaggagctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctgtgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtggttgtttcaaaccctatcaacccccctacaaactgtcattaagaaagtttatcaaactccaccagtcatgtgatattagttcgttttcacagtggtataaagaactacctgagacgaggagtttacaaagaaaagaggtttagttgactcacagtgctgcatggctagggaggccacaggaaacttataatcatggtggaaggtgaaggcgaagcacggcacatcacacagcgcagcaggagagagagggggaagtgacacatacttttaaactatcagctcttgtgagaagtcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcacaggaaaatctaaaatggcttgaaagaagaggaaaggagactggctcagggtttttataatggtttagtggtggcggcagagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagtgacaacttattctaggtagcaagaataaaaataatgaaaaagaaataagggttcagtatcgatggacaagacccagatctacagaaatgagatgactttagaaatataaggaaataataatgagagaaagaaggaggggatggggaattagggtcctggccgaatgtcttgggtagaagcttctcacaatcaaggactatcagcttattctgcaggtcttaggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgacctccagactcacgtaatcttcctgtatcagcctcctgagtatctagaattagaggggaatgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattctttacttgtaaaacatgaagccaataattaactgcctgactgttttgtgcagtgagttagttaaaagtttctgataagattccttccaatatgattcaagagcagtattttctgccgatattcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagttcacattttattaaaattgataatttttatgtagggatgccattttttaaacattcccagaaggttgtgagtgggattgactctgtcttctgtgaacaatgacagtgccctccatggttagataatattttaaactagattgagctagaatggttgctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacccagcactttgggaggccgaggtgggtggacccctcgaggttgggagtttgagaccagcctggtcagtatggtgaaacctcatttctactaaaaatacaaaaattcgccgggcatggtggtgtacactcgtaatcccagctacttgagaggctgaagtgagaggattgcttgaaccctggaggcgggggtcgcagtgagccgagattgtgccactgcacttcagcctgggcgacacagcgagactccgtctcaaacaaaacgacacaaaaaattccaaagttgtgcaccctctaaaagcatacgtacttaattctcatttttaatttattaaacatctctaataagttcaatgtttcctgccttctgagttgatttcctaacacatagaagaatatatcctaaatgaaagtttgtgttcttaatagaaattactagttaataacctttacttttattattgaggtattatacatcaatgttaatcctctcaatgggactcttacctaaagaatatataaaatattttcctgatcatgacataaagtagatgtgaacacattcttagcattcagccatgtctcttgtctattaatattataaaccacatgctaactttgattttattggtaattgttctaatttctttttttttcccacttctctggttgtttttttttttaactttaagttttagggtacatgtgcacaatgtgcaggttagttagatatgtatacatgtgccatgttggtgtgctgcacccattaactcgtcatttaatattaggtatatctcctaatgctatccctcccccctcccctcaccccacaacaggccccggtgtgtgatgttccccttcctgtgtccatgtgttctcattgttcaattcccacctaggactgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagtgataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcagcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatgtccaagtcagcctgttccgatcttaaatgccatccagtggcatctgccccaggtacactaatacatgggtcctgcttctctctgcagccgcctctctcctcagatttcaggttttgtgtattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaatgaagagtaaattttatatgatacatttgtagaaattttagaagatgccactattataaattaacatggagaagatttaaatgtttctgagaatatgctattgggagtaatggggatgtgagttaaatttcagaggaataagagaaagatttagggattaatttattcaaaccttgattgaagtgctgagtaaatggttgcaaacataggtctacatttttcaaatcattcaccataaatttgaattatttattaattacactcgaataaagcaataaagaaactgatgagataatatttgactgaattgcagcaataaatagatcgatattaacacaaggaatataactgacttccaaaaacatacacatgaaccgtggttcactctgcgtatttaggtaaataacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagacacagtgaggggaagtcattgtgcgcccagacacaaacctccctgcaggaacgctggcgggaaatcagcggcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgagtcttctccaatcagacccaggacagggacctccgtgagattccctgactggaacagtctttatggatcctggtcacagacaatagagaggctgaaccagggtcagcgtcatgtagaacctcacagatttcacgtctgatccttctcctgacacgaaagtatgcaaatcagtatcagcaccgatctggtgcttcttttgttcctaatccatttactttattttttcgtcgtttttctcctttttccatttgtttttcctgctttttgcaaaaggaagatgttttccctgtgagatgcaggggatgacaattttgggagatggctggaacatccaatatcctcagggccggccatcagtaagtgcaggctggaagtctcagaaagagctgaagctgcttaatcaccgtggagttttaccttctccagttctgctctgatggaatcagggccaagcaggttatcaatgataatctacctaacatagagtcaaccgattccagtttcaataacgtctgttaaaaattcacaccaccacctggattagtgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccatttggacattaaaactttttgagatatatggcatattatccaattctgtaagttgtagttacttggttgctttgcagaatctttttcataatctattcccacttgttcaattctgctttttttttgtaggtgatttgaatgtaaaatccagaaaaagattgctaattttttgagggttgagagttttacaattacaggtattaaagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagctcgtcatcaatatgtgggtttatatctaagctctgtataggtatttatgccaaaactttctatgtttttaacaaatgttaaggcctggaagtgaaatgcctaaagctttcttcttgccttgttacagatattggaccaaaatattctaaccttttactattgagtgtaataatagctgtggcctttcttaacggcttttattatgttcaagttgttttcttgtcttcctactttgttcatagtttttataatgaaactgatttttttcaaagtctttttctgtgtctgatgaaatgttactgaggtattttttctttagttttttaatgtggtgtaccaaattggttgatttgagaatgttgaatcaagtatgcatctcaggaagaaatttgagttggtcatggtgtatgtcttctaaaacactttggagcttagtttactattgttggggattaattcatgtctactaatgatattggtctgtagttttcttttattgtggtgcctttgtctattactggtaatactatcatggtagcctcatagaaagagtttagaagatatatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttaccttttccttttaatttttaagtttgtttttagacatatgcaatacattttgaggtgaaacctggtggaattttttctaataaattagaaaaaaataaatcatttaattgactattttattcaggttgatttgtttaatatttgctaaaggccagttctttaagctatgacacataataaatcccaaatggcagtacctcattgtttacttagcttttgtacttatatttctcagaggaagaaccactactgtaaattgtaaatagccaatacataattgtattgtatgcaaatctgtgactgtttacagtgtcatctctgagaaacataaagtttatttactatatatatataaagagtttggaaggtggactcctcaccaatttttgaaagagttacagaagggctggcattacttctttaaatgttaaggttcattttatgatgtgacatataacccatcatggagaatgttcaatgtgttcttgagaaggatgtgtattacgtgactcttggttggaaggttctgtaaatatcattcagataaatttgttcaatagtgttgttcaagttcagaggcacattaggaattttctttccggatttgctatacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaactcctcctggagtctgacgtctgctttgggcactgccttcttctcaggcatcccacactggagcttgctatagaggaggagggagggcccctctcctggtgaaaacaagcccagacctgaccctgcagctctgggagaagagccacagccctgggattcccaggggtttccatttggtaatcaggactgaacacagagaactcactatggggtgtgaattaagctgaatttttcttgttggtattttaaaaggtaactcatagggaactagagtgagtgagagtgagtggatatgagtgagagaaacagtggatatgtttgccagtttctgaccaggatttgtttgtattttcaggtgttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgtacataaggttccaagtgaggaaacatcggtgtgagtccagacacaaaatttcctgcaaaaagaagaaaggagtctgggccaaaggggacactcagcactcacaaaacaggtgcagccccaaggcaggtgcagatggagggagggtaagggctgctttccttcaggatctgtggtttcctctgcttctaatatttcccctctgagcctctgtacatttatattttgtgcccaccatgaggtcgctggattagaaaactaatttgaaagaggaaatattctcatatgtcctaaaaacagatgtaagtattggaggcataaaaatgcataggagccgggtgtgtctgtagacactgccacccccaatgccagacccacaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcaatctctccactgtgcacagccattgtctgggaggagctcccaggatgggtgtctttggcacacacagttgatgggtgttagagtgcagtgcagcagctggctgcctggtctattgggctcctggatattggagggatttgaggtgcattctcagggccagcacgctttgtcaatttttatatgaaaaccatgtgatttaattcattttctcagatgacatagataattaataacacaatctgcaaacaattataattttcaactttaccccaagttcattgtttctgaattctgtgcaggatccagacatggtactgcccttctcatgagaaactgttcgatctaaactgaaaccagttgtttctcgtatactttggttctccccatgtgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtggctcggaattaggacagtcttcaggttatcacaggtcaatcatattctaaaaatcatcgttatcacacaccatggtaacaattcaaggttcatttttctaacggcagtttctcttttttatttggttgcaagtttgaggaaaggaacatgtgataatactttttaacctaacctcgaaatctactgaattgttctaggagactcacaaattggacaaagtgagctctttattctcataaaaatgtgtggttttgggaatttcactgtgttgcccagaacctgttaacatcaacaactatgtttctcagcacacttctggcttgagacgtccttgcagaccctctccctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagcaaaagacgcaatgaagggccttcattgtgagcctagacacaaccctccctgcaggggtgaataggagcagcagggggcattcggggcagtatgggggcttaggatgattgttaggggtcaggatgagcaggatcaaggcttcgcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatatgtacccatatggaggtgcatccagttgtcttctccatcttatgtggaccttgtccatcaagcactaagtccctgtatttacttgagtacctcacacattatggtcaaaacaggtagggtctccttttggcatggtctctcctcctgccttctctcttctgtcacacaaaaacacgtgaactgacacacacacagagcttcccaactttaattatgtgatgtattgaagcaaattgattagtgtgcagcttttctgctttgcctgctattcatgttatgtaaaaataagaaccatgtttttctcagcttgtcacttctctaagctaagtagcatctttgtttattatacccagagaccaaaagcgatccaactgttattcagcagcttaactggtaaacaaattgtggaaaattcacttactggaatcatacccactgctacaatcaagtaatgctggatacacccaacaccatgcttaaaatagcaagtacttgaataagtaaaataagtcagacaaataaaagtgcatacatacgattccacttctataatttctataaagtaaaaatgaacttaaagttacataaaaagatctgtagttgactggggacatggtacaagaagagaaggtatagaaaggagaaactacaggagaacaaaaggaaatttctaggataattgatttttttctctgttagtaaaagtgaggattatgtcaatatttgtaaaattgtacactttatgtaaagattcttatttgctaatttcacctcattaaaatattgcaattttttaaatgtctagtttggtagaaaaggtagtagagagagatgaataaaatacataaaaatcagagagtcctgaatacacacatgaatggaccctgggtctcactgtactttgagggagacactagaatacaaaaacataatgacaggatttcagtacatgaaaggagcttctcagaccccaggaggcatgtccaactgcgtctgggagttaactcagggagcaggcatgtcctttggaaggagccgtgacaccaagctcccagcatccattgtagccgacaccatgccaatgccaagagatctcaactaaaattttctgtggatgttgagtctgattatgccacacactcacaccaagtgagtatggaaaggatagttacctgcatccttaaggtgtctgctgagagcagggcaggtctctcattaaggtccaaagtggcttgatagggcagggaaggagactggctcagggttgttatcatggtttggtggggagcggggcagagcatcctacttgcaggaagggttttgtggggtttcaaggccaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcgcagtttaacttcctctatttgagtagctttacaattgtgtaaaattcttaattaattaatttttttttgagacggagtctcactctcttgtgcaggttggactgcagtggtgtgatcataacatagctcacggtgattttaaattcctggctcatagaatcctcccacctcaacctcctgactagcaagtagctaggtttccagggcccttcatctacacttggccggttctttacattctttttttttttttttttaggtggagtttccctcttcttgcccagaccggagtgcaatggcgccatctcagctcactgcaatctccccctcccaggttcaggtgattctcctacctcagcctccagagtagctgggatcacaggcatgtgacaccatgccccgctaattttgtatttttagtagagatgacgtttctccatgttggtcaggctggtctcaaactccctacctcaggtgatccttccacctcagcctcccaaagtgctggaattacaggcgtgaggcaccacacctggcctcttcgtttttattcatatattccttcagcagccactatgtcttcccactgatttcttcagtttctgccttttccttttgaataaggctgttactcctgagggaagatgggaggtgggcctggacagggacttggtgcattcctctctcccctcccagttcttattggtttctccagtgtctgtagaacagtggttttgatggctttacctctgcagataatttctcttgcaatgtagtggtgatggggaggtgtgtctggatgcatttcagctgtagttgctgttttgctttcccagacagcaccatcccaaggggtagaggctggagcattttgtgatgtatccccagtactgaagaaaaaggcttcaatagcaggaggaattcctcaactgcatacactctgagaatttaaacaataacttctctatcacactcaaattgaaaccacccaatgaatatgtctactttaatcgtgtgctaacttaaatgacatttggcagcctctgtcccagaaaagattatcatctgctcctgtttatttccctgcaagtctttatgtctgttcagatttcagatatattgtttgtcctataacatcaaaaatttgatgtatatatgctaatttgcagatcagtaagtttagtatttgttataagaatagtaacatatttttatggggtgcttacatctccaagctgagaagcacctctgtgtaatactaagcaactagaaatggtacaaataccaagaagacacatagataaacagtaatggcatgctaatttatggtaataacatccatcattagaatcaatacattgttgatgctcaacatgtgtgcatcataagtagttatgtgcgagaagccacacaaataaaacacatactatgtaattcctgtataataaattcttgaaactcaaaactaaggtattaaatgtgaaggactgactcagaatatggtggaggaagaaaataattgggaaggaggaattgtagaggaacacaaggaaacttttaagtgtaatttgtttattcattatttggatggcttttggggatgcacaggtgagcacgagtggaataacattttgttttgtttgtttgtttgtttttttctgaagagatgtggtcctactctgcgacccaggctggagtgtagtggtgggatcatagttcaatgtagcctccaacttctggtctccaacaatactcctgcatctgccatctaagtagctggaactaccgttgtttgccagcaggcttggcttgagtacttattaaaccgcacactttttgcaatatttaatgtatagtaataatgtctcaataagactattacaaatcaatgaatgaataatttgttctgtacagatttatggaaaaatagacactaacatgatgaatgactgacatttatgaaaatacagctgcatgaaatgtgcttctctttacattcattaggtaaacacaatagtgcatacacatcacaccgtgctttcattacaggaagaaacatctgaaaatgtcactggggtgaaccatattgtgctgggcttggttcaggaagcagtcaggcccagtgttgtgaccttcaaccacagaatcctaaaaaataataaaagaggctcccccaaagtccccatcagttcctggactcgccatgtgtctgggccgtatcagtgcatccggagctccctggtggctttagggattccttgcttgccatgctgaggtctcgctgtagattatgttgggttttctgaggccgttttgctatttaagacccactccctggcacagagcgattccctctaaacctgatagaggttctgaactacaaataacgttaagtgaatcctggtgtgtctgaactcacatgattgttacattaagctgctgttgcaatctgtttcctcacctgggaaaagaggagccaggacatagtgagttgaggccccaggaagataactgaattctcagagggcacaaccagcatcctccttccagggagagcctaaaagactggggcctccctcatcccttttcacctctccatacagaggcaccacccacatgcaaatctcacttaggcacccaagggaaaccatcacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgagcccagggctcactgtgggtctctctgttcacaggggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaacacagtgaggggaggtgagtgtgagcccagacacaaacctccctgcagggaggcggaggagccggcgcaggtgctgctcaggacgagcagggggcgcgcggggcccacagagcaggaggccgggtcaggagcaggtgcagggagggcggggcttcctcatcagctcagtggtctccctcctccccagcacctcagctgtccccaggactcctctttctttattatctgtggttctacttcctcacatccttgctgcaggttttaacagtcactggcacccttttttcaacaaattcccacaaggcccattttaccttcttgacaagcaaaatattctaaggcttctcactatcccttgattggcgtcatctactgcatcgtgtctttctcttaaattcatgtgatgaaaccccaatcccagtggctctgtattggacagagggattttaagagggcaaataagttaactgtggccataaatgtgggaccctaatccagtaggactcttgtccttatgagaagtggaagacatcagaggcctctctctccacatgcacacagaggagagtccatgtggggatgcgctgcatgagaaggtggccctttgcaagcctggaagaggcctctcaaaaaacttaccctttctgcacccagatcttggacgtcaagactccagaacaataagaaaattaatatttgttatttgaaatagcctagtctgtggtatcttctcatggaaagccaagtagattcagagattcaattgtgttagctccgtctcctgcatggagtagcagcccaccgaggctggacacatctctcaaattattttcataaagaaaaatagatccaagatgaaaaccccaccacatttctgctgagccattcacttagcagcagtctctgagatcagccctgggggtatgttctaggtcgtgtatctcactttccactatgagaatccatgtagataatgagaaccagccagatggagtcctgatccctgcccaccttctgcttccccccaagtgacacacggtcacagaaaaccactccagcatcaccctgtgtcttgtactctctaaaatcccactaaagctgaccctaaactaggagctatttggggctggactcattctgttcttagtcttccataaggtccaggtgccgagtagagcctcagtaaagagtgagcttcaattcccctaacccacatcattcccttacatccttgtcatgcacctgtcctctgcaggcacccagggcaggttacacaggaattgcctgaagctggtctcaggtgccctgctgagaccactggttatgcacacgtatgatttcaggtcatgcaggctcttctgcaggacagacctgtgtcctgtagagcacagacacttggtgacccagggcctcctctaataactcatacatctcatgtcagtgtatatccaggtggcccctcagtgcagcacactagggtgattaccctcacaggtggctttttcaggcggtgaacagaaaatggggtgggcacgctggtcattcccatcatcggtgatatccaagtgaattttaaataaatgaaacaaaactaacaacaaaggggaaggatatgtacctgtatctgggaggtagactgggtcccagaactgtactgggagtgggtgtgaaaggcccttttgtgtgggaagccctccagcatgagtgaaagctgaaggaatgatcactgtaggtggaggctgatggagaagctggcagggtacatttcctgaagctgttcccgggtgcgtgatggttcaatggcccatgtacatgaagaggagggctggactcatgtaggatcaaggaaactaccccatggcaatggaagaaaagaaaatggagatggacacccctggaggcagcttattagctttggtggaggaacgatgggaatttattccaatgaccccagcattttcagctaaatatgagttgcattaacagacagaattatgaagggaagggagaaggagtttatagagggaaaaagcagaacagaaaaaaagaactatgcaagtctatcaaatggcagatgacagagtggagctgatgcagctacttcattcttcccggaacctaccagagaccttggcattcctgtaaggcaggtctagtggtgatgcacttgtccactttttgctttttggagaaacgtttgaaacatcctacattactgaagaaaagctttaattagtgtaatatttttacttgacagttttattggttttgttttattttcagcaacttgaatagaatcatgcacatcatgatatttgggtgaacaacaggccacatacacgataatgatctcattaaattataatactgtattttcactgcatttcttccatacttagatatgttcatatatatacatacctaccatggtgattcaactgcccacagtattcactacacttacatgatgtacagatttgttatctaggagcactatgctatcccacacagcctgggtgtagcagggtatttcacgtaggttcacgtaaacacactctatgatcctcgcatgatgacaaattgcctaaggacacattgctcagatgtatccctactgttaagctacacatcattgtatctcatctctctccatttttggtctctgataaaattctcgtgttgtttttgcattcttctctgagctcattgaacacatttataaggtttcctttgaattttctgccaggtaatcaatatacctccttttaatttgtgtcagtttctagtgctttgctttgttacagaatttggactgctttttttctctttcattattattatcactttgtacattctctgttgctttctgctcattagaaggaaaagccatggtaaccactcttcacagaatatgctcagggcaaatgccatcacctgttagcccagtccatgatagtggtgtctcttaaaatttcatactggtccaaactttttgttgttgttgttagtggcactcagacctatagaggattttaagttttcccctactctaaattaggtggcatcaaaattcatcctgcaggcagtctctgataaagtggagaaattggacaaagttttagcatgtatatggttcataaaaataatatgagtttaaggttttctcagccagttgctacatattgatattttataatcatttctttgaatgtctctggagtttatcttttgaaaatttagatcagaatatataccaggtttgaggcttcttgtctggcttaacgatctcctataggtcagcgtgtgaaaaggcacagagtctatctgaagaggagaactcagggaagccccaaaacaacagaggagacaaaactgaggactttgaggaatctaaagcttctgggacctgcagcctccagacatgctcagcaccctcttgttatccacggactaatttctttctcttttctgagtggtattttctagggttcccgtcctccactttgacactttggtatgtccatgtgtgtccattgtgtttcagccagggacacagaaccaggaaaacatcatggcttttctagagggagctgacctgggtaatcaacagttggagtagaaagtgcctttgtccatgtgtcacaggcctaagggccatgggcaggaggtcaggaagagaggatgaccagacggctggggaaaccaggatgaacaaagccactctccttcctggtgagaaggggcatgtggaagcctggtgtccctgtagggctgaaccacactcacctgcccactgctacctgccagcgaggtgacccacagagcagcagcagctcctgagtcactcacagaggctgcctcctcctccaaaccctccagtgtatgtgcttccataagtgtgagccccagcagatcccaaagttttcaatgggttcatctagctagtgtctgtcctcagccccatccccaggctcctgccctggttggtgtccacagtgtcccagcagcggtgacagtgacagccagggcctgcactttccagagcagcaagtttggaagaatcaagtcccagaaccagcctggatttggggcaaacacacaaatttcactctgaggggaagtgctggaaagtagccttgagtcttcctcagctcacctgtggctgatcctctgcatcccatcagcgatacatgagccctccccaaccccagcgtggagctgtttcaatcgcagcaggatgggaatgtgtcttctttctggggactttttaagcacagctcttatgttcctgagatttgaggtttataaaggtgtgtcagtcacccacagagtggacctgcacaagtaagacaaggacaggatccccaggagaggcacctcatatgagacgggacaggcaggtcccatcacagacactggtcctcagaaaccctgaccagctactcaccttcccaggtcacctgtgtctgatcagttcctgtgtttgctcctgaaaagatccccatcaagggtccccaggtcctgcccccttccttgatgtgcctctgggagtggggctggctgggctgtgggtctgctgtgactttccccacaggtcagcggctcagtgcaggctgcgccaactcggtggggctgggctgtggccgaccctcccagggggagcctggatgcttctcgggggcatctgcaggatcccaggttctgggagaacagggaagccacagtgtgtgcagggccccatctccaggtgtaaagtgtttgctgtcactctgttgacaagggcatatccccaggcctaggggcactgtgggtgcacaaccaatgtggtagacacagagagtaaggcacatttccctcccattactgtggggaatctaggcactgtgtgtgtgtgtgtgtgtgtgtgtgtgtgtgtgtattaggagttttgcagtgggctctgagccccgtgattttgtaggtttagaaattatctgatgagatgttcatccacaggaaccgacaagagattaggtgttctcccaaagcccctgggagctcctggactcattgtgagtgtggactgatccattgcttccagagctccacagaaggggctccctggtggtttcatagaatccttgcttggggtctttctgcagagttcactggctttcctacggccagtttagtattgtaagagatggtgtcagcagcacatggtatcacatgtcactaaatgagcattctgagccaggacacagcatcttcatactggggggagggaaatgctttgggagcccagacaggagcctctctgcagtgcaagggctgggctgcagggggcgctcaaggcccacccatcacaggctccacccccagagcaggtgcaccggaggctggggagggattcctctcaagatctgtgtcattcttctaaaaaaaatctaaaatgagtatttgacaaagactgctgaacattctataaatatcctattcaattgtgagcatttatcaaatttgatgttgtaatgagaaccacttttatactagatatttctaaccctgctagatatcttaatagtatgcagctggaggttaagcaagcttttcttttatataaataagtgcaactttggagaaacacactcatcccccgaataagacattcatgtattaaagcctagaaatactttaaattacctctgagccattcaagtgtgtgttcacagtgaagtcctgttctagggaaaattgttctccagggggagaagctttgtcaacatagagcttagggatgtatcaggaggcacatgacctctaaggggattatagcttgaacccttagcatcctcctgttggtaatacatgtgtcactctccaatctttctcatgcagtatcaggtatgaaataggatcgctcatgaatatgcaaataactgaggtaaatatagatatctttgtgccttgagagcatcatccaacaaccacaactctcctcagaagaagcccctagaccacagcacctcaacatgtactggacctggaggatcctcttcttggtggcagcagcaacaggtaagggacctcccagtcaccgggctgagagagaaaccaggccagtcaagtgagacttcacgcactcctgtctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacgtgcaagaggcacagtgtggaaacccacatcctgagagaaccagaaatcctgagggaggaggcagctgtgctgagctgaggcagtgacagggacaacgtggctgcaccctttgttgacatagggttatacacatacatatatatgcacccaacactggagcacccaggtatatcaagcaaatacaattagagataaacagagagatagacccaataccataatagctggagactttaacaccccactttcagcattggacagatcttccagacagaaaattaacaatgaaatcttagactaaatctgcatgacagaccaagtggacataatggatattgatggaacacttcatccaatggctgcagagtacacaatcttttcctaagcatatggatcattctcagggatagaccacatagtagaccagaaaatttgtcatttttaattaaaaagatatcatgtaccttctctgatagtaatgaaagaaaactaaaataataagaggaattttgaaaacacatggaaattaaacagtatcctccttaattaaacaatgtgcttccaaactgaactatatgctctaaaatgggttaataaagaaacaaacaagaaaattttacaatttattgaaagaaatgataatgaaaacagcgtatgaacacctatgaaatacagtgaacatagtactaagaggaaagttcacagctataagcacctatgttaaaaaagtagacaattataacataaacatcttaggaatatctctcaaaaaaaactagaaaagcaagagcaaatcaaatccaaacatagtaaaataaaaaagttaagatcagaacgttaataaataaaattgaaataaataaaacaataccaaagatcgatcaaatgaaaagttgttttttaaaaagataaaagacatctataaacctttaaccagaccaagaaaaaaaacaaagaagaccaaagtaaataaaatcagaaagaaaactggaaatattacaaccaatagtgcagaaaatcaaaggatcattagaggctactaggagcaactaaatgccaataaatcgaaatatctggaagaaaaggataaatttagagacacatacaacctaccaagattgagccaggaagaaattgaacagatcagtaacaagtagtgagagtgaagccataataaaaggtctcccagcaaagaaaaaacccgggacttgatgacttcatcactcaattatgacaaacatttaaagaagagataatacctaatctcactcaaaatattccaaaaatagataaaaagtagataaggaagggaagaattcttccaaacttactgtacaaggccaatgttacccttatatgaaaaccagataaagccataccaaaaaaaaaagaaaactacagttcaatatcactaatgaatatggatgcaaaactcctcaaggaattcttagcaaaccaaattcaataacatatcaaaagagcattcatcatgaccaagtgtggcttatcccagagatgcaaggatggttcaacctatgcaaatcaatcaatgtgacacatcgtatcaacagaatgaagggcagaagacgtaagatcaggccttaccttgttctcctcactcaaagtctaccattagttctttggtcctcttgaccagtcctgctgtacttggtctcccgtgattctgttcccaggtcctgaaacactgggcttctgcacacctggagtctctctctttgaacatggagaccctgtatcctcagagagggatgatgcctcattgtggctcccatgccccatgcaaacaattcttccaacacagtcatgatttttcctgttggaaattgaaaggggatgtgggaattgatgtgtgtgtgtgtgtgtgtgtcctcaggcctgttgggcctgttgagaacacagcagggctctatgtacaacaggaaagcaatgttttctctataccatctattttcttataaagtgttcataggtaatcaaaaggaaatgaatcacagtttataagatgttgtggactggactgatgttgtcactcaaggctactatgggggctccaggaaaagaaacctagaaaaggataagactgtgagcaaagaagcaaaacctgggaagcagcagggagagggtgagcaggggtgactcaactggggagggataacaccacttaccacagagggtgaaaactccgtgctcagcaaagaggagaacttactcagcatttcccctaatcctccctccagaagcgcgactgccaggaaagttcacaatgtatcatctccagctgggaacccaaaagaaacaggagattttagggcataggtcctgggcacaaggtgtttccctggttcctaccccttccctctctgtccagcaaaactgcttgtttctatcacttgccttcctgtccttggggtaagaatggatgctttgacactcagcagagggatgctctttcagaggaggaatgagtttgtgttatctgatgtctgagcaggacactcacctctgggaagaggctccaagacagaaggtcgccgtggttcctgccccttatatgtgaggggctcttgacacatgcacacttttcctcaaactctgtttataccccagcaacaatgctgggtgttgtcagcctctctcctccccagatactgctctatcatcagcttgagcacagtttccccatgaaaggcattattctctctctcaagaagatcaactttttacatgtcttcgatggatgacagtttttctgtgtgagaatctagaaataagaaatggggtaatggggacaagtgagctctctgtgtgactcactaggaagtccactgttattccaggtgtcctgtcccaggtgcagctgcaggagtcaggtccaggacccatgaggccctcagacacttccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgtgaaagactcagtgaggaggtgtccttatgagccctgacacaaacctgtcagggcacttaggacctccaggaagactcaagaccaccaaggggactcacgaccactggggaagggcaggttgcagtaagcacagggccagccccagagcaggtgcaggtggagatgagaggctggtttactgccagggtctggggctgcttctccatttagatgtttccttcagagaccctcccttatttcatgatgctctgcttagctgtaagtctctgaaatatcacagttttgttgtaccaggaggaaaccttctctcaggtgctaaatgtagaacaatctctctgccagtggttgccagggtcacagccctgtggaagctgaagggtacccagtgagtcttctccagtcacattcaggacaggaaccttagtggggttccctgaggagaacagtctttaggaattctaacctcagccaagagaggctgggccagggtcagtgtcaggtagaacctcacaggatttacgtctgacccttctcctgacactaaagcatgcaaatcagtatcagcactgatctggggccccttttgctcctagcccattctatttcttgttagttgtatttgttgttgattttccttttgctgttcctgatccctgtaaagtggagatgtggttcctgctgtaaaaattccagggctcaagccctttccctgcagctcaggtggggctcagactgtggctcctgcaaccacgtgggagaggctgatgggactatcttctctcccgttgctcagaaccctccagtgtgttgtgtggagactcacctgggaatgcaagtggccaatagttgtgaaaggtatgcgcttgtttggtcaaagtggaatgtggatgtggaatttatcctgtgttgtgcaaactaacacaggttcaccttcctcacctgtagtgttagaaagagtgtgaaagttgtaagaatcaaaacagagccacttgtgttaacaccctgacaaatggacctaggaatgaacatgaaggagggttcttaggcccatattcctgataacaaaaactatcataaatagactctgcttagccaccatcttggatagaagcccaccacaaccttattaaaaattacacttgcaagaacatcagctcagaaactggctgttcaaccttacactgatgccaccattgctattgattctacaactatatgataattatctcaaaacaacttttgtaacccacctcattttcacttcataaacctgtggattgacatgttggagttactgctgcatttgtagataatgataaataataaggccttttaacaatgtttgaagctgctattctctgatgtctcttctaaaataaagaatttccaagtggatgacaatgaaaaaattgttagaaatatttggtggtaaggcatctttaacatcctgttgaatgtttctgcatagcacatcaatcccttaaaatactttgctatatctgcatttaatgaatgagtctaatattgaggtgcaattgaaaatacctgggcctttgatgaatcagctcatagggtgataatgtctgggtccttgagaaagcagaccctgtgttgtaagttttagtagaagtaccttttgcaaagaaagttcatgtgtttctgaacattatgctacttttaacttaagaatgcaatatatgatttatttttacttcaaactgggtatatacccagtaatgggatcgctgggtcaaatggtatttctagttgtagctccttgaggaatcaccacaatgtcttccacaatggttgaactaattttcactcccaccaacagtataaaaatgttcctatttctccacatcctctctagcagctgttgtttcctgacttgttaatgatcaccattctaactggaatgagatggtatctcatcgtggttttgatttgcatttctctaatgactagtgatgctgaacattttttcatttgtctgttggctgcataaatatcttgttttgagaagtgtctgttcatatcctttgcccactttctgatggggctgtttgttttttccttgtaaatttgtttaagttctttgtagattctggatattagccctttgtcagatgggtagaatgcaaaaattttctccgattctgtaggttgactgttcactctgctgatagtttcttttgctgtgcagaagctccttagtttacttagatcccatttgtctattttagattttgttgtgattcatacttggttaatttttaattgcattgttttcttctgattagttgtaagtatacctgcatattgatcaaaaaagccgtttaacaaatcaaaaggaaacatttaacaaatacgtgacttggaagtattttctccaagtctgttgttgtcttttactcccttgtcagtgtgtattgcagaaaaatatgtatgtgtgtgtgtgtgtgtttacaaattaaagaaacaggtataatttcatttatccatagatcacgtctttggcattacatctgaaatctcatcataaaatatactaatagtgatttttttttccatgtctctaatctcaggccacaatctactcatgagtgtttaaacatcacctacttgattagaggactatcaccctaagatatttggaatatttctggaaggagatgtgttctttttcccattatttctctatttagtcatttattaatatccgtattggtttatgaatgtctatttcatactctgaagtaaatccatgctatattattcattttattgttcaaatcaccacagctttattatgtgcttggaactcatttagtttggatgctgcatccttacagcacacctcatcattttgtttttgaacactttcctgtttcctggtattacaatacattctaagcccattttctatattaactttttcatacatagaatcagacatttttctaaagattgcttctttctgatgttaaaatatagtattaaaataaaatttgtgatactgggtatatgtgttgttaatgtggtataagtacttttaggacctctcaaccaactggcctagtaaatgtgcatgtttatatgaactcatgtttaaggacacattgaaactatttatgtatcttatattctgtaactttattacattaaaaatgagaatacactggtctcctcacccaactatgttaccaccatatcgacctttctaggcttccttgactgtccataatcacccactgcaaagtgaggaaccccatcccatcatatgccattgtattacttagctgcacaatttcaggacacatgcattgcagcatcagaaatgtaaagctgtacccttcttggaaccatttttatctactagaatagagtgcttatgtgcagtttctttacactttaaacttatagaatttcctcattttcaaagttccttagatcagcaacttcgttttccactttcttcatgaagtcatttcaattacactgtataatttctttatttgaattctgtaaaagccaaaactacagtcaagtaaacatagagaggatattccaggaatttacagagtgggtatcaaataagttaaaaaggcaatgtttaagaagagtaaaactatttttagtgatatgcaatggttgagacatgacacaattaatttgtctaagctcataattttgtgatgaaaaatataaacctaaatatatacaatttaaaatgatgtttagcagtacattatccctaggatcaaatgcagactgtataaaattatctaataacttatttggtgaggatgccatgagacacatgcaacaaagaatgaactaattttccttatttgcatataagatgttgacattcactaaagatctttaatttaaaaaaaaatcaattttctatgtgacccaggttttttcttccagacaagcaaataacccacaggattattttctttccttgattgagaaagattttccccaaacttcagctcagttcaggcatatactgtccctaaatgggcatttaccctcagatgagtccacacacctgtcaacacgtggagtcttctgtcagacaaacacacctttactgatgtggattcttccctcagacaaaaacacatgtccccacatggacactttcctcagactaccatgtatgtccttacatttacgctttcctcagaaaacagacttttcctcatgtggactcttgtctcagacaagcaaatatgtctccatgtgaactcttcactcagataagtacacatatgtccacatttactgtttccctacacaggcacatatattcaatgttgaattgttttgtggcaaaatgatctcaagataatggtaattataaaccccctccctaataaagtgtagatctgtattttttttgttgtaacctaactttgccttattgtcaaaaacagtaatttgcagctctaaatgcaccagttagagacaggtgtccattttctctggaaatgtatttttattttcttactggacatatttgttgataatgttgctactatgaagatacctgaacagtatccacattaaagaataaaaaagagtaatgggcagaataaccctgtgcatccagacccagaaatcctttgaccctgccctcccgaaatgtagacacagaggatggatgagcagtgctgagcagtgtacccatgaccacaaacatgaagacatggaaatgtgtccccactcctcctcatgaaaggcagctcatgccctcttccttcaggccctggtatggagccaccccatgtctctgcccttccttagtgtccacaccatggggtctgcactgatctggattcccttctcatccccctcaatattagtgtgccttgtgaatcaggtccagctgtggctgttctcagtctgtttcctctgtattcacagaagtcctgtgtgatgtttactgatggagtcagaaggagaaaaatttaacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatattacagtgagggacacaggggagggaagatctgtctgagcccagacacaaaaatctctgcagagagacaggagggaactgcgtggtagatgctgctcagaaccaccatggggtggccaggaaacaaggggtgcttaggacctctagggagcgctcaggacgccaggggggtgctcagaaccactaggggacgctcaggacactaggtggcgctcaagacaacactactgcactcatgtcaccacggggtactcagaaccaccagggggcgctcagaaccaccagagggcgctcagaaccaccaggtggcgctcagcaccaccagggggcgctcaggacaccagggggcgctcagaaacactcggggacgctcaggacaagagggggtactcagaaccaacagggggcgctcaggaccaccaatgggtgctcagaaccacaagggggcgctcaggacataggtggtgctaaagacaacaattctgggctcaggtcaccagggggcgctcagaaccaccaggggacgctcaggacatgcaggttctcttaggaggcagctgcacatcaggagcttcagaggctgtgatttcctttcagaccctggaaattcctgacctggtcaagcaaaagtcttccccaggatgtctgatttttccttttaattccatgatttcttttacctacaaaacactaacttagaacagggatgtaatgcaacttttattgctgcgtattttctgagtaatactagcaatgatctctcgggacaattattaaaataggttatttatatattttaattattaaaaataatactattattaaaatagtaaaattttttaaatcacacttgtaatcccagcacttggggagactgaggcagacagattacttgagctcaggagttttagaacagcctggcaacatggtgagatgctttctatacataaaagaagaaatagctgagattggtgcaaccagctacttaaaaggctgaggagggaggattccttaagcctgggaggttgaggctgcagtgagctatgattgtgcctccacacaccagccttggtgacagagtgagaccctgtcttagaaaaaaaaatgcatatcctcaatacagactatttccatgaatagagttttgtgtttttgtgctgtaatagtcaaacaattgtatatgttttctaactttaactcagcatatgcatggtgttttgtttctttttctttcatctgctgtttgtggaaaataaacagcactttaaaggctctgtttctccactttgtttggcttccagtgtcctgtttttcagactgtttctccaccttcccttcttctttgaaagccatttatcttcctcagtctccatgcagaaaaagaaagtccctttactttctgtcttccaagtctggtgaatcagttcccttcttttcataatcactgaagccaaccaagtttagaagtataacagttctccttagaatacgctcatctacctgcactctctgccctcctcatccttttctaggtccctccagacatcaccctcatcccataccctcccttccttaagtaccacagagtgggctcttcacctcctgctgccctctatgtgctcagccctggggctcactagtcctttgattatgaagtccaaatccctatgtgcttgcacactctcacgccaccctctaggaagctgccattgtgagagagtcctgaaaagcatgggctgggtttagtttcataatgcatattatggtcaattagttattctatttgaacattctatttaattaatagatagagttaattaaatagagttattctatttaattctattaaactattaataaattagttattcaatttattaataacaggccaatatttaaaataaataccattgcacgtttaagtgacatatttgacaataattgcatttacatacagttttaccaaaacatgtatcgaagtgtatttgtttttttaaatattggaataggcagacatacacataggaaaacattattttgtactacaatctcaaactgcaaacacaatttaaatgccattaaataattagaataatatgaaacaaatgggcatggtgttttggtgtttaaatatacattcatttcacctgatcatacttatgtgtctttgctgggctgctgtgcatgtatgtgtatttgtatgaccatgaagctttcagatacatcattaaattacataaagtgttaccatgcacttccctcttttaggggacaaagtaaatctttcagggcaatcgcagggaaaatgtgtggttggatcttccacacagagtccctaccatgacattgccaagtagagctatggaagggggctaccaacctccagaccccagaatggtagatccacaggcagcttgcagctcgagtctggaaaagccacaggcacccagctccaacccatgagagcagccttatgggctgcattagggaagtcacaaaggtagggctgcccaaggccttgggcacccacccttgcaccaggtcacaagacatggagtcaatgattattttagagccttaagattgaaggactgtccgactaggttttggccttccataaaaatctttacccaatttttgggccattttctctttttagcataggactcctcacccaatttctgacccatcattgtactttggatgtaaataacttatttttgatttttcagtctcataggtgaaaggaacttttccttgagtctgaactttggattttgaattaatgccaaaacaagttcagattgtcagggaccactggggagggattattgtatattgcaatgtaagaaagacataaggggcagaatgatgtggtctggatgtgtgttttctccaaatcttatgttgaactgtgaaccccagtgttggaggtgaagtctgctgggaggcatggcattaggggcatatccctcatgagttacttcgtgtcatccccttggtgatgaatgagttatcagttcacatgacagctgattgaaagagcctggtaccactcccttctcttatcttcccccctattgtcatgtgacactcttgctccccttcatcttctgccttgactgtaagctttctgaggcactcagcagaaacagatgtcagcaccacacttgctgtacagcctgcacaactgtgagccatataaaacctatgtcctttataaattatccagcctcaggtatttctttacaattcaataatggacgaacagaagaagtatttaattgtgcagcaaattaggggtgtggaatcattaaaatggacttaacgcctgtagaggtaaagacacaagagtctctctctctctctctctctctctccttgaacccttctctgtctttacatacacacacacacacacacacacacacacacacacacacacacacgctccacgtgaagatgtcatgtgaccaaatagcaatatggtggctgctatgagccaacagtagaagcctcaaaataaaacctatcttgccagcatgtttatctttgaatttccagaattgaggaactgagataaaattaaggttgtgtaagttaccaagtatgattgtttttaatgtttgaactgactaaagagaatttgggatgaagaagtggggttctgatgttacaattatttcaacactgtggaaagtgccttggaattgggttatgtgtaaaaggctggatagttttgacatgcataaagaaatttatatattaagtgtcattctgatagattaaaatgagtagagtgctattggaaactggataaatggtgatctttgttataaagtgacaaaaaaaacttgtctagactatgttgtgatatttagtaaaagagaactttgagcagcaaaattgaatatttagctgagaacacttctaagtaaaatgttgaaagtgtagtttggtttctcctgggcatttataataagaaatagatgaattgaaaatgaaattataagggagaaaatatccaaaacttaaaggcttggaaaattctcaatctatctgtgttgcaaaaatcagaaagtgcgttctgaagagaacagtgagtatgaggctgtaatatcacttgataaagaatttatggtattaaaagagaataaatgcaggttttaaagaacaaggatggagatgagacaaaatggacgaatactgtcagattcttcagatttaagaggatggagctacttggttgcaaatgtgcaccattcttccagaacaaagaaaaataaaccttgaatttatttagaagtaatcatgaccactaccttggtttcaacagaccagaccatccatgcttaaaaccttgaggaaaagacctcctaccactgcctggaacttaggaactcccagtgagccttgtgtgtagggctgcatggggtctttgggatgggaccttaacccagcagttacccattggtgcctctacttaaagcattggaattaattctgctgctgcaatgagctgggaaagaagaagcttggcccagagaagattccacttgagccttaaggtctatggtaatttgttttgttatgtgttgtacttgctggggacacatcacccctcctttcttttctatttttctctttgggggagaaaatgtctattttatgcctaactcaccactgtattttgaaatcaaataacttgtccagcgctatggactgaatgtgtatgcaactccaaaattaatattgtggaaccctaatccccagtgtggtgtaattggggtgtgggccatttaaggggtgatcaggtgaaaaggttgaagccgtcataaatgagattagtgctctaataaaaagtcacgggagagcttttctctcttgcttccctgtcatgagatgatacgataaaattacggccatctgcaattcaggaaggaaacctttacatacacatgattggctgtcttgggcttcccagcattcggcactgcacagaataaatatgtcttgttaaagtcatgcactttatgacactttgttaaagcagccccaataaaataagatatctggttttactggctcagagttggagagaaatttgtttcagaaataattctacctcaaatcttactcatgtatggtttagttaatatttaaattatgttttaaacttgtttagagttgatgatgaaatgagttaagagtttggggactgttataatcaaatgaatgaactgcgaatgtgtaaatgccatgcatttgggggatggtcttttctattctgggtctttcatgcctacgtgtgaattgaaggattgcttttcttatttctgtgaagaaggccattattattttgatagataatttatctaatctgtaaataactttgggtagtatgaaaatttcaatactattaattcttccaatccataaatgtggagtatctgggatatatgtcctatttatgtgtgtccatttcattttctattaccaataatttatagttatcctctagaaatctttctcttatttggtaacatttattcctaggtatattttgcagctattgtaaaaggaaaggcttcatggatttcattctcagatgttttgctgtcaacatatagaaatgccaccaattattgtatgtagatgatgaatcttacaactttacttaatttgcttatgaattctaatagtttgtgagaaggctttagttttctttttttaatataagatctttttgtctgctcacaggaaatctgacttccacaattccaaatttgaggtcatttccttttactgttaactaaatactctggctagcatttcagtactattctgaataaaagtgataaaaatggttatttttgtcttcttccacttcttagatgaaaatttcccggtttttccatgcttcgtgtgatgaaagctgtgtttttctcatatatgcgctttattttttgagatatccttcttgtatacctaatttttgataatttctatcagaaatgaatgttgaattttattctatgattttctaaaatatcttgactacacaataacacagtaatatgcaggtcaatacatatcaactgaatttcacttaatatcatcccaacttctaatatttattttttagtattagaacatgcctgtttccatattatatttgctcacaggtattggtacatattttagctaatttgtcattattttactctaagaaataactcaaaaaatcatttttattatgaattgaaaggtaacatcggcaaaattagcccaatcttaatctttcccagactttgaaacattattgaagacaatgagaggggaaagtcagctttagttgagcttctaagaggtaagtgaggtaaaaacccagggcttattggctacgactttgaatgttactgtcttcttttccataagccacatccagaccattttctaaatctaagaaaactaattttatctcactgcttcttagtcttgtttcctgcagctgacaaccaaaactgtcagcgatagagcccagtgtaaatcaccagcctttaattattgcagaactatgattttacaacaacattgtgagttacataatgatcctactttatggccgcggtgcaaatgcttaacttccactaaatcacagagctcagaatggctagcatggaggtgtatatgtatatgtgcattgttctagaaatttccaattactgtatattattgtttgcagtaattaggtcaatctgaactgacaaaagtctccatggccttataagcacagagaccacctccacggcaggtggaaatcaaggctgggaacagtctaccagctgctcccctgggattcctccaattaccctgtttaaagcctctgctcactcatgcgctggaagagggatgtcagagatgcagtctactcttcctaaagggctgacagggcataaagacaagactgattatccatggaacattcctataggaatgcacctatgtgcagacacactaataagctgtgtgtcttgcagtgtgtaaatggctgagatgccatttacacttctttacacaatacatttttaaatgttttgttgatgtattctctatcattcaaaaaaatcatcactttccccctaaacaaagaggatttttatcagaacacttatgggaagccccttgctctcccagattcccaccctcatttctcctgaaggaagaaagaaaaccatctctattgatttccactctcatcctctaggactaaaaccagaaagctgcatgctccctgggtgagccttagagaagaccctgtctgtaggagcaggaatctcagagccttggctgagaggcatggtcctgaaatgagatggagtcccccatggagatcccacgtggacgcccacacctgagggctcactgctcctcaccacagatgcactcccctactgagtcctgagacctgagtgcaccccatagagtaggactcagatgagggaatgcaaatctccaccagctccaccctcctctgggttcaaaagctgagcacggggcctcgctcagtgactcctgtgccccaccatggacacactttgctacacactcctgctgctgaccaccccttcctgtgagtgctgtggtcagggacttcctcagaagtgaaacatcagttgtctcctttgtgggcttcatcttcttatgtcttctccacaggggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggataccacagagacacagcccaggatgcctcctgtacaagaacctagctgcatctcagtggtgctccctccctacctctgcagaacaggaaagtgtgactgagatgccatttcctgccagggcttgtgtttcctataccaaccagactcagagccctgtctgttttcctattctgtactattaaatggcatgttccctgttagtgattcacgcaagcagaggctgtatcctgtttgacaaagattgagcatgaaagattcccattacctgggccacatgcatcactgatatgtggccacttatttcttgagctcatatccttccaaggggctgaatacaaatatctataacataggccatcttaaactgcaggaagtaatgttggagaagaatgtggagataaaagagcaggatgattaattaaaatccagataccatctttttttgcagagaaaaatttacactaataaagtaattttatgaaacaacaagaaagatggaatgtgtcctcatcatggagtgtctcacttgcagtgcacaaataaatttctaaaaattttatagggaagatgtgatagatgaggctgatttccacacagggagtgattaaatacccaggtaagtataaaatccaacacttggaaaggaaaatgcctcagcttgacatcagaaacccagctcagtaagtctgaggagcaatgcggaaaagaaatgaaaaattcgacaacacttttcttatgaaatccctagctcatgtttgaacacgaaaacagaattgtccacaattttaggacagccatcgcatgacaacaaaccactacaatgataggagcatcactgagtcaacggagttcaagcagtgagcagatcagtactgaggccccaggagaaccaaggctctttggtacattttacagaacccagaaccgagccacataatctatggccaagtgatctttgacaaagttaacaaaaattaaccaacgtatacaccagggaaaggacaccccattcaataaagggtgctggggatattggatagctatatgcacgcgaatgaaactggacccccaccctcaacatgtaaataattaacacaaaatagattaaaggtttaaatgtaagtcttcaaactgtaaatgtattcaaataaaacaccaggacaactcttctggacaaaaagcaaacaatagacaaatgggacttaatgaatctaacaagtttcttcacagcaacagagtgaacagacaaagtgcagaatgatagaaaatatttgcacactgtgcatctgacagagtactaatatacagaattaacaagaaactcaaaccacaacaacaaaagaaaacaagaaccaaataaccccattaaaatgagcaaagaacatgagtagacatttttgcaaataacacataaaaatggacaatagatatataaaaatgctcagcattactaataatcagggaaatgcaaattaaaactagtgagatataccattcacaatggctgttattaaaaagtcaaaaataacagatgttggagaggatgaaatgtaaagggaactcttagacactgttgatgagaatgtggacgagtacgacctctatagagaacagtatggattcagtatgatattgactgtgcatttgtcataaacagctcttattattttgagatacattccatcaatacatagtttaatgagagtttttagtattaaggggtgttgaattttattgaaggcctttgctgcatctattgagataatcatgtgttttttttccattggttctgtttatgtgatggattatgtttattgatttgcatatgttgaaccagccttgcatcccaggtatgaagccaacttgatcatggtggatttgaaaaccggcacaagacaaggatgtcctgtctcatcactcccattcaacatagtattggaagttctggccaaggaaatcaggcaagagaaataaataaagggtattcaaatagaaaaagaggaagtcaaactgtctctgtttgcagatgacatgattatatatttagaaaaccccatcatctcagccccaaatctccttaagctgataagcaacttcagcaaagtctaaggatacaaaatcaatgtggaaaaatcacaaacattcctatataccaataatagaaaaacagagagccaaatcatgactgaactctcattcacaattgctacaaagagaataaaatacctaggaatacaacttacaaaggatgtgaaggacctcttcaagagaactgcaaaccactgcccaaggaaataagagagggcacaaacaaatggaaaaacattccatgttcatggataggaagaatcaatatcgtgaaaatggccatactgcccaaagtaatttatagattcaatgctatccacatcaagctaccattgactttcttcacagaattagaaaaaaactactttaaatttcatatggaaccaaaaaagagcccatatagcctagacaatcctaaggaaaaagaacaaagctggaggcatcacgctacctgacttcaaactatactacaaggctacagtaaccaaaacagcatggtactggtaccaaaacagagatacagaccaatggaacacaacagaggtcccagaaataatgccacacatctacacccatctgacctttgaaaaacctgacagaaacaagcaatgtggaaaatgatcccctatttaataaatggtgttgagaaaactagctagccatattcagaaaactgaaactggatcccttccttacaccttatacaaaaattaactcatgatggattaaagacttaaacatgagacctaaaaccataaaaacccaagaagaaaacctaggcaataccattcagtacataggcatgggcaaggccttaatgactaaaacaccgaaagcaatggcaacaaaagtcaaaattgacaaatgggatctaagtaaactaaagagcttctgcacagcaaaagaaactatcatcagagtgaatgggcagcctacagaatgggagaaattgtttgcaatctatccatctgacaaagggccaatatctagaatctgcaaggaacttaaacaagcttacaataaaaaaaaaacaaccccatcaaaaattggcggaaggttatgaacatacacttctcaaaagaagatatttattcagccaacaaacataaaataaagttcaacagcattggtcgttcgagaaatgcaaatcaaaaccacaaagagataccacctcacaccagttagaatggcgatgattaaaaagtcaggaaacaaaagctgctggagaggatgtaaagaaataggaacgtttttacactgtggtcggtagtgtaaattacttcaaccattgtggaagacagtgtggtgattcttcaaggatatagaactagaaatgccatttgtcccagcaatcccattatttggtatatacccaaaggattataaatcattctgctataaagacacatgcacacatatttttattgcagcactgttgacaataacaaagacttggaaccaacccaaatgcccatcaaagatagactggataaagaaaatgtggcacatatacaccatggaatactatgcagccataaaaaggatgagttcatgtgctttgcatggacatgggtgaagctggaaaccatcattctcagcaaactatcacaagaacataaaaccaaacaccgcatgttctcactcataagtgggagttgaacaatgagaacacaaggacacagggaggggaacaaacatcacacaacagagcctgtcggggagtggggggctggaggggatagcattaggagaaatacctattgtagatgatgggttggtgggtgcagcaaaccactatggcctatgtatacctatgtgacaaacctgcacattctgcacatgtatcccagaacttaaagtatagttaaaaaaaaagagagagagagagaaaggaaacagtatggagactttccaaaaaatgagaaacagtactggcctttattctaccaatcccactactgggtagctacccaaagagaaagaaatcatatttcaaaaagatacccacacttctatgtgtaccacaaatctattcccaatagcacatatgacaacctgagtgtccaccaacagatgattttataaaagaatatagcatatatgcacaatttaatactagtcagccacaataaggaatgaaactgtgtcttttgcagcaagatgcctagaactgggggacattataattagtgaactaactcacaaacagaaagccacatatcacacattattacttataagtgggaggaaaacagtgtgtacacaaggatatggagagagggattatggacattggagacttagcagaatgggagggtaggagttgggagcatgatgaaaaatcacctaatgggtacaatgtacgttacttgggtgttgggtacactaaagccaataccactgtgtaatatttccatgtaacacagttgcacccatagcccttaaatttatacaaataaagataaaaacaattacaatttaaaatataaaattattaatagttgaccaaagatcttgaaaattaaaatttaaatcatgatcaataaatgaaattaatatcagttgaacttcatttaacttaaaatccttttgtactcaagtgattttaagaaaatgaatgtcaagttttagatgaggagatttgcaaatcatatcaccacctatgtaattatagtaagaaccctcaaaactcaacagtgaataaaagaagaggcaacccatggataaaataggcaaaggtttgtgcaggcatttcattaaagaagatgtacagattacacataggcatataaacaggatctcaacaggatttttcatcacagaaattcaaatcaagaccacaataagatacccaaacaccctttttagaatggctgaaattaagaagaaagatggatcataccgatgctggtgagcataccaggtttctagagtctaaaacattgctaatgggaatgcaaaatgaaacagctacacaggaaaataattcttagtttcttgtaaaattatatatgcccttaacacattacctaaaaatccccctcctgtaatacagtaatacatggctgtgtattactgtgaaagaggcatagtgtgaaaacccacatcttgaaaccctgagggagaaggcagctatgctgtggctgaggagattacagggattatttgattaaagacttttttagaaagtgaggttaaatcagccgggcgtggtggttcacacctgcaatcccatcactttgggaggccgaggtgggtggatcacgaagtcaggaatttgagaccagtctggccaacatggttaaactccatctctactaaaagtgcaaaaaattagccgggtgtggcggtgtacacctgtaatcccagctactctgggcgctgagacaggagaatctcatgaatcggggaggctgaggttgcagtgagccgaaatcgacccactgcaccccagcttgggtgacagtgcaagactccgtctcaaaaaaacaacaacaacaacaaaaagcgaggttaagtcattgaaaaataggaaaatataaatgtgtatgcactctaattatttgggaaattttccatacaacttgtattctgtaaacaaaattcagggagtggaaaacaaatcaaattaataaaactgatataagaattcctctgaagatattagtgtgagcactaacacacacttttgaatgggtgttgtaaatattttggaacacacctcttaggtcacattttaattctacatttatgtaaattatataaaatatcgaaattttttaatgtctccattttgtgcagttataattttggtttcatgccagcaatgcatgatagattccgttcttccacatcctcgttgccatttggcactataagcattgtgtattttaaccattctaatctattggtggtgatagctcattgttgtttaaatgcacatgtctctaaaattttatatttaattattttatataattgtgatgaagtgtttgttatggtatttggctcatttttgatagcattgtttatttttgatcagttgtaagtttctttacatacccattatataagtcacttaaaaaagtacttagctggtcatgaaccccaggatgagatgcagactgtatagaaatctctagcaatgttactcagtgtgggcagggatggcatgagatacggggaataaagaataaagtaactttctccatttggatataagatgtgtccattcactagagagttttctttcagaaggttcccatgtgagccagtttccttcctgacaaggaaatcacccagaggattctcataatctcttaagtgagaaaagttttcctcaaactccagctcagtctagctcacactgtctctaaatgggcaattactttcagacatgtacacacatctgtcccaacgtggactcctccctcagacaagcacacacattgcaatgtggactctcccctcagaaaaccacacatgccccacaatgactccttcttcacataagcatatatgcctgatgctgaactgctgtgtagcaaaattagctcagaatacaagcacttatggactctagccataacaatgtgtagatctgcattttattttaaattctaaatgaacattttgccttcttgttaagaacagtggtttacagctctacatgtagagactacaggcagatatatgtttcctctgggaaaagtttattttcatgtatttactgggttattttgttgataaacattcatctataaagacacctgaaaagtgccctcattagagaaaaagaaagtgtagtttgcagattaactctgagcatccaatcccaggaatcctttgatctgccctccctgaaatccacaggcagaggggggatgatcgctgataagtagcaaacacatgtccacaggaagggagacatggaaatgtggtcactcccacactcaagaggagcagctcatcccctgtccgtagtggtcctggtgaggagccaccccacacctgtgccttcctcagtatccacaccatggggtctgtgctgatctgggcttcccttctcatcactctcaatattagtgtccttgcggatcaggctcagctgtggctgctccagatgaggctgttctcagtctgttccctctgtgtttgcagaagtcctgtgtgaagttcaccgggggagacagaggaaataacggtgcagccgggggctatctgagtctctcctgcaaagactctggattcaccttcactgattgcagcataagcttggtccagcaagctccaggaccagggttgatgtgggcagcaacagggagaaattgaagaggaagctctcagtggtgccctccatgaatacaaagaatcttcacagtccccaggacacccttacgtgcatggtctcactgatatctttacttcttttatcacttttgttatgtaaatcacaatgaatagtgtattcctcatctattatacatttgttaagtcttttttggtgtctttaaaaaaactgataactttatagtatgtaatatccttaagtcctgaaagtgttttttgatgtctaccttgtcttaaatttatacagctactatagcttttcttggttcatgttttctcatatttatcttttctatttgtgaatatgtagagaaactttcttgtacatagctaatagttgtgtattgcttttttattttggcagtccttaaatattctaattttttatgatactttaagttttagggtacatgtgcacaacatgcaggtttaaacaaacaacctcatcaaaaagtgggcaaaggatatgaacagacacttctcaaaagaagacatttatgcagccaaaaaacacatgaagaaatgctcatcatcattggccatcagagaaatgcaaatcaaaaccacaatgagatatcatctcacaacagttagaatgacgatcattaaaaagtcaggaaacaacaggtgctggagaggatgtggagaaataagaacacttttacactgttggtgggactgtaaactagttcaaccattgcggaagtcagtgtggcgattcctcaggtatctagaactagaaataccatttgacccagccatcccattactgggtatatacccaaaggattataaatcatgctgctataaagacacatgcacacgtatgtttatagcagcactattcacaatagcaaagacttggaaccaacctaaatgtccagcaacgatagactggattaagaaaatttggcacatatacaccatggaatactatgcagctataaaaaatgatgagttcctgtcctttgtagggacatggatgaaactatctattgcttttttaaatcaactataataaattctattttttttttttgagaaggagtctcgctctgtcgcccaggctggagtgcagtggtgcgatcagggctcactgcaagctctgcctcctgggtttatgccattctgctgcctcagcctcccgagtagctgggactgcaggcacccaccaccacgcctggctagttttttgtatttttagtagagatggggtttcaccgtgttagtgaggatgctctcaatctcctgaccttgtgatccacctgcctcagcctcccaaagtgctgggattacaggcatgagcaataaattctatttttaaaccaacaatatttttttccgttaatttttgtttaaattaacattttgtaatgatgcttatttctctattaacatggtatttaattacctttttataaatattgtatagttaccataagatttacaataaaaattgtatgtaattagattctaatgtaaatcctgtgatggccttgatatgaagaacacagatagtgtaactgtgtgctttgaattcctccttctcgccactctttcttgtttattctgtttgcacttacatatgctgtaaaatagaatatgtaattttttattactttatacagttatatcttatagcaattacaaatgttaaagagtacaattcatctagatttttccatttttacaatctttatttctttgtagagatttctattttgagtgcatatcacatggctactcgcagagaatctttgtaaaatgtgccctgaaacatgaatgtgctgacaacacatattctccagatctttttttctgacagaattttatttgccattcacctttaatgaaattttaatgcatgtagaatttcagtttgcatttcacctgtaatttattttcttgtaattattattagtttttcctggagatgatcacacattacattctgctgggcctttattaaccatgtttctgcgaacctagtcaggcttgggtttcaagtgtatggttgccgtggctatcagagttgaaatcagcttctcctgttcacaaaaacttcaggttcctctggtgatacctgcgtttgtgtccctgtttggctttggatcttcacatttcattctccccaaagaaaggctgtctctttcagctgtggcaggtgcatcctgctgacacatttacttggtgactttttgtgggatgaaggggcttggacacaggggcacgttttccaaccttctggctgagcctccttcttagctatgggtggtgagactggctctgatgcatgatcttccaagtgttcctgttccttcccttcctcagtgtcacagtgtctcttcccagtcatgctgttttttcatcagtgtcctcagcttctgacccactgtccttaccccacagattctggatttcattcctcaggaaacagacgggaggtgattctgggtagagtttccctgatgtcctctgtttccttgtgttctagttgattctaccagtgcccacaggacacaagatttaataaatgtctcctgcatataatgaagggggattcagcattgaacggagctactgttcttcctccccagtcaacaccacaggacagcaggtgggtgagttgtctggggatttccccaattctgtaggaaaagcctgcaagtgccaggagtttcacactctcacaccattagcacacacgtcttcaagcaactcattaaacatttccaggttagctttttcctatcttcaataccatgccatgagtggcacctgccccaggtactctaataaacgcaccctagttctctctgcgggcccctattttctcatatttcagggatttttttctctgtgacatcaactcagatatggtgaggggtttattttttgtaattcttcatgttttttgttaacgaggtcagaataatatcattttctcaatttttacattctaacgcttagtatctgatttctaaataaaattcagaaactaagacaacaaatgaagtatccattatttggtgcattgttaaacaatttgagaaatattcatgtactgaaatagaatgaaccactgaaatcaaggcatgcctcattcacataagaacatgagggcattatcaaataattttgctgagtggaggaagctaaagaattcaccatcaatttcatgtgatttcatttgtataaatcacagaagatgcaatattctaaattaacatagagaagatctgaatttctctgaaaatagggtgggcagagtaacaacgtggtgaaataaaattatagacaagttagataaaaaaattagaggttaacttaattgctaaaacatgattgaagtgctgattcaatgactgcacacatatatcaacattttccaaatgcttcactatcaatttgatttcattattgattgtttttttaataaagcagtaataaaaatgaatatattggctgagaaagagcaagaaatggataaataccgacacttgaataatcaaggactcctgaaaatacacacatgtgaacactgattgtagatttcaggtaaacactagaaaaggcaaaattacacaaagttgttatgacaggagggacatcctgaaaacctctctaggcatgtcccacaccaccctggagctgtctcaggggagcagtctcctccagtgtttagaggcacaggcacgcataatagggctaactctggccagatgtgtgatattggacacattgcacaactgctctgttctgtatgtaatttatcttctctacaaatgtaacattgacagttgcattaaatatattctgcaaatatgtaaaagttaaataagctgatgtctgctaaatgattaccaaggcacaatcacataatctgaagttatattttccagagtgataggattacctccagagttttccaggacactctcatctgctccgggcactgccttctcctcagccgtcccacccctgagcttgctatatagtaggagacatggaaatagggcccactctctgctgataaaaaccagcccaaccccgaccctgcagctctgggagaggagcccagcccccgaattcccaggtgttttcatctggtgatcagcaccgaacacagaggactcaccatggagtttgtgctgagctgggttttccttgttgctattttaaaacgtgatctatagagaactagagatattgagtatgaatggatatgagtgagaaacagtggatacgtgtggcagtttctgaccggggtgtctctgtgtttgcaggtatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccagagacacagtgaggggaggtcagtgtgagcccagacacaaacctccctgcagggccatgcgggtggtttcctttctcagctgcaggaggcgggcttattgttgcaggactctggagacttattaggttgtgatattttactatggttatttatcatgaacttttttattgggaattgtgttttattaatttttattttatatgtaaggttatttttttaaaatacataccttcaagaaataattcttcctaataatttgcacttgttctttttagagttttgttaacatctgttgatatcagctactacatagctatagggacattaatttacatctatagacatatgtgtaaatacacaaacttatacatatatgtggtcttttatatttaatgttataataaaattattataacaattataaaatacatcctaaagaatgaaacatatatagtaatccatattcctttcaatcattgcctatagtttacataaattgatgtctatttgtaaccttaaacatagtgtattggtcattttcaaacatccaagaacaaatttcaaatgtccttgtcacacacacaaaaataaaaatttgaggatttgaggtgatatatatgtcaatcagctcgattcaattattccatattgcattcataaatcataacatagctttattcactataaatacatacaaccaaaatttctcaattttcaatgaaattttaattatacatattttatctgtcctaggtcatgaatgtttttctccctgtccggatgtgattagattgtcctgagaaacaaattcagcttcctgcctcctgaaggcttcaggaagcagctcctagatggggtgaagcaggcaacccgtgtgtgtccacaggacccggagcctctctctccttggattaggccccctcctcaggattacagggctcttcagttttctcaacatgctgttataccagagaagcacaaaacacttaatttcattatatttttcttcaatttttcaaaacaacacaaaggtaataattttaacaataaacatattacaacctactatacatgagacccttcctgtgcttcgaggtttcttctcaggactttgtatgtattacatgttttcagtttttttctgagatggaatgttgacgtctccttattacagattattcttttaatttgtctcttagaataattttttccagagctcctgcccgcccgcgcctggcggaatggagcggcgccagggctgagccaggcgcgcaggggccgccgcacgtgccgcgcggggagcggatgcccagcgggcggagagccagcgccagaggccgggtcggagcggccgctggagcagcgtcagaatgggagaacagcccatcttcaccccccgagcgcgggtcttccagattgaccccaacaccaagaagaactggatgcctgcgagcaacaggcggtcaccatttcctgtttctatgatgtcacaaggaacagctatgggatcatcagtgtggacagcgccaaggtgaccataaacaacacaattacacagaatatgaccttcaccaacacgtcacagacgtctgggcagtgggccgacagcagagccaacacggtgtttggtttggggttttcctctgagcagcagctgacaaagtttgcagagaaattccaggaggtggaagaagcggccaagacagccaaagacaagacccaggagaacatggagccctcgagtaatcatcctgagaatcagggcgtggagccccatcttctactccggcatccagtgtcaacgggacggacgatgaaaggcctctcaggccgctgcagccgacacgcacctgcagtctgggaaccacaagctgaaggcggcctcgacgcagagctgcccacgggaagaggtgggagatggagctgcagacccggcgggagaccgacttccggctgcccacggcgctgcaggagtcgacggccagtgcggagcagaggaagaggccgtgagtcagagtgcgactgtgtctctgagaagatggaggcggcagagagaggatcaaaacctggaagataaagtgcgttccctaaagataggccctgaggagagcaaatcccgacagcgccacctggaggcgcttcctggtggcgctggaccggaagatccaggcctgcataacttccgcccaggcctcccaggctgggcaccaacaactagggctggcagaggcccgggatccccaacgtgagtcctaagtatgtgtgcgagaccagatggcgctaggacgttccctgtgtgcgttgcttctgtaaatgcaggcgccgtgtgtcgtgtttccaaaccagttgtgccatccactcactcctttccagaatagaaatctctcgcttctctggccttgtgaggttgtggacaactggaagattctgactgaggaaaccagaaccaggtctaccttcaacatttacgcagtcaggccagggatgtttatatcgttcataagggttgttggaaccatatgaactgaaaaaaagcattttctcatccaaatattgatattctttacaccaggccatcgggctccttttatccgatagcattcagagtatttgaaggtcctccaggtgccagccttgggggcacagggagaacaacattcctctccgaaaacatggggaagctttaaaataactgtttagtggagacttgcccagagatggaaaacaggtttctggtgagtacattttctggtttgggaatcacctgcatccccgatcctgccccgtgccccccagtttgtatggttgtgacaatgttccatttctttgttttaatttctgagcagttgactgtggtgcgggaacagcacacagtgagggtgcctagcacaatgcctggcgcaaagtaggtgctttataaatatttgttcaattaaaaaaaaagagggaggctgaggcaggagaatcacttgaagctgggaggcggaggttgtggtgagccgagatggcgccacttcactccagcctggcaacagagcaagactccatttcaaaaaaataaaataaaataaataaaataaataaataaaataaaaaatattttttccaagccccactcaaaaccatggtattgttagaggtgtaatagttggaccaacattgaaaatacattccatttagttcatgggcgtgcaaatatccttttttctttaaaaattgttctcagttgtaatattacaaaaaatattggtaatttataccaatgacacaggttaaaatgttgtataaataatttaatgacgtttgattggaaaaaatacatgtgccacatgtcgacaattttttccttctctatgaaatatatactcattaataagtttcagatgttacagttatctttttgatttctgggatttaattttagtaggtatacttgaatgcattttattaattcctataatgatgttgatatttcatgtaggattttaatactaattttactatttactgaattttaaactattctacatgttttatttatataagaaaaaaattacatatgagaaaaaatgcgtagacctgaaatgtatcactagagagtttctgtcaaatgtgaatacctttgttcccaacacctaaggtagcctgaagagcaagtccttccccacaacatgcgtctttttctgtgcttgcggtcagctcctgcatggggaaatgttttgatttctgacactatagatccattttttttctgttttgaactttatataaatgcaatcaaacattttagaccttaatttggtaatgggctacattgctattttttgaggttatttcctgctatttaaggtattaaattagatcaacatattatcatttattcaagtaatggactgactctgatatgaaacctcaaagttttcacatatatatggagagagagagagagagagagagatgagggagagaggttttatatctgagtcagtctgttaaataagtaaatgacagtattttgatttattttcctgtaaatcgactttaaatttgtttccagtttatgaatattataaacaaagctgttacaaatgtcttagtgtaagttttcctatgttgtcttccttttattgagaaaatatgaagtatgtatttattataagcttaaattttttcagttttattgaggtataattgaaatattttaataatgtatagctttaaggtgccccacttgacgttttgatgttgtattagtccattctcacggtgctataaaaaatgcctgagactgagggatttgagaaaaaaagtgtgtttaattggctcacggttctgcaggctgtacaggaagtgtagtggcttctccttctggggagagtcaggaaagttaggatcatggcagaagacaaaggggagcaggtgcgtcacatggccagaccaggagccacaggaagcagggaaggtctacacactgttaggcaactagatcttatgagaactcacacactgtcatgagaacagcaccaggagtttgttctaaaccattcatgaaagacccaccccatgtcccagtcatctcccaccaggtcccaccttcacaattgaggattataatacaacatgagatttggggcaggacacagatccaaaccacatcagatacacattgtgaaatgctcatcatggccaaggtaatttgtatatccattttctcatggagctaccattttatttttttaaaatgtactacatgtgtgtgtatgtgtgtgtgtctcatgagaacacctacgatctacccgttcagcaaaaatcacatttacaatacagcattaaatacaagaacattgcagtacattagatctgcagaactcattcaccctgcacaactggacctctacccttcgaccgacatcatctgatttccctctcctcacaggcctgggacccactattctactctctgctttcaagagcttgaatattttagatcccacatgtaaatgagatcattaagtctttctgcatctggcttattccactaagcatcatgtcctctagccccatccctgttgttgcaaatgtcagaatttccttcttttcaaagcctaataaaattcagttttctgtgtacacattttctttacacattcatcaatctgtggtcattaaattattttacaaatctacactattataaataatcttgcagtgaacatgtgtttgacataataattttatttcttttgaatatatgacaagaagtgggatcaccagagcatatgatagctttatttttcaatataatgaataaccaaacctaccacaccatgcttttgaagtcttagtcatattttatttgcctaggccaatgtcccgaaaaatttctcctacattttcttcagtttgtacatttaaatattgaatccatattcaattaatttttgtctatggtgaaaaactagaagtctagttttattcttctatgtgtggctgtctaagtttttcagcaccacttactgaatagagggttgtttctccattgcatatttttgtcagttttgtcaaagaacaggtggttgtagaaacttgtctttatttcttggctgtctattcttttacattattattattgttattgtttttagtagcagtaccatgctgtctttcttactgtatctgtgtagtataatttgaaatcagggaatgtggtgctttcagctttggtctttttccttgggatttcttttgctattcaggctgttttttgattccatatatatttaaggattttttttaaaacatgtaatcaattatattggttacttgataaaaattgcattgaatatgtatcttgctttggacagtgtattagtctactgtgcattgctataaattaatgcctgaggccaagtgatttacaaagaaaagaggcttatttggcttacagttttggaggctgtgtgagaagcatggcaccagcatctgcttcttgtgagggcctcaggaagcttacggtcatggtggaaggcaaaggggaagcaggcggtgtcctgtggtgagagggggcacagaagaggggaggagggtcgctagactgtttttaacaatcagatttcaaattagctaataaagaaataattcactaattaccatggggttgataccaagccatacctgaaggatcttttccccacaatccaaaaactcctactaggacccacctcaaatattttggatcacatttcaccatgagatttggaagggacaatcacctaaactgtagcatttcactcttgtgtcccctggtctcaaatccttgtaagattgcaaaatcatctttttttaaaatagttcccaaaagtgttaacttgatcaacctccaactgaaaattacaaagtctcgccagggtcttaaggcaatttccctccagctgcgtgctggcaaaatgttttaaagagttatgtacttccaaggtgcaatattgccattgggtaaatattgtcaatacaaaaggaataaattggccaaaggccccacacacacctaaagcctagcaggacagatattaaatcttaaagctacaaaataatctatcttgactttatgttcttagtcagggtacaccaggacaaagtgggtcccaaaatcctcaggcatctcatccttatggctgggcacattccatggggctaataacacaggccagagtcaagtgccagaagtagttccaggttgggagtacaagctgcctttggatctaccattctgggatcttgagggttgtggctgcatttctgtagctccactatgaagtgccctagtggggactctgaatggggttccaaccccatctttccccatctttggtactgccttcgtagaggttgtttgtggtggatccagtcctgtagcaagcttcctcctgggcacatagggttctctacacatcttctgaaatctaggtagaaactgcccagcctccttcactcttgcattctgcatatctgccagaatccagttatcccagcaccatttactgaacacagaggtttttttccacattgtttgtttttgtcagccttatgaagtatcagacggtttaggtgtgcagctttatttctgtttcctattttgttccgtttcttctgcatatctgctcttgtaccagtaccaagctgtttttgttaccatgtcattatggtgtagcttaaagttgggtatcatgatgcctctggcgttgttctttttgcttagcattgctttggctattcagggtcttttttggttccatacaaattttagaatagattattttttctaattctgtgatcaatgatgttgatagttttatgtaaatagtactgaatctgtaaattgctttagacagtatgataatttttacaatattccttcttctaatccataagcatgaaatgttttcccatttatttgtgtcatgtatgatttatttatttatttatgctgtgttttgtagttctccttgtagagatctttcaccttgtttgttacctgtatttccaggcatttcatttgtgtgtgtgtgaatattgtaagtgggataagactgtgttcttgatttcactctcagcttggacatagttgggtatagaaatgttagtgattcttgtacattaagtttgtatcctgagactctaccaaagttgtttatctattttagaattattttggcagagtctttagaattttctatgtgtagaattatatcatcagtttggacagatatatctacttcttttcccatttagatgttgtattagtctatttgcacactataaagaaacacctgagactgcataatttataaagatttttaattgtctcatggttctgcaggctgtacaggaagcatggctggggaggcctcaggaacccaacagtcatgacagaaagggaagcatcatgtcttacatggctggagcaggaagagagaggaggtaggtgccaagtacttggaaaccacatctcctgagggctctgtcatgggaacagcacaaaagagggtgaagcatccccatgatctaatcatccctcaccagtccccacctccaacactgggaataacaatttgacatgaaatttgggtggggatgcaaatacaaaccatatcagctccgttttattttttctattgcctggttgctctgactacgatttccagtagtatgctcaataggagtggtgagagagggcatccttgtcttatttcagttctcaaggggtttgagcttttgctcactcagtataatgttgagtgtggttttgtcatagatggctgttattattttgagttttttttttttttttttgagacggagtctcgctctgtcgcctaggctggagtccaatggcacgatctcggctcactgcgacctctgcctttcggggtcaagcgattctcctgcctcagcctcccatgtagctaggattatggttacgggcatgcgccatcacgcccagctaattttttgtatttttagtagagacagggtttcactgcgttagccaggatggtctccatctcctgacctcgtgatccgcccgcctcagcctcccaaagtgctgggattagaggcgtgagcccccgcaccaggctattttgaggtattttttgatgcctagtcttttgagagtttttatgagtgaatgttggatctcatcaaaagctttctcagcatgtattgagaaaatcatatgttttttgcttttattttgcttacatggagaatcacagttactgaattgtggatgttgaatgaaacttgccttccaggggtaaagcctacttgatcatgacgtatcacattttaaagtgcttctggattctatttgttagtattttgttgagaaattttaggtctatgttcaccaagaatattcatctgatgttttcttttttaattatgtatcttcctgattttgtatcccaaggacacacaatgaaggaaggacagtctcccaacaaatgatgtaaaaactggacatccatatgcaaaataaataaaattagaccttctctaacaccatatacaaaaatcaacaaaaataaacataacatgaaaccataaactcatagacaacatggaaaaataattcatgtcattgattcagaaatgatttatttgaagttaatcccaaaagcaagcccagcaaaaaactacatgcaattatatatctgacaagaagttctatcaaaatgtataaataatccatacaactcaatagcaaatatcaaatgacctcataaaaagagcaaaaacctgaatagatttttttcagaagacacatgcatgaaaaacagagcataaaaatgtcctcaagatgactaattgtcagaggaattcgaatcaaaagcacaatgacatatcacctcacaccacttaaaatggctattatcagcaagacaaaagataagaaatgttggcaagaatgatccacagccataaagagagctttgattggccaagagactgatttcagtaactttctcctgtgaagagaccactgaccatggacttgtcctggccaatttccagaggctgtgcactgtgtgtctttctgcccctgcacaaagcccttttgatatgcaggacccaactgtaattcatttagttcttaagtcctcaccccaaagcaaagctgaaatgcatgtatcatgtgtgtttgcttattagacatgagagcctccactccatgtgaatatccatagctccttctatagcctgctgagtgtgtacactcgaccaatccatttgcacaaatttgtttctcatctttccctctcttaaagtgcctgctcacagtctctgtgggaggctttccttcccagcctgttaagatggccatcctgcagcttcaaccctttctgagaaataaagtctcctttctaaatttataaactgggtgattcttccgttgaaagcacaagctgttgggaagagttatatggcaattccataaatgcctggaagacaagtgtggatagggtagggtaagaagtcctgggggctgcacaccccactctgatggaatttccctccagaaacttctgggttctcaagatgagaatccaaacagattccctcatggctctgtcatcaggagaactatactctgataagtatgcccagaacttcctccagacagaccctatagggaaaaaatacttttcaagatctttattctgtgaggggaagggattcttttccatcccagacagcttcatcttagccttcctgagtcatgaaaaggagtataattaataaaacatctggggtcagattcaagaaaataatctgtggatgctgcagccaggagggggagtggaggacggaggaaaatcagctgtaccactgaatactccttgtaaatggtacagcctagagaaagaatagcaagaaatcattggaattcaatttccagaacatatactgctcccctacccaccacatcacctcaccaccaatatgattaatctggattaaagagaaaagtgtggaaaggcacagactccatctaaggactagaatttagggaaaccaaaggcagtgggagagaaaaagtcaaggacagtaaagtgacttaaaacctcttagaccaacagcttcaggaacaaggtcacatcctctccctcactgaaattagatttacctctcatggggcatctgcagggtgcgcaggtgagaactggcaaagagaacatgaaggcactttccaaatctccattagtacctagctcgctttagctgtttggaaaaagcaaaaccacaacaaacataaccaggactaggatcagtgttggaagcacttttcactggcaagacactaagaaggagggcaaattcgaggccagttactatgcaaatatgccactgtgagtgtgtgtggtggtgagctttgagacatagggtctgtgggtaaagttataatcgataaaatcttcaaccacagaatcctaaaaaaaagagccttccccaaagtcccatcagttcctggactcgccatgtgtctggaccgtatcagtggatccggagctccagggaaggggctccctgatggcttttatgattccttgcttgccgtgctgaggtctccctgtagattatgttgggttttctaaggcctattttctattgtaagaggtggtgggggaaacaatttctgtcactgaaagagcattctgagccagggcacagccccttcctactgagcttgagattctgggaggaaaaagttctctgacaggaggaaaaagttcccagacaggaacttccctgcagggcaggagctgagcggcagggggcgctcagggagcacccagcacaggacccagccctggggcaggtgcacaggaggctggggcagggttttctctcaggaattgaatgttccttatttcaaagcaataatgacctaacatttaaataagaatttagcaagtactgatgtgcctgtaagtattttattgtatacgcagcctatacctaacccaataatttaatgcaaaccggatttaaaaggagaaatgtctaggtctttcaaatgtatttctagttaggaattgaggggtggttttattaattcaatgggtgttactgtccggagacacactcatcccagaagttagatgtgcagagggcaaggctcaggaaaagttcaggtagacagtgagccatatgaacagggaatcacattgaggaccatgtcctgtgagattctgggtttctgtgagaggagttctgtcttcatggacttctgggcatgtcagaggacaaatattaaacaaagttcagggcagggagctcagcatcccactgtggcgtggtccacatgtcacctatcttcttcctcagggtggcgtggcctgagctatgaaaaacctgcctcatgaatatgcaaatgcactgctgtctaccgaggtaaatacagatctttccttgcccagagaccatcacacaacagccacatccctcccctacagaagcccccagagcgcagcacctcaccatggactgcacctggaggatcctcttcttggtggcagcagctacaggcaagagaatcctgagttccagggctgatgaggggactgggtccagttaagtggtgtctcatccactcctctgtcctctccacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagacacagtgtgaaaacccacatcctgagagcgtcagaaaccctgaggaatgaggcagctgtgctgaggctgaggagatgacaggatttatgaagtttaaatctgtttagaaaatgggttgagtaattgagtaaaacagcaatggaaagatgtgtacactgtcattatgtaggaaatagtattttcaactgtcaccctataagtaacactcacagagtgggaaaggcagccatcaatcaagctgatgcaaacattcccatgggggctttgtggggacatacattttataattggatctataaatcattagaaacaggattgcttgatctcatggtaagactaaatataatttccaagaagtggccgaaatttcttccaaaatgtctttgcccttccttttacattgaatttattttaaaggagttttaggatcacaacaagtttgagtagaagaaacagagttcccatgcactcctgccccccgacgctcagccttctctgctatcaacaccctgcaccagtgtcataaatcggttacagaggatgaatctccacagacacattggttgtttccttttctggtggtccctggtataacaagcctcaactatcttgaagcaccccaggttcaagtggattcttcaagtgggttactgggaatgatgccaggtagaaggaaagtgggtgggaccattcctctttgcactctttcctcaaggatccataaaatgtacatttacatggagctcctctttctcctggttttatatgcctcttccccaatggtaaggtttcccagtgtttacagcgggggtccccagtccccgtgctgtggatccgttaaggtgtgcagtgcgttaggaactgggccacacagctggagatgagtgggggcgagccagcatcgctgcctgagctctgtctcctgtcggatcagctgtgcattagattctcctacgagccgaattcactttttttatatatatactttaattctagggtacatgtgcataacgtacaggtttgttacataggtatacatgtgctatgttggtttgctgcattcatcgaattctattgtgacctgcacatacaaggggcctagactgagcgctccctatgagaatctaatgcctgacgattgcagggggaacaagttcatcccaaaaccacccaccgccatcatccatggaaaaattctcttctaccaaactgttccctggtgccaaaatggttggggacactggtgtagaggcaggtctgtaccttggaaagccagcagcttctggtgaatcccataattaatgtcctttaatgagaagtggagactttggtcatgagggccttcgtgaataatgccctacagttggattcaaaacattgtaagctcttggggggtgtttctggataaagccctttgtgcagaaaatgcagacacatccatgggatccatgcaggaaaaaagcttcctttacaaagtggtttggcacctggaaggagctctcagggttgggcactgtaccctttgctggctgcactttagccagaggcttaagcctgattggtcttgcagtgggagagccttcctggggtcaaaggttacaaaaatgcctgtcatcttccagctgagcaagcccatctgcgtgcttgtcagtgtcaaccccatgaagggtgcactctggaagatgacaagatgcacacaaacctcctcccactgattatccactaccacacactcagctgcaacccgtgctccagaaacggacaggggcctgcaaggataaacagaatggaagtattttattacctgggaaagcactgccaaatgccacgtttcaggaaggttaactcataagtgttcaggaagtgactgaagggcagtggtgggtgaggtgacgggactgcctcagggctgcacatgaggagggctccctcccacacagccttttcctccaggagctgcaccaggaactcacagaggatcaggaaggattctgagaacattcttctgtggcgctgactagaggggcaaaataaattataaaaaataaatcaattctaaatataatatgatgtttgttattagaaactatttctggatcctgtgggaaccctgacataagccaccattctctgtgaacaaacatttaacctctccttccatggggaggtcgacgagcttggattggttctttcatggatagtatcccccaaactcctctccactccctgcgtatccccgggtctctcagtgacaagttctcctcagtggaatttggttgatgtagtgagatcttcaaatttcctgtcgtctgtgttctcatgttctccccttatctgagattaagaaacgcacctgcatgtagtaaattatagcctactgtctctcatggacaaaataatggccacgccaaccaaccttgtggctgacagcaaccactggcggccaccatcccctccacagcctgtgttggaacatcacctgagagattgtgttagcaactttccttcagaatcatcttaaaaactttgtgtcccatttcacatggagacgtcatttttccatttcatcttcatagagaaatagaaggagaagaataccaaatacacttcctatctccagattattcaaatataattgtccctttatcaccttctgatttctggtcttcacagaatactctacaaatttttctcactggcgttataccaaaagttgtgaagcaccagatactgggattaatttaaccaacattattattctaataattcttagaatttagaattacaattatcatcttttcgtatacggataaactaacctatgcctttgaaaataagcccttacatgagagtgaaaagctatagatttggaggatttccttgcaaatccaatatttggaaaacggattttatcacaaatatacaaattaacttacaattgaacaacaaaaccacagaatttaattttaaaatgggcagagacctgaatagaaaccatatccaaaaaacaaacataaaaagtgatcaacttgattttcattaggtgtacttatgtttaatatttaaaaagttctactaaactatgagaatgggtaaaaattacaaggtagacaatatcagatggtgatgaggaagttgaaaaacaggaactttcaccccttgctggtgggaatgccgaaatggcacatagaaaactacagttaataatttattgtatatttcagaatagctacaagataagatttggaatgttcataacactaagaaataatcagtgatatagatgaaggatatcctagttatccagatttgatcactgcacataaaatgcttttatcaaaatatcagttgtaccacctaaatattttgaaatattgtgtatctatataaatcaaacattaaaaaacaccaatgcagtggaatccagctaattgcagattcccattagatgggatgtgctgcatgatctgtaaactaatcagaatctgtgggtttgtaaaggactttagaaatcaactaggctgcttgtttctaaagataagtctccctagtttaaatattttcttaatgggtggcgattttgaacatagaagaaatagtaatatttgtgtcttgtaagttttcttcttctcgtgtcacgagaaaaggtttgcagggaggaatctgggaccatctttcaagtctcaacttcactgtgattacctcagtaagtattttctgatacccctgactaagataagtctcgtatctgtcctagaaactaaaagtagaattctaagcatctacctgaccagatggacccttcctcttcaccaaggagttccagagacacttttaaacctagctccggccgtgttagaaatagaggatcagaaatgcctcattataccctcctccctttggaattcaagcacaactaaccagcatttttatgaaaacagagcttaaggctcagaaaacagattatttgtagcagtaagataccaaattctaaccttattcgagaatatcatcacaggacagagagcaggcattgaaaggaatcaaaggcttttaccctaaaatatattcctttgacatattttaaaatagccaggcacagttatcttttgtgagagagatttacattctgtagagaatctccttccctttccaggtctttttcttataccgaggagattagctgagggtctagcttcttttaaaggtcttaggagaaaacatttcccagctattgcctctaaaggtggtcacataagagacttcatctacatagtaagaatcttgttctccaaaacctgttatcttaacctagaaacatttttctaccggtttcaggtctttagaaaaaagcttaaatctttcaatcaattgtcaatcagaaaatattcgaactcactgtaagttgtaatccccgccacacactgcctcacttctagctgttttgtctttatggaccaaatcaacatatatctcacatgtattgtttggtgactgtctctctagtacactaaatttaagctgccatcaagccactttgggcacatgttctcaagatcttctggggctgttcacagttcatggtcctcacattcgcctcagaataaatctctctaaatattttgcaaggttgctttttcatcagtagttctaacagaacctactctgtggtttttgttaaaagcattatattaatatagtattagtaatattagtattagttataacacatgttggaaaattcttatgaagttatgcatagactaacaatgggatcaagtgtaaatgtttcaaagtatttaagcaagttatttcaaaatttatcttctgcagatacttctatcagattcattatatcagctaattacttgctttatgatttttgcattttattgtagatgatcacaccctatattttcttggcctttattgtagaaaattgtgtgaaactagtcagggctacatttgcaagtaattgtcgcagtggctgcctgaattgcagtgggtttcctctgcagccaccagtcactcagattactccaatgacaccttaattttgtttcctgcttggctttgggccttagtcttgtgctctccagacagactctgtctttcatctcccctaggtcaggccagagccacatggacctgatgattgtcaatatggtgggaagggtcgcactgaacgggcactctctgtccttctgagggagccatactgcaggcagacatggcagtcctggctcagggtgtgtccttccaagtatccctgcccttccttcaggtgtgatgctgatccatgcatcttcctcccattcctgggtagagggtctccttgttctttccccaatcttctcccagcagccactatgtcttcccactgatgtcttcagcttcctcttttctgcccttcccagcagatgagtctgttattcctgagggaagagagaggaggtgggagatgaggctgttattcctgaaagaatggacagagctttggagcttttctttcttctaccccagtttctacgagttcctccagtgcctgtaacacagagctgtcagtggctttgcccctgcatgttaattctttggtcatgtagtggtggtgagggagctgggtctggatgcatttcagccacagctgctgttccacttccccacacagaaccgtctcaggaggaagaggttggagatttttctgatgtgtcctcaatcctgggagaaaagttttcaatagcaataggaatctctcagttgtatgtccgctgagaatttaaacaataacttctttataatactaaattttaaacaatccaatgaatatatctaatttaattttgtattagcttatgtgacatttgctggcctctcccccagataaggtcatattctcttcctgtttgttcctgcaagtcactgaatttcacaagatgtaaggtctcttgattatactataacatcaataatctggtgtactaaagaaaatgtgctaatttgcagcttactaaaattagttgttttagtaaaaataatatatttgttatagcatgcctacatctccaggctgagtagaagctttgtttgtaatactcagaaactgcaaataacacacatattaaggagctttctaaataaatactatgggtgaattctttaactggaatactgttcctcattagaatcaacacattctttatacacaaccaaattactgactcacaagtaattatactgagcaagaagccacacaaatgaaattgaaaatataagatttcactttaacaaaatcttgaaaaatagatctgaattaacaaagatgagaggttgactcagtatggtgagagggaaataatggggaggcaggaatgagaggaacacagggaggcttttaactgtaatcatcgttatctcgattgttattttggatacacaggtgagcacacgtgaaattacgttttttttccttcggagacatggttttgctttgtcgtccaggctggagctccgtggtgagatcatagctctctgcagcctcagaccctgggtctccagcaatcctcctccctctgccctatgtagctgggactacaggtgtgcaccaccatgctcggcttcagtgcgtattaaaccgcacacttcaattatgcagtatttattatatagcaataatgcctcaataagggtattacaaataagtggatagataatttgttaaagattgatggaaagatagataccaacatgagaaatgtatgacactcaagaaaataaaactgtaggaaacttgcttttctttatatttgttaggtaatcaccacagtgtgtacacatcacaccatgttcccattacagagaaaaggttctgcgaacctcacgagctgtgacccctgtgtgctgggcttggttcagggagaagtcaggtccagtggtgagaagcacaggcccagatgcccaggctcactctgaccaaatgtgagcactggggacattgtaaaacccacctgtgcttttgctgataatttttcatctttaacatggaaataatattgatactatataccatggtttctctgcgtatgtaaaaataaaagatgattggtgctaactttaaaaatatgcagtttatgtagatctatggtacctcaataaaactgttttaaaataaaaattacaaaattataagattttcaggttttaaggtttaagtttatcacaaaacaaactgacaataggaaagcacaatttcccaatgctttcaatatcacagatctccccgaggacattctgacatgctctgagccccactatctccaaaggcctctcaccccagagcttactatatagtaggagatatgcaaatagagccctccgtctgctgatgaaaaccagcccagccctgaccctgcagctctgagagaggagcccagccctgggattttcaggtgttttcatttggtgatcaggactgaacagagagaactcaccatggagtttgggctgagctggctttttcttgtggctattttaaaaggtaattcatggagaaatagaaaaattgagtgtgaatggataagagtgagagaaacagtggatacgtgtggcagtttctgaccagggtttctttttgtttgcaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacacagtgaggggaagtcattgtgagcccagacacaaacctccctgcaggaacgatgggggggaaatcagcggcagggggcgctcaggacccgctgatcagagtcatccgcagaggcaggtgcagatggaggctgtttcctgtcagggtgtgggacttcatcttcttctgacagtttctctagtgaacctctctaacctcagaattctgtgcttactaatgtcatctctacgtattttttaaaagatcattttaatatgagcacctattctcacacgcaccaaatgcagattgacgcttacagagatgaaaagttctcaaccatggtcaccaggatgagagtcctgaggaaattcaggggtgcctggtgactcttccgcaatcagtcctgggacagaaacctcagggacagcctttatgagttttgatcacatctaacagagaggatgggccagggccagagtcatgtagaacctcacaggttccacgtctgacccttctcctgacactaaagccaatcagcatcagcactgacctggtgctccttttgctcccaatccatgttctttctttggagagtttcttctcccttttttatttgcttttcctctttcctgaaaaagaaacagatggtccccttggtccacattccagggctcaaggcattttcttggagctcaggtggggctcaggctgtggctcctgcagccacgtgggagaggctgatgggacttccttctctccccattttctcaggaccctctactgtgttgtgtgtaggctcatctgggaatgcagttgaccattaatactgaaggggacaaactcatttgatcaaaatgggatgtggatgtggagttaaccctgttccgtgcacagtgtcagagtcgtctgcttcagaagtagtgttagaaagagctggtgaaatttatcagaatcaagatggagccacttgtgttaaagccctaatgaatgaagctggggaaggccatgaaggagggttctaacacacatattcctgataataagaactaccataaatagactctgcacaaccataaccttgcacagaagccaccacaacattaaaagaattacttctcccattgtatctgcccagcaactccctgttcaactttacaccgatgtgcccctgttattgatccttctagcccaggacaattgtcttaaacagctgatgtgaccctcctcatttttcctttattctttatcttcctataccaacctgaatgcacccatacatttcaattgcaatacacttcctagaatacatattattatattttagagtctctctctctctgttattcagggttgacaagctacagatggacatgccactttctttttttatgactttttttaaaaattttattattcttgtactttaagttttagggtacctgtgaacaatgcaggtttgttacatatgtatacatgtgccatgttgttgtgctccacccattaactcgtcatttagcattaggtatacctcctaatgctctccctccccactacccccaccccacaacagtccctggagtgtgatgttcctcttcctgtgtccatgtgttctcattgttcaattcccacctatgagtgaggaaaaaaatgatgagttcatgtcctttgtagggacacggaagaaactggaaaccatccttctatcattctcagcaaactatcgcaaggacaaaagacatgccacttttctgtgagatgtggaggatgacagtttttggagatgtctgggaatacccagtgtccagaagatcatccatcaataagtgcaggctggaggtcccagagagaggcaaagctgctgaaacaccatggaatttcattttctccagttctgctctgatggaatcaggcccacctgttttgcttgtcttaagtaaattcacagcaccacatatattagtgttgcagtgaataactacaaagtctatcctaaccaagtgtaccatcaaatttaccattacccagagggaagaatctttaacatgagatctatgttcataattttttaaggtgaaaaagtgatcactatccaatcaggcaaatatgattttgctaatgagtggtagatgttgcatgtatttttggatgtcatccctttttcagatgcatggcttgcaattatattttcccattctgtaggttggaattatttccacactttgtagaatctttttgttgtgatgtagttccacctgtttaattctgcttttgttgtctgtgcctttaatgtgaaatataggaaatcattgttaatatattattttctgggtcggggaaattttacaattgcaggccatatgtttaaatatctggcccattcagagtgatttttgtgtttattctaacccaaaattcttaactctttgcatgtgtacatccagtttttctaacacattcatagggagagacttggtttatctgttttatattgtgggttcttatgctgaaaatcagtttgccattgatacatcagtttatttctgagctctttctacatatttatgccaactccatcctgtttttattattctacttttgttattacttttgaaatctggaagtaagatgtaagtttatttttgcctttttacagatgctatagcaaaatattttaacctttcactcttccatataaaagtatggctttaaataatgacttttattatatacaggttatattcttgtattcctaacttttagaggttttattatgagatcttgaattttttaaatgttattttctatgtctggtgagaagttaactgatgcttttcctttattctcttaatttaccacatcagatttattgatttgaagatattgattcatcagcgcatctcaaaaataatttggagcttgtcatggtgtacaatccttttaaagtcttatagaacttagttgactatgaattgggagtagcttgtttatatatactaagaacatttgtcagaagctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttccctttctgtactgattgtcaggatcctgaggcctccccagccatgcttcctgtatagcctgaagaaccatgaaacaattaaaaatctttataaattacacagtctcaggtgtttctttatagtttgcgaatggactaatacagaatccaaataggaaaagaagaactcaatgtatctctccaaactgatgatataattctatacctagaaaattctaaagaccctgccaaaataattctagaatagataaacaattttggtaaagtgttgggatacaaaatcaatgtacaaaaatcactagcatttctataccccaactatgtccaagctgagactgaaatcaagaacacaatcctatcccacttacaatattcacacacacaaaatatgaaatgcctggaaatacaggtaacaaacaaggtgaaggatctctgcaaggagaactacaaaatacagcagaaataaataaataaatcgtacatgacacatgactcatctgacaaagggctaatatccagaatctacaatgaacttaaacaaatttacaagaaaaacaaacaaccccatcaaaaagcgggcaaaggatatgaatagacacttctcaaaagaagacatttatggagccaacagacacatgaaaaaatgctcatcatcactggccatcagaggaatgcaaatcaaaaccacaatgagataccatctcacaccagctagaatggcgatcattaaaaagtcagggaacaacaggcgctggaggggatgtggagaaataggaacacttttacactgctggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccagcccaaatgtccaccagtgatagactggattaagaaaatgtggcacatatacaccatggaatactatgcagccataaaaaaggatgagttcatgtcctttgtagggacatggatgaaaatggaaaccatcattctgtgcaaactatcacaaggacagaaaaccaaacactgcatgttctcattcataggtgggaactgaacagtgagaacatttggactcaaggtggggaacatcacacaccggggcccgtcatggggtcgtgggagtggggagggatagcattaggagatatacctaatgtaatgttaatgggtgcagcacaccaacatagcacatgtatacatatgtagcaaacctgcacattgtgcacatggaccctagaacttaaagtattatttaaaaagaaagaaaaaaactattaatttttctgaaccatgaacatggaatatttcagatatattttcaatttgtgtgtgttcactttattttttattatcaatcatttctggttttcttttagaaatctttcacttatttggtaatatgaaatataatttttagctattataaacaaaatgctttattgattttttgctgtttgcatttagcaatgccaccaatttttgtatgtaggtgttgtattctgcaaatttacagaattttttatcaattataacagtttttccagcaccatttattaaatagggaatcgtttccccatttcttgtttttgtcaggtttgtcaaagatcagatggtcgtagatatgcagcattatttctgagggctctgttctgttccattggtctatatctctgttttggtaccagtaccatgctgttttggttactgtagccttgtagcatagcttgaagtcaggtagcgtgatgcctccatctttgttgttttggcttaggattgagttggcaatgcaggctcttttttgttccatatgaactttaaagtagttttttccaattctgtgaagaaagtcattgatggggatggcatcgaatctataaattaccttgggcagtatggccattttcacgatattgattcttgctacccatgagcatggaatgttcttccatttctttgtgtcctcttttatttcattgagcagtggtttgtagttctccttgaagaggtccttcacatcccttgtaagttggattcctaggtgttttattctctttgaagcaattgtgaatgggagttcactcatgatttggctctctgtttgtctgttattggtgtataagaatgctagtgatttttgcacactgattttgtaccctgagacttcactgatgttgcctattagcttagggagatttggggctgagacaatggggttttctagatatacaatcatgtcatctgcaaacagggacaatttgacttcctcttttcctaatcgaataccctttatttccttctcctgcctgattgccctggccagaatatgtagaaagctgaaactggatcccttccttgcaccttatacaaaaattaattcaagatggattaaagacttaaatgttagatctaaaaccataaaaaccctagaagaaaacctaagcaataccattcaggacataggcatgggcaaggacttcatgtctaaaacagcaaaagcaatggcaacaaaagccaaaattgacaaatgggatctaattaagctaaagagcttctgcacagcaaaagaaactatcatcagagtgaacaggcaaccaacagaatgggagaaaacttttgcgatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttgggatggcgatcattaaaaagtcagggaacaacaggcgctggagaggatatggagaaataggaacacttttacactgttggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccaacccaaatgtccaccagtgatagactggattaagaaaatgtggcacatatacaccatggaatactatgcagccataaaaaaggatgagttcatgtcctttgtggggacatggatgaaaatggaaaccatcattctgtgcaaactatcacaaggacagaaaaccaaacactgcatgttctcattcataggtgggaactgaacaatgagaacatttggtctcaaggtggggaacatcacacaccggggcccgtcatggggtcgtgggagtggggagggatagcattaggagatatacctaatggtaaatgacaagttaataggtgcagcacaccaacgtggcacacgtatacatatgtaactaacctgcacattgtgcacatgtaccctaaaacttaaagtataataaaaaaaagaaaaaagagacccaattgttgacaaagttatgaaaaagatagtttttaaggagtctttaagtaatattgtattttctgcaaacagacaatttgatttcccctattccaaatttcaggacatttcttcttttttcttgtcaaattgttctggctagaattacagtaccatgtagaagtggtggaaaagagcatttttgtcttgttcaacatcttagagaaaaggctttcagtttttccagccttggtataatgcaagctgtgggtttcacatatctggactttattattttgagatatgtttcttgtataccaagtttgttgagaatttctataaggaatggaggttgaatttttttctatgactttcttaaagcaattaatcataaaataataataagcaggtcaatacaagatccataaattagtggaagctagttatttgcactgctgccatagagtaggatcactacacaactcatggtgttgatgggaaactataattctgcaataattaaagactagtgatttacactgggctctattgagagatttggttgtcaactacagaaatcgagatgaaggggcactgagaaacatttcgcttcatatcatctcaacttctaatatcaatttttagtactaatacagtcctattttctcagtatactgtctcacaggttatagtatatgtcttagaaaattaagggttgtttcattctaataattaactcagaaaaattcatttcctattatggatgacaagtgtaaattcatatcttaataattacccacactccaaaacactactacaggcaaaggcaagagaaaggcaggtatagatgagattctctgaggtcagttatgtaaatacccaaggactattgtctatgaccttgaatgtcactttcttcccttccatgagctacatccaggatattctgtgaatctgagagcgttgagcatgtttaattattttatctcactgccccttagtcttgctttctccagttgacaaccaaatctctcaacaataggcccagcgtaaatcaccagacttcaattattgtagaactatggtttcccaacaacattatgagttacaaaatgatactactttatggcagcagtgaaaatgatgaacttccactaacttatgaatctctgaatggctagcatggaggtgtgtatgtatcagcgcactgttctagaaatgttccgtttctgtccattattttatgtagtaatgaggacaacgtgaactaaagggagtatccatggccttataagcacagagaccacatccagtgcaggtgcagagcaaggctgcaacagtcagcaagttgctctctgaagagtcttccaattcccttgcccaaagcatctgctcattcatgggctgagaaaagggaagtcatgcatgcagtctactctctctacagagctgacaggggacacggacaacatcgattattcatggaattttcccataggaatgcagctgtgtgcacacacacataatacatttttaaatgttttttttatttatcctctccaattttaaaaaagtcatcaccttttctcctaatcaaagaggattttgaccagaatgcttggtgggagccccctgctctcccagatgcccacccttatttctcttgaagtgaagaacggcagctctcttgatttctactctcatcctctaggactaaaaccagaaggttccacgccccctgggtgaacatccaagaagaccctgtctgtagcagcaggagcctcaagccttgactgagagctatggtcctgaaatgagacagtgtcccccatggagagcacacgtggacgcccacaactgagggctcactgctcttcaccacagatgcgctcccttactgagtcctgagacctgagtgcaccccatagggtagggctcagaagaggggatgcaaatctccaccagctccacccttctctgtgttgaaaagccgagcatggggacctagttcagtgactcctgtgccccaccacatggagctttactccacgcttctcctgctgactgtcccttcctgtgagttcagtggtcagggaatccttcaggggtgaaacacctgttcttttctttgtgggcttcatcttcttatgctttctccacaggggtcttatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaaggagaccacagagacagagcccagggtgcctcttgtacaagaacccaggctgcttctcagtggcgctccctccccacctctgcagaacaggaaagtgtggctgagatgccatttcctgtcagggtctgggtgtcttatcctatctgactcagagccttgtcttcctccctcttctttagtaataaatggcatgacccctgttagtggttcatgcaagcagaggctgtatcctgtttgacaaagattcagcatgaaaggttcctgttacttgagccagatgcatcactgatatgtggccaccagtttcttagactcataccactttaagggaccaaatacaaatgtccatagcatatgccattcttaaactgcagaaatgatgtcaaagaagaatgtggagataagagagcaggaggaattatgaaaatctggatagcatcttctcttctagggtggaaggtatgctagtaaagtaatttaatgaaacaatcagacagatgcaatatgtcctcatcatggagtgtctcacatgggcagtgcacaaataaatttctaaaaattccataaggtagatgtgatggatgaggcttatttccacacagggagcccacaaatatccagagaagtaaaaaatctgacacttggaaagaaaattgcctcatcttgacatcagaaacccatttcaacatgtccgaggggcaatgtggaaaagaaatggaaacttcaaaaacacatttcttatgaaatgtctagctcatgtttgaacataaaaacagaattgtccatgattttagaaaaaccaacccatgacagcgagtcactacactcagaaacaccactgagtcaacagacttcagtctgtgagcaggtcagtactgaggccccaggtgaatcaaggctctcacgtacattgtacagaacccagaattgagccacacaatctataaccaagtcttctttgacaaactttacaaaaattaacaaaaaaatacaccagagaaattcaatatatgaaattcaatatacccattcaatatatggtgctggggaaattggttagccacgtgcagaagaacaaaactagacccccaccctcaacacatatatactcaacacaaaatgaattaaagacttacatataagacctcaaactataaatctactcaaacaaaacaccaggacaactcttctgggctttggcctaggtaaagaatttatgactaagaccccaaaagcaaatccaagaaaaaaatagacaaatgggacttaattaacctaaagcatttttcacagcaccggagtgaacagacaagttgcagagcgaaagaaaatttttccacaccacacctgtgacagggaactaatatgaagaatttgcaaggaactcaaactactctacaacaacaacagcaacaagaaccaaataactccgttaaaattagcagaggacatgagtagacattttcaaaagaacacataaaaatggataataaatatataaactacgctcaacatcactcatcatcagggaaatgcaaattaaaaccacaataagatatcatcttccaccagtcacaatgactattactaaaaactcaaaaatatcagatgttggtgaagatggaaaggaaagggaactcttagacactgttgatgaggatgtggatgaggacaacttctatggaaaatggtatggagatttcccaaaaaactagaaatagaactcccctttgatccagcaatcccactactgggtttactacccaaaggaaaataattttttatttccaaaagatatccacacttctatgtttatcacaaaactattatcaacagcacatatgtcaacctgagtgtccaccaacagatgattttataaaagaatatagcatatatgcacaattcaatactagtcagccacaataaggaatgaaactgtcttttgcagcaatatgcatagaactggaagacaacataattagtgacctaactcacaaacagagagtcacatgtcacatgttattatttataagtggaaggtaacaacgtgtccacaaggatatggagagagaaatgatggacaccagagacttagaaggatgggaggtggaaggtgggagcatgaggagacattacctagtgggtacaatgtacattatttgggtgatagtacactaaaagccaagaccactatggaatatagccatgtccaaaagtggcattcgtagtccttaagtttatacaagtaaatgtacacacaaataaaattaaaaatataaaataattaacagttgaccaatgatcttaaaagttgatttaaaatataatcaataaatgaaatgaatatcagttgaacctcattaaatttgaaaacgttttatactcaaatgactataagaaaatgaatgtcaagtttcagatgagaaactgtttgcaaatcattagccaccaacataagtataataagaaccctcagaactcaactgtgaaaaaaagaaacaacccatggatagaataggcaaaggtttgtgcagacatttcatcaaataagatgtacagatgacacataggcatataaatgggctcgcaacaggattttccattcgaaaaattcaaatcaagccgacagtgagacactactatacaatttttagaaattaagaagaaatacagataataccaatgctggtgagcatatcagggtccaagactctaaaacgttgcaaacaggaatgcaaaatgaaactgctactcaggaaaataatttatagttttttctaaaatcaaacattttcttaatatatgacctaaatatcccactcctgaatatttgtgtcagagaaatacaatcttagattcacaacaaacttccatttaaatgttcaatatattgtgctcacgtgtgtgtgtgcacgatagaaacaaaaagtaacatgaatgtctcaaaatttgaataggtaaaaagtaggaagtgtctattaattgaataccatcagcaataaaaaataacaaaatgactgatacacaaaccattacaggtgaactccagacatgatgctaagtgagagaagccagtctcaatgatcaaagggacacatctgtaagcaccacggtcatcctcaggtgtcagtggtttgggctgggctctctgtctctttcctgaccagacccagatgttgagctccgccacttgcagatggaaaattctactattttcaacaatgcactgaggtttgaactgcttcacagactgaacgaaacaaacacgggctcctttgaacagtgtgcagcatttgttccaaccacaagagaatgtctcccagctctgccccttctcagttttccctgcaagccagcagccctgcagtttagcctgcatctcccatgcatgcacccatctccttccaagggccttactccacaacctccacttattttgagtgcactgactggctttgaacttttccacattctgttgttattgaagttaggatgtttagagccatattaaggatcatattttatgactgaattccagtgccccctctctcctgggacagagcacgtaaccaacattctgcatgtggagacaaagatgagcttttttcttcctcagcctaggagatgagcgctcagtggagggttggatagaagcttcccaccttctcagcactccagttctggtggggagaacctctgccataggagcagagctagaaaccagggaccgaatgttcccagtgacactggacccagggtagagcctccatccacgagtggggctccatggaagaagcgagtctctggctctcagtagcttttgtccagaactgagccttaggatcgtgtactgtgggcagagtcagagggccaatgtcctggctcctggggaacagtttcctctgaagggagctgggtagaaggtgtcctgtcttcttggctacatctgtttgcagtggagtttacatcatgctgagttgggatgtggaaggaaggaggagcatcttagatcaattatgatggctagacttactgaattttgtagattttcttgaataaatgtttcttcacttgctgtatgctgtgagagcctttccaaaccctgtattttttcaaaataattttcactggtctcatgagggcatggattcattgagcccctcatgctatcaaagagaaatagaactttttttgttcactttttagagaacatccatgggttataaaacaatgggttgacttctcttccaaaactttacagataccgtcaattttcctcttgcttgtaaggttttatccagaagaatgctgtcatcattttttctgcttttttggaaggaatgccccttctactcacctcaaattgcctgcatgtatttctatttttctttggttttcagcagttttaataagatttagctaaatgtgtgtggggggagcagggagtgtcattctgctgttctgtgttctctgagatgcatggattcacggtttactctgtctccattttggggaacacaattagaaaaaatgtcagtgtgagcccagaaacaagcctccctgaagtgggcagaggaccacctgggggcgctcaggacccactgagcacaagagccagccccagggcaggtgcagacgggggttaagatctggtttcccgtcagccctgtggcttcctctccataaaacagttccctcgggggcacgtctctggattccttatcttgttcttactgtgaagtctctgaagaataaacatttgttgtaacaagagaaaaattttctcccatgcaccaaaggcagagtcacctacagtcaattagtcctgtttctcaatgttaataaactatcaatgtttctgaaggtacattgtacagaacccagaattcagccacacaatgtatagccaagtgatattgacaaacttaacaaaatatacaccagggaaaggacgtcccattcaataaatggtacttgggaaaatggatagaaacatgcagaagaacaaaactagatccccaccctcaacacattagtcaggtctctaaaatgcaggagtacatatctaaaatttattattttattgtgcatttttacgtgttccagaaggtgggagaaatttctttctgtgaagagcatcccaaagtcaggcactcctctagaacacgtgtttaatccttgtctttggcttattgatgagctctgttggctgcaataacttctgccatccgggctgactttgcatcatgtagaggagcaaattctgaatgaaagtttgcactactcaattgagtgcataacctacagttttgttactgatgtatgattcatcagagatgatatcagatcaaggatttcaatgagaatctaatctaaaagatgtaaacaaattttcctaatttagataaaattactgtgagcacactgctagtattcagccatgtctcctatcacattgaatctacactaagtttgacctaaaagctagcacttgttctcatgttccaatatgttatttttattttaatgtattcagattactatgtgttgctattttacccaaagtgaaggaaagcaattttaactgactgaaaatgagaaaaagcacaacctaatgaaatggaagtcaggacatgagtgtctccagccttgtctatttcaaaaattcacgtacgcagggggatttctttcctcaattttacacagagaaacttccaaaatgtttgtttcctctcccatggactctatcatcagtttctatgtcagtttgcttagaattttggcctccagctccaaccaatttggtgcaaaaacatgatttcattcttttttatagctgcagagtattgcactgtgtataagtaccatgttttctttatgcagtctataactgatgggcgtctaggttgattccctgtattaggtaatgtgaattgcacagagataaacacatgagtggatgtgtctttgtgttacaatgattggttttctcttgggcatatacccagtaatgagattgctgaggggaatagtagctctgttttaagttctttgagaaatctctagactgactgaattgttttctctgtgaatggtgataattatgtcaatatttgtcaaattttgaatgtattgtttgaagattgttatttgtcaatattacctcattaaaactattaaaaatggaagtgtataatttggtagaaaaggattaaaagaaagataaaaataatacaagaaaagtcacagactcctgaatccacatgtgaattagcactcagtttttctatattatttataaaaacactaagatacagccaaataatatcatgatatccttataagaagagtgtttcgtaaacctcactgggaatttctagctctgtcctagagttaatttagggagcagtcggatccagtcctgagcaacacaggccagacactgagacttaccacatcttaccagatgtgagctcttagacacgtcacatggcctctccatgcttgggggtttaccttcacatctgtaaatgaaggaaacattgactgccacagaacatacttcatgtgcatctatacagtagaaatgctaataagaattaattgtttatgaagtgtaatcactctgggacacagcccactcagaggcatcccttccagaacccgctatatagtaggagacatgcaaatagggccctccctctgctgatgaaaaccagcccagccctgaccctgcagctctgggagaggagccccagccctgagattcccaggtgtttccattcagtgatcagcactgaacacagaggactcaccatggagttgggactgagctggattttccttttggctattttaaaaggtgattcatggagaaatagagagattgagtgtgagtggacatgagtggatttgtgtggcagtttctgaccttggtgtctctgtgtttgcaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacacagtgaggggaagtcagcgagagcccagacaaaaacctcctgcaggaagacaggaggggcctgggctgcagagggcactcaagacacactgaaaacacggttaacactgggacaagttgctcaggaaggttaagggctggtttcctttcagagtctttgctgtttctgtatctaacagtttccccaggaaccctgtctagatttgcgatcttgatctgcttaaactgtctctgtgtcatttttcttacctgtgactttaggggagctgatcgtggacactccagtgtgtggagatttcctggtgacagcaattgtgtgttctgtctaagcatgtctagggccggtcatcaggaaggacaggaaggacaggctggaattcttggaaacagctgcacctgccatccaccagggaactttattgtcttctgttctgctaaaattaaatcaggcacaccaagtttaactagcactatcttcctagcttaagaaaattgatggcaggtttcaataacacctatattaaaccttcagagcaacacctacattagtgtctgatttgataattgagactatgttctagccaagcagacacataaaactggtgattgccatgcttagttcatatttcatatttatcaatagaatctggctggtgttataaacagatttgccaacacatgtgtgttagtgtttgtcttcggagaggcacattctatgactggattaagtttgtgtacaggttcctaaggaacctgttcatgcttttgagaggaaatgcagagggggtggaaggcggctggggaagctgaaggtatacgagggaagtcagtccctgagtgaaggagagagggaggagaactgggtagaactttcctaaacttctgtgctggtctaggaaggtccagcaagatcactgagtcagattcgtgtcaaagtttcccatcggggacccccgtgactcccagcagtggctctgctcagatcagcacagagctcgttcttctcctgagagtggagcagaggatgtggctccagcaccagccatggcatggacgtcagagagcagccccaggcacctgagtcgggtgcattgtgccccctgcaggtggacggagggaggtgctgactcagggcccacacgctgtgggttctatacagaacacacacttttacttcatttctgtggatgacatagaaacaaacatgcagtctattaacagcggtgattcctacatttgccccaattgctttattccttgattccgcagaatatcctgacgcagaattgtctttctctcgtggaattgcgacgtgtttaggacgtgtgttccccactttcagtgttctgctccatgaacagagatcctgagtagagtacagctgaccctccttccacactgttcctctcctccccacaggaagagcagataattacctgaggctgaatctgaggtgggatctgtcctctgaacctcagagcctgcagagacccccggctgcagattcatggagtcaggtgtttgtacatgtgggaaacttgagctgttcttttgtcagtgaacactccttagaactaattgtgggttcagaattaggacacccattgatctatcacacctcagctcattctgccactcagaatctccagaaattcaggaaatggttcaatttacatgtttgtgacacattgttctcatttcatttagttgtgagtttggtcagcaaaagtgctaccatttatgtgtcccaacctgatgaagctaacttgcttcaccagatgttgggagctcctgaattttatcctaagcccctctctctccacttcatgtgaaattcggtttgacctggaattctggtgtgttgatttagccagatttccccatactgagtgtctgattttcctggatatctgatcagtttccttgtccttcaccataacttgggtgacatctgatcaccctgggctaacttcaacaaaaatcctggcaggttgccttaagcaggatttacctcactcctgatgtttcttcttgattttccatcctttgccccaaccctgctgcatgcctataaatccccacgttctcactctgtatttggagttctgctgaatctctccctcattgcaaaatcccactgccctggtccctacacctatcatgagggccctggataaagtcttccttactgtgctgtagaaagtgtctttgtatatacattttttctttaacaaatctgcctttagtatttcctaattgatcaaggaacctcaaacattgaatgaaagtgaggttttccattttactaacatatgtgtatctgtgaatttcaatttcaatgtgtggtgtccagaagtcctgagcaccaacagttgtgcttctctgtccaattatttgattctgaaacctgggagtcatcccaacacaggtaaatatgtgattttttttttttttttggtttttactgtttagtgactgacttatttcacttacactgaagcttcatgaacacaatgatgaaaagtagagagaggacttgtttgaaaatgccagatttatggtagactttaccacccacgtgtgtctggaggtcttcttaaggttccaagaacaggacatttttcccacaacaagacaaggatgagaacctctgagctgtgaggatggaggacaggcagggccatgtgtggacaaggacgggctgctgctatgtccagggtgttctctactagcaaccactccatctccttcctcactctgtggtatttgtcagatgggaaacatgcctagaatttatctttgacatctggatggaagcccaggcaagaggcatttgacagcttattcgtgagcctacttctttaaggaatgccagatcccttgctctccttcctagttcttaacccctttaactcccttcccctcctgcacccatccactgcctatttacagccacgtccccacacccttcactgtagcaccattttcttgggctcctgggaaacacaacagctttggtttaactcacagctcaggcacactcacgggtcctttcagaggctctcaacttccctcctacagtccctcagctcctcctggggtcctaacttggccatctctatcctctctgctgagcctggccatacacaatccatcccatctggatatgtgtatagcagtgggttaactcagcaggcatgaatagttcaaaccctccacgttcctaaaaaggtaaataactaaaaaataaaaacaaaagtaaacctttgttcatttatggctgtctgttacctcctgggatgagatctccgagtccatgaaatcttacacctgataaaagtgtctgcagatgtctgcagccttgggacatgctgtacgagtttaatcacagtgatttatagtgaacgcctgcttttgttttgctggggagggctgtggtctgagtattgtggtcagttacccaggtgttccatagtctatgattcattccccaaacacagccctggacaagaaaactcaggggcactcccctgggtgttgacacttcacacatgtcatcttacctcatagctggagcattacacatgtgcagaaggctccacagtgggaggacccctgagagcttgtgcctggattctcctgagcttcactctttgtgccttttttttccatgtattttcaattgtatcattttgctgtaataaactgttcctgtgaatacgagttttcatgagtcctgtgtttttactgagttttgagcctgagggtggcagatgcaacttctcaatgcagttgtatcagaagaaggatttcctagagagatcctaagtgacacatggctgaagtattgttcagaaaacataagtattcaggtgtggaatggcaaaatctgatacttgggtggcaacagaattacccggtctgagacagcagctgaactgaagtagatgtctggagataaatgcaatttagaaacgataactcatactcccaaagagctggctcaatcgatacataaggaaaaataaaatgataaaaaataacctaaatatgcaattactatttgtgagaacatccgggagagtgattgcagggaaagtggcctgcgccgacctcagattttggccaatgtcatttctggctgatgggctccagggcactacctaagggagcaattatgctgcaatgacagacagaagcttcgcaagctctctccacccagaaggtggttcaggtggtgaagtgcggggactggtgagccacaaaacactgaaatgagggaggaaagtgagaaagtgaaaggcttttgagctttttctttagcttaataatttttgttaattattaacaaaataattggacaatgactaatgtaaaagtggaccgtgttttgagtcccttagaacggaggagaatgcagcggtcaatgttgtgcccagagattactatagaacaatagtaggtggttgaacatgctccaaacacaaagcctcttgttgctgatgggacagctgccctcgtctactgcacaacagcttctccaaagtgtgtttaccctgagcattgagattgcctttctcttgtaagtgaaaaaatcggaaaactccaaataaaggaggagttgtaacgctctatgtgtaagaaattctaatgtggatttatgataactgggatatgcatccacttatctttttatctgtaaaaattcatgggtgaaagtgcaattttgttacatggatatattgttcagtgatgaagtctgggctttgaggagagtcatcatctggatggtgtatattgtacccagcaagtaatttctcatcccacacaccactcccaccatccaaaccttccaagtttccaatatttattatgccacactctatattcatgtgtgcacattatttagttcttacttatatatgacatgtggtattcaactttattcttctgagttatttaacttaagatagcagcctacagtttcatccatgatactgtaaaatacataatttcattttttattattgagtagtaattaaatgtgtgtatatatattcacaaatatatataatgtatttgtgagggtgtgtatgtgtgtatatatgtgcatatatacatatacaacatgttttctttatccaatcattcattaaaaacacttagtttggtaccgcatatgtgctattgtgaataaggcaacagcaaacataaatgcagcatctatcgaatataaaattcatttttctttgagtcgataccaagtagtggatttgccgaattaaatattagttccatttaataagagaacttaccaacatctgtttcttgtttagtttagtttttatttttgactttttaataatagttattctgactggtttaatatggcttctcgttttgacttcaaattgcatttctgtgatgattaatgacattgattgttttttcatatcctggttgatgatttttatggcctcttttgaaaaataaatgtctgatatttgctcactttttaatgtggctatttgtgctttttgtgttgctttagtttcttgtagattccaaatattagctctttgtcagatgtagtgtttaaaaatatttttcgtcattctgtaggttttctgttaactttgttgattatttattttgctgatcagatgttttgcttcttatttgtattaagtccaaataacctattttggtttagttgtgtttacttttaaggtcatagtcatgaattctttgcctagcacaatgttcagaaaaacacttcctaggatttcatttatgactttcagactctcaggcctcccagtcaagtcttttatccatattggtgtaatgtttgtatgtagtgagacatatgggtccagttttattcttctgcaaatagctgttcagtttttcctgcacaatttattgaacaaggtgacattttcccagggtatgctttttgtctggttggtcacagtcagttggctgcaggcacatgactgtatttctggaatgtctattctgttccaagtatctatggttctctggttgattgttacttgtgtataaaaatcctactggcttttgtatgcttttttatcctttattctaaaacttcactgaattaattcatcaattctaggagtacttctaaagaatattagtttttaagtacaaaatcatattgtcagcaaacacacacaaaaaactgacttcttcttttccaatttgggtgcctttatttctttctggtgtcttatttctctggctaggatttcaagttctatattgattaagagtggtgaaagtgggcatccttgacgtgttctgagtcttaggaggaatactttcaacatattgctactcagtataatgttgtatgtgagtttgtcatatatgatttttattaatttgaggtatgttttccttctattctaattttgttgagggttttttatcataaagaaatcctaaatgttatcaaatttttttttctggacctattgacatgattatatgttttttgtttatgtggtggatcacagttattgagacatgaacgttgaactatccttgcatccctgaaatgaaacttagcagattgtagcatattatctttttgatatgtagttggacttgattttcttgtgtcttgttgaggatttttccatctatagtcatcagtgatattgatctgtagtattcatttttgggtccttgcatggatgtggtatcaggctattagtggctttgtagaatgagttagggagaaaaaccctctcctcgtttttttggaaaaagtttcagtagaattactagcagatctttttgtatattggacagaattcaccttttaaaataatatgctttacggctttgatgttgagatttttttaaattactgcttcgatgtcactaatttttgttggtcctttcaggatttttatttcttcctatttcaatcttgggagattatatatttccagacatttatctattcaccctaaattttctagtttatgagcctggagatgttcatagtagactatgttgatcattatatttctatggcatcagttgtaatcttttcttttttgtttctcattctgcttatttaaattgtctgtctactttacttgcctaatctagctagtggtctgtaagttttgtttatcatctcaaaaacccaatgttttattgtattggttctttgtatttcttggttcttaactttatctagttctgctctggtctttgttatttgttttcttctgctgtgtgtttggtttgatgttgtttttctagttatttgatacgtaatgttaggttgttaatttgtgatctttctttttgatgtggtcatttaacattataatcttatcccttagcacagcttttgctgtaaaccagaggttttggtatgctgtttctctatttttattcatttcacaacatgttacaatctttttaaattttatcattgacccaaagttcattcagttgcaggttgttaaattttcattgtgtgtgtagtcttgaatattcttctagggtttgatttctggctttatattactgtggtctgagaagatatttcatttttaaaaagttattgagtcttttatttctggcatagtatataatccatgtttgaaaatattccttgctaatgggaataatgtatattctgcagtcattaggttaaatgttctgttaatgtctgttaggttcatttggtctagagtccaatttaagtctagtgtttctttgttgattttctgtcttaatgttttgcctagtattatcatttgggcattgaaatccatcacaattgtattgttacctgtgttcttccttaggtctaatagtatttgttttatgaacatgggttttctggtgcagagtgcatatatatttagaattgtcatttttaatcaatcattttatcattatataatgactttctttgtctttacttactggtgtttatttaaagtttttttatatgatatagatagtcttgcttgcttttggtttccaattgcatgaaatatattttttcaccctcttgatcttgaatctacgtatttttaccaattaagtgagtttcctgtcagcagcataaatttcaaaactcttttttattctttccactaatctatatattttaggtgaagaatttaactcatttatattcaaacttaatacagatatgtgaggtctggcttctgttgtcatgttaattattaactagtggctttgtagtcttaattgtgtaatagttttatgagtgaattttataattttgtgttgtttatgatggtgagtactgacctattgcttccatgtctaggtctcccttgagcatttcttgtaggtgcggtctggtgtaaataaatgtccttggcattttcttaccttagaaatactttatttctccttcatttatgaagcttagtttagaaggatacaaaattaatttctgacatagaattttttctttttttttctttaagtagtctgaaattgggagtccaatctcttctatcttataactttatgctgagaagtacactgtcagcatgatagaatttcagataaattattagacacttttctattgtgaattttaggatttttttcttcctatttactttagatagtctgaggactatagatcttggtaatgtctgtcttccagtgtcttctcatgtagttttctgaaccacttttatctgcatatgcaaatatctagcaagactagtgatgttttcctcaattacttcatcaaattggtcctctaaaactttttactaattttctccctcaggaatatccatgattattggctaagttgttttacataatcctatacttcccaatgattttgttcatttttttgttattttcatctgactgggttaatgcgaaatatctgtctcttaggtttgatgttctttcttctttttagtgtagcccattgtgaaagttttaaactattttttgtaattaaaattcaatgaagtctttactccctgaagctttatttttaaaatattaaagtcttaagtaaatcttgaattgttctgatttttttttttttttttttgacacggagtctcatactgtcacccaggctggagtgcagtggcgcgatcttggctcactgcaacctctgcctcccgggttcatgcaattctccttccttagcgtcccgagtagctgggactacaggcacacaccatcacacccagctaattttttgtatattgagtagagacagggtttcactatgttggccagactggtctccaactcctgacctcgtgatctccgctccttggcctcccgaagtgctgggattacaggcataagccaccacgcccggcctgagttattctgatttatttgtgttggttctcaaatttcttttggatttaattgagattccttgaggtcaacattttgaattatttatctgacatttcaaatatatcatgttgtgtaaattctatttctggagagttaaggtgatatccggcgtcttgtaattgtgttttttcatacttccacaattgcttacctgcttgcttttcattggctaaactatctcttactgtttttgaattcattttgattttcatgaaaatttcattccctttagaatgtgaatataacgtatattatgtgggtcttttgatttggttcttggtttactcattggcaaaggctctgtaagagtttcttgtatatagatagtcattatttagtggctttctgaaactatggttgtagtaataatctactgggcctgtgagcaggctcactgcctcctgcaggccctaaatagtggaggcctcagaaaccatttcttatttgcaatgcacttgtttcagcacattttatattgggatgttaagttcacctacacattagtatgtgtccttacagatttgagctgactgtggtagaagcagatgagtacatgcttgatatctgtacacagggagaagctctctgttgcctcaggcgatggactggtctatgaagtgcacagtgacttgagttctctgatcagcccctgagtgggggatgaagctggacagagatgagccaccgagcctggcaagcaaaagcgccagccttgatggaaatggcgagctgaggggcatctactcagtgtggtttcttttgttattaagagctttagtgtggtggctttttcaaattcccgttgtagtagtaacatactgagcatgtgagcaggcccgcggtcttttgcggggttggaatcacagaagtattgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttaccggtggttaaagtgggaaatttgtcatgttccagatcttagagaaaagacttttagctatttctcattcattataatgctgcctgaaagtctctcgaacataactttttattatgtcgagatgtgttctttctatacccattttttacattttttttcctgaaaggatgttgagtttcatcaaatgatttttcagcatcaattgaaaaaaactatatgtcgattaaagatctaaatgtaaaatctaaaactataaaaactctggataataacctaggaaatacaatttaggacattagaactggcaaagacattatgaagaaaatgcaattttaacaaaatcaaaaaatggcaaatgagccctaagtaaactaaagagcttctgcatagcaaaagatactatcaacagagcaaacaggcaacctaaagaatggaaaataaaatatttgcaatctatacatctgacagggtctaatatttatagcatacatgcaattaaacaaacatacaagaaaaaaagtgcccaaaggacatgaaaagacacttataaaaagacctacatgtggccaacaagcataggaaaaaatgctgactatcactatcattagagaaatacatattaaaaccacaatgaggtaccatctcacatcagtcagaatggctaatcttaaaaaaataataacagatgctgctaaggttgcaggaaaaagggaacatttatacacttctagtgcaagtataaattagttcaaccattgtggaaagcagtgccatgatccctccaataacctaaaacagaagtttcatttgacccaacaatcctacaactggacatatacctaaaggagtataaacgtataggttcattccagcactattcacaatagcatagacatggaatttacctaaatgcctgtcactggcataatggatagagaaaaatgtgatacatataaccatggaatactatgcagctaagaaaagaatgaaatcatgttctttgtaggaatatgatggaactggtagtcattactcttagaaaactaattcaggaacagaaaaccagatactatatgttctcacttattttttggagataaataatgagaaatattctctcagggcctgagtcttccatattcaaaaaaaaattctaaaataagtgttcaacaagttgccgacatgcctttaaatatcctgtttcatctggaccccttatatcactcaataaagccatgagaactatatttaaaagtgggattctatgataataaataacttaacagtaagaataggaaggatatggatggttttactaatttaatgggtacataactgtggtatacactatattcctatgaataagatattctgatttcagagctaagtattgtttcctacgttgtgtgtgtgacttggttgtgttggatttgagagtgtagcacgtgcacagaccatgtggatcagaaatccacatgtaaagatgacaatctatggatgtgaactacaagtatgtaagtacttcaagtaattctatttaatggagtttgaaataaaactcaaacttattcaaaacactaattacttggtatttattttgagatctatgagtttatcaagaaattcaaattcctatttctatttaaactcccgattcctactctcagtgggagggaaaactcacagccaatcacacatcacaggacaaatctgtaaacgaagagtcattcctctgaaggtcctgggtgttcaggactctcaggcaggtgctgaggaccctgtcttgggagtgcccagcagatctcagaaccctacatggggcctgctggacactcatgtgggataactagtcgccacttattcagagttaccagtgagctttgactgttccgaatgggaccagcatggagtcaaggtgcctgctcaatgtcagagacagcgatggtctcagaaacaatccaggtaatctctaggccaataaaatgtggattcacagtgagaagtacatcctggaggtggagcttgttcttcagtgggaagagtgctgtgcacagaaagcttagaaatggggaagggggtgcgtttcctcaggcaggattagggcttcgtccctcagcgtcccactcttgtatggctgatgtggcatctgtgttttctttctcatactagataaggctttgagctgtgaaataccctgcctcatgaatatgcaaataacctgagctcttctgaggtaaatataggtatattggtgccctgagagcatcactcaacaaccacatctgtcctctagagaaaaccctgtgagcacagctcctcaccatggactggacctggaggatcctcttcttggtggcagcagctacaagtaaggggcttcctagtctcaaagctgaggaacggatcctggttcagtcaaagaggattttattctctcctgtgttctctccacaggtgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggcacagtgtgaaaaaccacatcctcagagagtcagaaaccctaggggagaaggcagctgtgctgggctgaggagatgacaggggttatcaggtttaaggcttttttgaaaatgggttatatatttgagaaaaaaataacaatagaaacaagtacacactctaattttaagagatatattcaattcaagaattgtagaagccgaattcacagtgggaaaggccacactcaataaagttgataaaaacattccaggaaggtgctactgtgaacaagttttcaaattagatgaataaataatttggagcaatgttatttgatcatgaggtgagacagtatgattcttaaaaagtggaaaaaattctttcaaatgtttctgccactctttatcataaaattaattttagagcagttttaggattacaatgaaattgcacagaaggcatgagaattcccatgactccctgccctacacaggcagagcctcctccactatgaccatccagcaccacagtcacaaatcagttacaatggaggaatctccaaggacatttgattctttcttttttggtgatgccctaatataacaagcctaatttatctcggaataccacaagttttgttcagtggatttctaggaatcatattagttagagggaaagttggtgaggctcttactatttgaactcattcttccaaaatccacaaaacatatattaatttaaagcttatcttacttctggtttacaggatccttcccagagagtaagatttttaagattttagaggcaggttcatgtctctaaaaggccagcaagttctggggaatcccataatgaacatcctttcatgggaattggagaccctggcaatgagagactccatgtataatgccctagagttggattagatgcactgtgagctcttgggtggtggttctgaaaaaggtggtctgtgcagtaaatgcaaacacatgcacgggacacaggaaggagcaaaagcttccctttacaaagtgtgtgggcacctggaagaaaccctcacaagggcacgtctcacccttaatgactgcacattagccaggggcatgatcatgattggtcttacaaggaaagagcaccactgaggtcataggttatgaaaatgtcatcctccagctgagaaattccatctgctggcatgtgcgtgtcaaccccgtggagggtgcactctgggagttgacgagatgcatagaaacctcctgtcatgaattatcgtctaccacacagtcagaatcaacctgtgctccagaaagagatacatgcctgtagaaataaacagagcttaaggattttcttacctgctgaatatagtgcccaaaaccacactttcaggaagattagctcagaaatgtttacaaagtgactgaagggcagtggcgggtgaggtgatgggacagcctcagggctgcacttgaggagggctccctctcccatgcaggcttttcctccaggagctgcatcaggaactcacagaggataagggagaattctgagaacatgctactgtggtactgcctagagaggaaggataaatgatgacaaatacatctctgagtaacatatgggcatttgttcatgaaaactgttttttctgaaagcttatgaaggtcttgaaatgcccctgattagctgaggacaaacatttaaaccctccttccacagggagttcaagcaggctggatgtgtcctgctatggatgatcttccccagccccttcctcttcccagctcatccctggctctctgtgtaaaaagttttcatcagtggaaggtggttgatgaagtgaggtcttcaatttcctcatcttctctgtggtcatgttattttcctcatctgaggtttaaaaactcacctgcatgcagcacatgacaggctaaaatctcttgtggacaaaacagtaacaaaggcacccaccatggttgagcacccgtgttgctgacagtgaccaccaagggtcaacgtcctcttcacaatcctgtgtcagagcagcacttgagtgatttcactagcaacttcccaggagaatcggcttaaaactacttgtcgcattttccatacagatataacacatctattttcctgaagaaatagaaagagctgaatgctgaatacactgtatgtctgctggttctgcaagtttgtgactatcactttctaatttctgatctgtgtggaccaccctccagatttttctcactggtgtgaccagccttctggatgtcaaatataattaactttttttcatataaaagtcaacacaagctcctcatggtttcggtgctcactgactactttaaacttacacaatatgtttctttattagttttgttttctggtatctctactcagcatcttcaacacacccatgttaagatgcttgtacaggtaattgttaattttaaatttactggtgtttagtttaattaaataggcaggcaatagcttagaatttagaaacaacaatgtaaaggaaaagtaaatgcaataaaatttaacataagaaaaccagcagctgaaaggaagggaaatctattctgccacctaagagggtatggtgacctcatagtacaacgaacttctgcagtttaatcgatactgctcacaagtgatagcattctctctctttatatcagagcattccctaacatgtacaataaagagtgagcagatacctccaaccagactgaccagtacctctccctgagtgcctcagctgatagagatagacatcacatttgtctaacaaaataattacaggctgtaaggatacccaccagtcatatggagataatttgaaaaacttagtcaaagcccaaaccttataggtagtcatttatacttagaagaattaactcttatcttcacatgtatttttcttaatcatagagaagctactagagtcactgtccaagttactgaatatcttattcctagaatgagacattgcacaatgtgttctgacatgagggaatgtagctatagttaaaggataggagatgtgatcacggaaacacgagtctgcgatccagcagttctttctccctcacatttgcccagaaacaaagaccccagcagaaaaatggaagggttgacttcagtctccaaagtatgatgtgagatatacgtcaggtatttcatgccattgttttatagtaggaaatttaatctctaaagaaggtcattttcaggataatactattctccaggatacttaaatgcccgaaaacagagagcgctacagtgcccagtgtccaggagctacctggcacgggtctggaaaccagtggacagaaatatcagtttctcttaccacatgtatgttggaaatttgaagaatgtttctttccttcttcgtaatcataggctgcaatggactggaggtcccagtacataagaggaaatgtgtctccagtaggaacacaattagtcccataaaataattgtgctcacactgtggtgcccacactgttggaccagctgactgagaaagtgttgtaagagctgcagtgtctactgattcctatcatatttggggctacattcgcagctaccaacggaaagagagagaagtaaaactggcttaggtagagtctatggatttgctttctttccttcaaactgaagtaaaaaaaaaaatcacatcaactaaaatggggacgatgatgaagtgatcaaggacaagagccactcagtgttttaggtgggttttaacctaaagtcccacaacatgtgagaacctgaactctggagtccggggcatctctggggagaatgtggaaggtgggcgggaggaaacagtgattcatgtctagggaaatttcagggctacctgctctgggggaaaggaaagcctgagcctctccgacagtgtcctctgttaaaattgttggctgacttattgtattcttcaacaccaatatttttttagtcctcttttaattttgtttttattattatactttaagttctagggtacatgtgcacaatgtgcaggttagttacatatgtatacatgtgccatgttggtgtgccgcacccattaactcgtcatttaacattaggtatatctcctaatgctatccctcccccctccccccacaccacaacagaccccagtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtctatcattgttggacgtttggcttggttccaagtctttgctattgtgaatagtgacacaataaacatacatgtgcatgtgcctttatagcagcatgatttataatcctttgggtatatacccagtaatgggatggctgggtcaaatggtatttctagttctagatccctgaggaatcgccacactgtcttccacaatggttgaactaatttacagtcccaccaacagtgtaaaagtgttcctatttctccacatcctctccagcacctgttgtttcctgactttttaatgatcgccactgtaactggtgtgaggtggtatctcattgtggttttgatttgcatttctctgatggccagtgatgatgagcattttttcatgtgtctgttggctgcataaatgtcttcttttgagacgtgtctgttcatatccttcacccactttttgatggggttgtttgttttgttcttgtaaatttgtttgagttcattgtagattctggatattagccctttgtcagatgagtagattgcaaaaattttctcccattctgttggttgcctggtcactctgacgatagtttcttttgctgtgcaaaagctctttcgtttaattagatcccatttgtcaattctggcttttgttgccattgcttttgctgttttagacatgaagtccttgctcatgcctatgtcctgaatggtattgcctaggttttcttctagggtttttatggttttaggtctaacatttaagtctttaatccatcttgaattaattttcgtataaggtgtaaggaagagatccagtttcagctttcctcatatggctagccagtttttccagcaccatttattaaatagggaatcgtttccccatttcttgtttttgtcaggtttgtcaaagatcacatgcttgtagatatgcggcattatttctgagggctctgttctgttccattggtctatatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagtagtttttcccaattctgtgaagaaagtcattggtagcttgatggggatgtcattgaatctataaattaccttgggcagtatggccattttcacaatgttgattcttcctacccatgagcatggaatgttcttccatttgtttgtatcatcttttatttcattgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgattttttcacattgattttgtatcccgagactttgctgaagttgcttatcagcttaaggagattttgggctgagacgatggggttttctagatacacaatcatgtcatctgcaaacagggacaatttgacttcctcttttcctagttgaataccctttatttccttctcctgcctgattgccctggccagaacttccaacactatgttgaataggagtggtgagagagggcatccctgtcttgtttcaattttcaaagggaattcttccagtttttgcccattcaatatgttattggctgtgggtttgtcatagatagctcttattattttgagatatgtcccatcaatacctaatttattgaagagtttttagtatgaagggttgctgaattttgtcaaaggccttttctgcatctatcgagataatcatatggtttttgtcgttggttctgtttatatgctggattatgtttattgatttgcatatgttgaaccagccttgcatcctagggatgaagcccacttgattatggtggataagctttttgatgtgctgctggatttggtttgccagtattctattgaggatttttgcatcgatgttcatcagggatattggtttaaaattctctttttttgttgtgtctctgccaggctttggtatcaggatgatgctggcctcataaaatgagttggggaggattccctctttttctattgattggaatagtttcagaaggaatgctaccagctcctccttgcacctctggtagaatttggctgtgaatccgtctggtcctggacttttttaggcaggaatttccttgtcctaataagcccaggagtgctacaggagaccagggcttatttcatccctcagcggcgaccgtaaaagacagccatcccgaaagcagccatttcagaggcctcccctcagggatgcattctctttctcagggatgttccttgctgagaaaaagaattcagtgatatttctcccatttgcttttgaaagaacagaaatatggctctgttccacctggctcaccagcagtcagagtttagggttatctcccttgttgcctgaacattgctgttattctgttcttttttcaaagtgcccagatttcatattgttcaaacctacatgctctacaaacaatttgtgcagttaacgcaatcatcacagggtcctgaggctacatacgtcctcctcagtttacaaagattatgggattaagagactaaagtaaagacaggcataggaaatcacaagggcattgattggggaagtgataagtgtccatgaaatcttcacaatttatgttcagagattgcagtaaagacaggcataagaaattataaaaggattaatttggggaactaataaatgtccatgaaatcttcacaatttatgttcttctgccatggcttcagccagtccctccgtttggggtccctgacttcccacaacagtttattaactttgtatgactaataatgtaaaatgttccccatatttttagcaatgttttacttatttgtgaaaggtgtgtttattaatttttcattttaaggtgtcacatttatctttcttgtttctgggatttcattctagtagatatagctgaatgcattttaacaattattgtaatcatctcacattttatatttggatttgcatatacattttattaagattttgattttgatataaaatattttcttacaattgtctcttttctatttttatgagataaaattaatgtatgcataattgcatacatcttcaatgtacagtttcagggtttctgacatatgtgcacacatttgtctccagcacctaagttaggatgaggagcaggtcagtctccacaacaagtgtcctcttcagtgcttccagtcagctctcacataaggatttttatttaatttcaagttttcattttcactaatcatcagagaaatgcaaatagaaaaacgttctggtttctgtcactacagttcaattttttcctgttttgggcatcacataaatggaatcaaatgttatagttcattttttgtaaggggctacttttgctatttgtgaggttcattcatgtatttgcatctaccaaggttttgtcatcatatatatacacacacacacttatatatgtactaatgcacatataggtatttcatatctcaatcagtccattacgttaataaatgacagtttattaagtaaatccattcattaagtgaataagtgacaaaaaatatatctattttcctgttgatggaatttagtttccaaaataaatatcgtaaacacatctgttataaatatctttgtacaagttcttctgcttatatctcccatttttattgataaaatatgtataaatataagtatgcattataacttttcagctttatggagctataactgacaaataaaattgtatgaatttaaggtacaccacttgaggtattgatatacatggggaaatattcatcgtgatcaaagtaattggcatgcctatcatctcagagaatatcattttatgcctttaatttattgtgagtctgtgatgaaaacacctaagatctactcttctggaaacagataagtttataatataatattcattagtatagttacattgctgtatgtttcatctccagaactccttcaacctgtgtatcagtccattctcaaactactttagagaactacctgagactgggaaatacatgaagagaagggagttagttcactcacagttctgcaggcttagcaggaacttatagggaggcatcaggaaaattacgatgattgtggaaagtgaaggggaagcaaggaccgtcttcacatgctggcaggggagagagagaaagagcaaggggagatgcgccacacttttaaacctcaagatcttgtgagaactctaacacaagaagagcaaaggggaaagccgcctccatgattcagtcactccccatcagacccctcctacaacacttgaggatgaaaatttgacatgagatttgggtggaaacgctgagccaaacagtatcattatacccggccactcacaaatctcatatccctctcacattgcaaaatataattatcccttctcaacagtctcccagtcttcactcaattcagcattaacacaaacttctacagtccaaagtctcctctgagacaaggtaagtttcttggatgtataaccctgtaaaataaaaaacaagttagttacttccaagctaatatgagatgaatgcactgggtaaatgttcccattctaaatgggagaaattggccactacaaatgggctacaggccccatggctagtccaaacactagcagggcagtcatcaaatcttaaagctccaaaaaaatttccttttactccatgtctcacatccaggacacgttgatataagaggtgatctcccaaggcctttggaagctccacccttgtggctctgcatgttagactccccatagctgctttcataggctggcattgagttgctatgtcttttccaggcacaccatacaagctgctggtggttctaccattctggggtctgaaggacagtggtcctcttctcacagatccactagacagtgcccaagtggggactctgtgtgtggaatccaacaccatattttccttctacactggcctagtagaggtactccattagagctcagcccctgcatgagacttctgcctggatatccaggcattatcatacatcatctgaaatctaggaggaggttcccaaacctcaactcttgcctcatgtgcaccagcaggctcaacaccacgtggaagcaaccaaagcttagggcttgcaccctctggagcaatggcctgagctggaccttgaccccttttagccatggctggcacaggacagacagggatgcaaggcgccatgtcccgaggctgcacagagcagtggcgtcctgggcttggacaaagaaaccatttttctctcctgggcttctggacctgtgatgggaggggctgccacaaagatctctgaaatgccctgcggacattttttcccaccggggtccttgttacttatgcaaatttctgcagccagtttgaatttctccccataaaatgaggttttttgtctaccacatggtcaggctacaatgttttatcaaacttttatgctccgcttcccttttaaacgtaagttccaatttcagaccatctctttatgaatgcacatggcttatgttttcagaaacagccaggtcaactcttcaatgctttggtgcttagaaatttcttctgccagatataccttaaattatgtctctgtagctcaacatttcacagatctctagggtagggggaaaatgccactagtctttttgctaaagcatagcaagtgtgaccttcactccagttcgcaataagttcttcaccttcatctgacaccacctcagactggacttcattgcccatatcactatcagcattttggtaaaacccattcaacgagcctctaggcagtttcaaacttttccacatcttcctgtcttcttgtgagcactccaagcttttccaacctctgcccattacccagttacaaagtcacttccacattttcaggtatcttaatagcagtatcccactcctggtgcaagttttctgtattagtccattttcacattgctataaagactacctcagactgggtaatttatgaagagaagagttttagttaactctcagctctgcccgctaaacgggaagcattattgggaggcatcaggacgaacaatgatggtggaaggtgaacgggaagcaagaaccttcttcacatggtggcaggagagagagagcaagtgagcggggaggtgccacacttttaaaccatcagatctcttgagaactttatcacgagaacagcgaagaggaagacaatcccatgaccaaatcactttatcttaggcccttccttcaacatgcagggtctacaatctggcatgagatttgagtcggaacacggagccaaaccatatcaaccttcataacgggaagtttttaccctttgaccaacaatacccaattttttcctcctcccagcccctgcgacctactattctactctgcttccaagagcttgaatattttatactttagattctatatataaatgagatcatgcagcttttgtctttctgtgtctggcttattccacttagcataatgttttctatttgttgcaaatataagaatttctttgtttttaaaggctgaataatactcagttttatgtaggtataagccacattttatctgttcattcgtagatggacattgactcgttttccttatctagactattatgaataatctcacaatggacatagatttgtcacactcagtttattttctctagatgtatgctcagaagtggggatgctctatgtccagttcactgagtaatcttcatgttgtttttcatactggctgtaataattcacattttgttccaaaccatacatggatacctttgtaccacatattcaggtctttgtgtaactcttgaatccatttttagctgatttctgtgtattgtgtgaggtgagttctatctatttcttctgcatatggatgcccgtttttcacaccactcgttgaagagactgtcctttctctactgtgtgtcttgggaacttgacaaagatcagtttattaggaagaaatgggttggtttccaggttgtgtttaatgttccattggattatatgtctgtttaaatgccagcattataccattttgatttatatagatttgattttgaaattatagattatgatatattcagctttgttatttatgcccaaaattactttggctatttgaagtcttttatatttttatataaattggagctttttaaaaacattttgtaaaatcatgccatggagattatttatttattttattggcatatagtagatatacctattttatgggaacatgtaatatattgatacatttataaatgtgtaaagattagtgtaagatttacatatctgtcacattaaaaatgtaccctttccttgtgctgagcacatttgaatgactcctttcgctattttaatgttgtgcattagattattattaactatagtgaccttactgatctatcaaacatttaggtcttatttctcctctataaatgtatatttgtatacagtaatcaacctctccttatctccttctctcttctatccatccaggattctggtaagcaacagtctattctatcttcaggcgatccagtattttagttttgatgtaaaataagaagatgcaatatttgtctctcttttattggcttatttatcttaacataatgacttccagttccattcatattatagcaaatgacagaatattgggtttcatggctgaataatatcctatcgcatacatagattacatttactctatccatttgtccacctacagacactgaggtgctttcacatctgggctattgtgaaagagctgcaaagaacatgggaggggacatgccttcatgaggtggtggtggttttatcttctttagaacatacccagaagaggatttgccaagtcataaggtatttctgtttttaatttattttggaatcttcatactactttgcacatagtggaaacacaaatggagtaaacattaaaaaagcagtttcggttttgatgtataatccagaaacaaataatgtttgaccatgattctcattaggagtctctaatggatctggtggaaatgcaggaagttttctaaccttgttcaggaaattatgagtttgcacctttttctttttgaggcttgaaattggcatgattcatgatgcatactgttgggaggtttcagaatgatatggcaaaaatcataatgaaaaggcaagacagagagagagggagagagagagagtcaggcctagaaagagaaaaaataattttctcaacaggagaaagtgctggatatctgtatcagtgttgagttttgctcatagacacatctgtaccgagtgaggaaccatgaagtcaagggaggggtctagaacttgttcaagtgaagcatcagcatatttctcacaggcaccaatttccaccacatcacaagggtgatgcatttttgaatgccattaaatatgagttcacagtcagtaatcatgtttccatgaaattcagttaaaataccaagggtgtgtccagatcactcatgcacaaatacacaaaatttgctttttcatgtgtggctatctagagacaaagtgcactgaggagacttcagcaggttacagagatttgcttaagtttggaaaaccatagaagagtgcctttaagtgaaggttggtatataaattaaataggtcaaaatcccctctatggagtagcgttccaattgtgtggaatttttaattccttattcagttgtaaaacataatccctaggactgactccgtggagttttactgctgtgttgacaaaaatatctaacaagcttccttccagtgtttcaagggaagtttttctctaaattttttccaatgtataaattttcctggctaaagatagtaaaaggctgttaaaaacacaactggaatggcagctttaatcttttgctgattgataggagtgagcataatacatgaatctctttgagtgttctgcctcatccaaatacaataggtcaaaggctagtactggaggtaagatttccaaatgtgtttttttccagctaccaagtcataggaaaataacagatacatccttgagacagaggaccataatgccacaatgctggtaggagtacatgtagacaagggagttcaagggtttcttaaaactgataattttaatgtaagaataccattcttttaaacttatgtggaagactgtgggaggttataacaatgccatattttagtatcagccctgcctcacagaatcattttataacagttcctttcatgagtgtgcttcactcggttcatgcaaaaacctggcagatcacaggctaaaaacagaaaatatagaagcttttaatcaactgaaagagctgtagcctttgtcaaggaattattggaagacacagagaacacagatagatgataaataaaatacattcatatcccgttaagtgtggaaattgaggaaagtttacataaatgtgtccaagtggcaaactgtttatttaatctggtaaccaatttttctataaattgtagagttgaaatgcaacaaatacatatttgaaatgatctggcacaaattaagcaaatatggtaactatgtattttcactcatttttatttaagatcagcggctcagcattgatatttttgataatatctgtgactcagcagctttaccttttgaggatatgatctggtatggcagttttcttagcttcaatgttacctctttttgcattgacttccacctttatatctgccaggaatctggggaaaaggagtgcctgtaaacgttccctaacttgcccattttggtgggttttccagaatgtgtgagatgctttttttttttttttcaaagcatcctgaacccatgcactgccctgaaacatgtttatttcctagtttaacaaattggcacttctaataaatgcaatctcttctgccatctgtgctgattttacatcagatagaggactgtgttctaaaggaaatcttatattagtaagagcaattttgtcattaacctagagttttattattgaggtgtgattcataacatataatattaggtagaggttctcagtggcagtgtctaaatctcttgggtgtacagtgtcttccccgttaacatgaagcatttacgagcacagtcatagtttccagccatgcttctccctgtctcacaatcaccacaaactaactatgaccacaactggaacttggtgagttattctttaataagttttaagtttgtctttaatctttatgcctctagattattatgtgagacataatctttatgcctctagattattgtgtaaagctatttcagaagaaagttaaaaagaacattttaactgactaaacaacacaggaaatcattaataaaatgcaaagtgtagatgtgagaggctccaggcctggataatgcaagagttcatgtatgcaggcagtttctttgcccaattatactgatacaaccagcatgtcagcttcatgccccatttgactcctattatgcaagcgcatggaaatgacatgctcaagggtcacacacagatatgaaaactggtgggagcaggagaggagacgactctgcacttctcctctgaaggaccaggaaagcctggacagaccatctccccagcctccatgactgcgcgacgtgcccacatggacactcatctctgacaagataagaagactccattgatgaggctgaacattttatgatttaaattactagagacttacattgaggtttcaataactaatttttataacccaaatttacttacccccatgttgttacctctttcttcagtgaaaaattgcttttgctgtaattgagttttaggaagattcccagtgttcacaactgagcttccaagagagtgttgagaacaaaaactgaatgagggcagagaaacccatctttactgtgttcaccactaaactcaagtggactcggcactgcctttgatcactgttgcttctctgcagagttcaggtttgtatttctcacaattctaacacagactctccctctcctcaaaggtttggcctccactggctgtaaggtcacactgttctgaatttcttgtctgaaccgttttatgagggtggtgatgagccatttaatggaaattttatatcatctcagcatgaatcctatgggcggtcacgaattattattctgattatggtaattgatttttctcagcatattcattactagtgatattcaaaaaccctttttatttaaatctttgatgcttcatttttgttgctatgacactttttcttctactgagtcttcccactagcattataacatgacctaatatccagggctcagttgttatataacaaccacatatgtcaaaagctatgcattcttttcacagcagacataattttctcttttctggagatgaacacacactggctgagctacccccactcacaagaacatatggaaaatcatgacatttttatttacttgactaataaattatgtcattctctcttcaaattctttatcccccagaatgccatgacaaactcttctgcatctgttcaaaccataaactcagaaaccacatggtgagtaaaagctcacttgattcgggatattgggtcaagctcttcccctccaatgtcccacagcattgggacctcagcccacctgtccaggttctatcaagagagtttagctccttcacagtgaaggaaacaattgagttaagagggaacctgcagaagatagacaatattgaaaaccattcatatgacaagggattactatcaagcatataaaataaactcaacccaactgcaaataataatgtggctaataatggaggaataacattaatacatatttctcaaaagaagaaaagaaaaagggcagatagatgatagatagataaatagatatattagtatgtatacatacatatatcgctagaaaacactaatattcaggaaaatgcacattcacaatgagatgtcttttcatcctttatctttgcttgagagtcagaaaatctaaataaataaataaataaaacaggagctggccaggattcatagaaagggaaactcttatagaccattggtggaaatggaaattagtgaagccatcatgggaaaaaatagaactaccatataattcacaatccaactgctgagtatgtatctatttaaatcattaaagtaaaaaactaatattgaagagatacatgtacacccatgtttattgcagcactatccaccatagctaacatatgaaatcaacatatgtgtccatcaacagatgaatggataaataaaatgtgttatatttacacaatggaatattgttcagtcttaaaaatgaaattctgctgttagaagcaacatggatggaactggacaccatcatgttgagtgaaacaagacagacacagaaaaataaatacagcattttctcagtgttatgtggaaattttaaaaagttgatcttctagaagtaaataatagagtagtggttatgagatgccgggaatgggaggagactgagagacaataagaggtttgttaacaaacgtataatttacaggcagataggagggatgtgctccagtgatctacagtgcagtagggtgactgctgttaacaatatagtgcacattttatgtttacaagtagccagaagacagaaatttgtatgttaccaacaaaaagaaatgttagtgtctaagctgatgaatttgttcattgttctgatttaatcataccacatggcacacatgcatagaaatatcacactgtaccccatacagttattatgtgctaactttaaaaaatcctttaattaaaacagattttatttgcatacattacaaatgcttcaacacagagccaggaataaataccatttttctttgaaatgtgaatttcctaacaacgtagttacattcatttgaaccaaaccgtgtatttgatcatggtaagaatagacaggcttatgcatagaatgatatattttaattttagacttctacttaataccataaattcaaataattttaaaacaactaagtaaaaactataaagttgaggaaatgtgtacgtggtgtgtgatgtgtgactttttccttgcgcaccactctgtccatggtggatgtgtggtgtgggtgtctgtgtctatttctgtttactctgcttgaggttctctgtgattctaggatctgtagttcagtgtctttcacaaaactgggaacgttcttagccattatttctttcaaatactgtctctgtatctacaatttctcctttcagatttaaaatgtacatatacaatactttttaatattaatgtttactttcttcactctcttttccttgcactttactctgtaaaatttctagtggtattttaagtgagtggtttcatttaaaaggtgagccagctctactgaagggtgtgcccaaagcttactcaatgtttatactgcattgcttttgatttcttatgcatttccatttgattttttcttagtattttcaactctcagttccctatctagtccttcattatgtatacagtttccttaatagatttttacatatgaattatagttactttatatatcttgtttaattagatagttctaagatccatatcatatagaagtctcattctgatcatttgtttattatgactttggtatttctcattaatatatgtaatctttgttgatagccagatattttaggttggacagttgatattggcttattacttcattttatgcattttctgcctgtatttgaccatactttatttttgccaggcctttaatgtggaaatgtttgaatcttctcagagctacatttgacgtttacttttgcagtagacgtcatagttgaagtctgttcttctgtgtccaccagagacttcagatcctccagtgataccttgtttttctttcctgcttggctttgtctcttcaccctgttccttcctccagagaatctctttcagctccttcaggtggattaagatattatattgaactgacaattgtgaaattggtggaaggcaatagaataaagggagattttctgacctttcatgggtctatatttctacgaaggcattgtgaccctgagtctgggtgtgacattgccggtgtttctgaacttctgccagatgagatgttggtctgtgtgttcttgctgttttccctgctgtggagtcctcttgttttccccagttgttccctcccacagctccaatgttctcttttggtgttatcagcttccagagttgatgacctgacctagagattaaggctctgattaaataagaaggaggggagatacttctcaatggaacttaggtgaagacctctttttccatctcagttcctaagggatggccccagtgcccctaagatcctggctttggtggcttgctcctgcagagtaatttcttagttctgcaatggggattaaggaggtgggtctgaatgcatttcagagtgtgggctctttttctctcccagacagacacattgggacaaaagatttttgtgactgtccccatttttgggaaaaaggtttcaaggtataggaaagctcttcagtatgtggtccctgagaaattcacgctacaacacatttaccacacttgacttcaccaattcagtatgtatgtatttttttctcttataatagcctacatttttatatgccagactctgcctcagttcaactcatacccatgcctttttactctctgcaagaacttgtctctccctaaatttcggatttgatgattatcttaaaacctccagtatttaaagtatattttaaaattggcaaaattccatctcctgtgtttatctgttatgttgatgctgtaaaacagtaagtaaaatatactcctcatctatgtacattttgaagctgagttgcaggttttttggtaagacccagagtcacagagaattcaaatattgttaagctgcttaatagaaaaacaaattatggtaaatgtgttcactggaatactacccatgatttataataaataaatgcctgacacacagaacagcagcaaaaccacacatgctcttattacagaaagtggcttctgaaaaccacaccgggcacgtacagctttgtcctggagttggtttagggggatgtcagagccagtgacgagaagcacagggccagatggcagcgttcactcatcccagacatgagctcctggatgcatacagagcccccccatgtgtgggtttacttccacttctgtaaaaggagaaaatactgactcctacagagcataatttacacattttttaaaaaatgtaatagggtgatcagggcaaagtgtttatcacagcacaatttcataagacagcatattttccaaataccatcattgtcagcaaacttctgcagagcaccgtcttcttatatgggtacagcctattcctccagcatcccactagagcttcttatatagtaggagacatgcaaatagggccctccctctactgatgaaaaccaacccaaccctgaccctgcaggtctcagagaggagccttagccctggactccaaggcctttccacttggtgatcagcactgagcacagaggactcaccatggaattggggctgagctgggttttccttgttgctattttagaaggtgattcatggaaaactaggaagattgagtgtgtgtggatatgagtgtgagaaacagtggatttgtgtggcagtttctgaccttggtgtctctttgtttgcaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcaggggtcccttgggaccaccagggggcgacagggcattgagcactgggctgtctccagggcaggtgcaggtgctgctgagggctggcttcctgtcgcggtctggggctgcctcgtcgtcaaatttccccaggaacttctccagatttacaattctgtactgacatttcatgtctctaaatgcaatactttttttgtcctttttgtttctttgtttttttgcaacaggagtacatatcctcagctccacagaagccagggtgtcactttgggggcagaaataatcgtttcgtggtcaacaggatgagagtcctgaggaatcccagggaaacctggagagtgttttccaattagactcagggcagagacctccatgggaatttctgattagaacgggctttgagctctgatgggagccaagagacaggctcacccagggtcggggtccttaaagcctgatggttttcacagctatcccccctcgtcttgtaaactcagactgattcagttgaccctttttctgctaatccattttgcttctctgtaggtttgattctcacagttcgctttcttcttctcttccctgagaacaaacgatgtgttttctgttttcagggaaaatcccagggctcaggtctgcaggacctgggtaggctgaggagactttctcactcaccattgtctggacactcctgttgtcttctgtgcatggaggcatttgggaaatgaagtggacattagtcattaagggaataatactagttttctccaattggatattgatgtagagctgaacttgtgcttctcacactgtcacagagtttggaccctcacctataactttgaggagagttgatgatggatagtccattgtgggtgagctctgggtaacagtaattgtagggtctggctaggcagcctaaggtcaatacttctggacctcaggaaagacaggctggaattcctgggaagacctgcatctgccatccaccgtggagtcccatcatcttctgttatgctgtgattgaatcagccccacctagtttatctagaacactcttcatgacttaggaaaacataatggcaagctctcctaacacctgtatcatgccatgggagcaacacctaagctagtgtgtgattgagtagatgagactgtgatctagtcaagacgacaggtaaaattgattgttgtcattatgatattttatatttggcaatataatcatgctcatattataaatacttttgctacattttttgagtgtgtcagaggctttggaactggaacaacttcatcttgaataggggctaggaaaaataagaccgagacctgctgggctggattcctagtaagttgatgcagtaagttagtcacaggatgagataggaggtctgcacaagatccaggtcataaaggccttgcagataaatcttacagtaaagaagctgggcaaagccctccaaaaccgagacagtggctaaaatgacctcagtttgtcctcactgttcattatactctaattataatgcattaacatgctaaaaaacactcccttccagcccccaagacagtttacagttgtcaaggcaacatcatgaagtttccttgtgtggtttaaaaaggaggggaggaacactcaacttcaggaattgcctggaggactcatgaataatccatccattgtttaacatataatcaagaaataaccataaaatggacaaccagcagcccatactgctgctccacctctggtgtagccagtctcattattttacttgcataagaaacttgttttcattttaatctgtggattttccccaaattgggacccctttctcctaatatttgtgctattattcgtgttctgagcagaaaaccccaagatggaatgaagtttccctacatttttataagaagtacattcacccctttgagcgaaaatgcacagggagtggaatgaggctgggaagctaatggcgtatgatggaagcttgtccctgactggaggagagagggagggaggattgggaggaaggttcctatatttttgtgctatgcaaggaagctgcaaaagataactgagtctcgtgtaagtcagtgctacctctcaggggatccctgtgactccaagaaagggctcttcttaggaatcactgtggagtcagtcctttcattagagtagaccacaggacatgggcctcagcacacgccatgccacagatgtcagaaagcagctgctgggaacctgatccacctgcattttgctgcctgtaggaggagggagggaggtgcattctcagggtcagcacactgtttgtgaatttttatagagaacccctgcttttgctgtatttttattggaaaatatatgaacaagtgtgcacctgcaaacaactgtaattttcacatttccttcagttgcattatttcttaatcctgaatgacgtcctgacacagagttgagtttttcacaggcattgttcgaaggatcgagatgatggcattttccacattcactggtttttctccatgtggcagagaccttgagtagagcacatctggcccttatccacactatctcttgtgtcccctgggaaagagcagagatttgcctgactgcagaatctggggtaggagtctgcacacctctgagcctgcagagaagctcagcgaagttttgtggagtcagagagctttccgtgtggggaacctctagcttcctcactctcggagattaatggtcagctgtacttgaggggttaagaattagagcaccttgggagcctgtctcatcacagttccattatgtaacttaccaccattagactgcgggtaataactcaatcttgatttttctgacccgattttttcatcttattcattactaattttgtttatggaaaatgttatgtttagtttatgattaaaacctcagaactttctgaacttatcaggaataatacaaatgtgtccagtttgggggaaatgtaaatgaatgtccatgcagtttgggtgtgtgtgtgtgcgtgtgtgtgtgcatgtgtgtttgtttgtgtgtgtgtggatatgtcagtcacttacaccacaatgaacatgattgctgaattacatagtcaaactaaaattagatttgctgaaaattgcctgcagcgatgtctgtgaagctgaccctgtcactttgctgtgaagaaactcagtgtacaggcgaggttgcacgggagagctaaaagcttctgcacacaggacaggctgagctcctgaactggagccaggcacaggactgagcacctgagaaacagaacccccagccctcctttatctgggctggatgggcaccagaggacccgcaggagatgctcagaactcacacaagacagagcctcagtgaggagcagaggcagcgaggaaccagtccagggagccctgtgaccgccacctcgggttgtcttattttgcttaacagcatccaaacctcaggagaccatttattacgttatttagacttccatgccctttctgtcccgaagtaaaacaaacataaatatgactctgcagttagctctttgaacctgggttatttttctgagaatgtcatcttcgtcatcaacatcatggtcatcatgtcaaaatcaacaggcaaatccagtcaccgtgaagacagtttcatggcatgattcatacacaatcattccattccacagagaatctctttcagattcttaaggtggattaaagtgttatatttaattgccaattgtgaaattggtggaagacattatactaaaggaattgtctctgacctctcatggggtcatatttccagaaaatcattgtgatcctgagtgtgagctgactttccaagtgttcccaaccctcctccagatgagatgctggtctgtgtgttcttgctgcttcccctggggcagattcctcttgttttccccagttgttccctcccacagctctcataatctctgttggtgtccccaacttccagatctgctgccatgacctgcagattaaagctctgattccgtaagaaagtgaggggagctgcttctcaatagagctttgatgggaacctctgttcatacctcaattcttaaggggctgcaccagtgccctaggatgctgattttcatggcttgctcctgcagggtaatatcttagttttgtagtggggatcagagaactgggtctggatgcatttcagaagtgtgagctcattctctcccagacagatactatgggaaaggaagatgttttgcaggggtaaatgattcaagagattagggcaactctccagtatgaggtcccttagaatttctcactataacatgcctaacacactcgacttcaagcaatccagtgtatatttgttcttcatcttgtaatagcctacattttatatgacagcctctgcctcagggaatttcatactctggcttcattactctctacaggaacttgcctctccctagatttcaaatattttgtttgttttcaaccctcaattatctgaagcattaagtaaaatttgcaaacttccatcttttctgtttatctgttattgttgatactattgttgtaagaatgaatatatgggcccggcgcggtggctcatgcctgtaatcccagcactttgtgaggccgaggtgggtggatcacgaggtcaggagatcaagaccatcttggctaacacggtgaaaccccgtctctactaaaaatacaaaaaattagccaggtgtggtggtgcgcaccagtagtcccagctacttgggaggctgaggcaggagaatggcgtgaacccgggaggtggagcttgtagtgagctgagatcgcgccactgcactccagcctgggtgacagagtgagactctgtctctaaaaataaataaataaataaataaataaataaataaatatgtgtgtatatatatatatatttctcatctatgtacatttttaagcttagcagcatattttttagtgagatccagaataataaaagaatccaaacatttttcagctgcctaatagagaaacaaattctggtaaattttttcactggaatactactcaacatttataataaatatatttctggtacacagaacagcaaggaaaagtatctaagtatttatgctgagtaaaataagccagacaaataagaatatgtactatattactccatttatgtaatttatttcaaatgaaaaaaatctaaagtaatatacaaaagatgagtagttacctgggaaaagggtagaataaaggaaggggaaatgtggaaacatacagaagaacaagagaaaatgttgaggggaactcacttgtccacctcagtaatgatgacgcttacatcatgttttcaattctacactttaaatacgtgaagtgtattatctgccaattaacactcacaaaatttattgcaagcaaacaaatgaaaaattagaccaaaagcggtggtataaagatacaaaatatccattaaaagtcagaaatatatgagaatttgcctcctgaaccctagttctctccttatttttaggtgaatgctagagtgccacaaaaatcactcaagttctcaatacaggaagtgggttccacaaagcacactaggcatgtccaattcttacctggagttggttcagggagtaactggggccactgatgtggagcacaggccaagctaccagggctcattcatctcagacatgagacacacacagcccctcctccgtgtgtgggtttatttcacatctgtaaatggagaaaccattgacttctacagaacataatttacacaaatatgtaaaaatataatagtgcaaaatgtttatcacaacacattttcataataagacagtgtattttccaaataccataattgtcacccaattcctgcggggccctgtcattttatctggggtctgccatctcctcagggttcccaccccagagctctctgtgtagcaggagacacgcaaatagggccctccccatgctgatgaaaaccagctaaaccctgaccctgcagctctggcagaggagcctcagccccgggattcccaggtgtttctgcttggtcaacactgaacatacaggattcaccatggagttggggctgaggtgggttttccttgctgctattttaaaaggtgatttatggagaactagagctattgagtgtgaatggacataagtgagcgaaacagtggatatgtgtggcagtttcttaccaggatgtctctgtgtttgcaggtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgtgagagatacggtaaggagaagtcagtgtgagcccagacacaaacctcccttcagggtacctgggacaaccagggaaagcctgggacactgtgcactgtgctgaccccaggggcaagtgcaggtgctacaagggctgggtttcctgtcttgatctggggctgccttgttaccaaattacccgagggaacttctctagatttgcaattctgtactaacatttgatgtctgtgactgctaaacttccctcacatatttgttttttgtttgtttgttttgttttgttttttgtaacaggaagacccatcctcacccctacagaagcccgagtgtcaccttgggggcagaaatgaccctgccttggtcacattgatcagtgtcctgaggaagcccagtggaacctggggagtgttttccagtcaggctcagggcagagacctccgtggaaatctctgattagaataggtttgggattcagacttgggccaagagggagtctcacccatgggagggtccttaaatcctgacagtttttacagctgttctccctcctctggcaaaactgtgcacatctgactcagaactgatccagctggcccttacttgctaatcaatttttcttctctctacacttcattctcatagttcccttttcttcccttcccagaaaacagagagtgtgttttctgtggtctaaatctcagggctcaggcctgttacctggaactcaggtgtggcccaggctgtggctcctgtgagacctggggaggctgaggggactttcccactcaccattgcctggacccgcctgctgtcttctgtgcatggaggcatttgggaaatgaagtggacattagtcactgaggggataatggtagctttctcaaatgagatactgatgtagagctgatcttctgtttctcacactgtcacagaatttcctccttcatctgtgactttggggaaagctaaggatggacactctattgtgctgtgagctctgggtgacagcaattggagggtctggctaggcaaatcctacagggtttcaggtcaatggagttggaatttctgggaagacctacactgtcatcctccatggagtcccatcatcatctcttatgctctgatggaatcagccccacctaggttatctaggacaatcttcctgacttaggaaaaaaatgatggcaggctttactaacacttatattataggatcagtacaacacctaggttagtgtgtaactgaataaatgactctatgagtcaaggggacacataaaattgattgttgccatgacatttatttatttatttatttatttatttattggaaaccagagttttattgttactgaaatgagtctcgccaagcattcaagaatgggattttttaaggatagcttggtgggttgggggcagccagtgagtcatgagtactgattgatcaggtcagagataaaatcatagggagctgaaggtgtcttgtgctgagtcagttcctaggagggggccacaagatcggatgagccagtttattgatctgggtgatgccagctgatccatcaagtgcagagtctgtaaaatatctaaagcattgatcttaggctttataatagtcattttatccccaggagcaaactaggaagggttagaatttgtagccaccagctgcatgactcttaaaacataatttctaatattttggctaattcgttagtcccccaaaggcagtctagtccccaggacgaaggagatttgttttgggaaagggcagttattgtctctgttttaaactataaactaaactaagttcctcccaatgttaggtaagcctacacccaggaatgcacaaggacaacctggaggtttgaggcaagatggagcaggttaggtcacagctctttcactgtttcagttgcagctttgcagtggtggcttcaattcctccctttgagttttgaccttatcgacttgttttgtttctctttaagtgatggttttataaccatctatgaaactctaacaggtgctctcacatgcagatttctgattaaaaactctgaagatggttacaatagtatagagataaaactatcaaatagaagactatcttttttgacttttcacttaaaatgttgcccaagaaaacttttcttttgagctatttatagctttcaacaattgagtatagtcctgtacataaaatttggagaatatttgtttctctctgtccactttctccagaatttggaaactctttgtgaatatccttaacttatggcaatatgatttttcataagtgcagtaagattttttttttttttgcaacaggacacaattggagaaactggttattttaccaaggctttgactgtaatggcgtgcttcaccttaagcaatcgaacttgacttatacagccaataagagccccttgggaaaactggcctgtaccttgtccacacagtctttgtacaaggttcctgaccagtggtaagtaaagaatgtcactttctaacaggcccaagaaccccatgttttcctgggaccccagaggaaaaataatttaccagacttacaggtatttgatggtaaaaactcatggctgggcttggctttaaaaaagtcttatctgagattccttatggaacagagttccaccaaagccaattttaaaagcctgtgtaaacaataattatttgtattgtgctttatgcaaataataaggccatgaataataagactaaagtttattttgcaaataaatcagtcctatcttgatttgttttaaataaaaatggggacaagagagaaaaaaattatgctttaaaaatatagtacacctgttgtttgctgttcttgtttttttttcttcagcagtttggacgaaattctaaattatttgtaggctacaaagccataaactaatgcgttcaaatctttacttttaaaactgcgaattgcactccttaccccagttctcattatgtactttatagtatgttgttccctccaatgtggtgctggaattatagatgacagcactgacagctttgccatgcaagccttggaaccccacgcaggcctgcgtgagtacactcagacagttgcaatgaggttccagtcctcttatcttgaggtcagcacctacccctactacgccccaggtcatcaataaaaagttgtaacagtcttggcccttcttacatcttcattatccaacaccatgatttttgttttttgccaaaacaattgccaaatatagtcataatcataggataaataattttgctgaaatatatgtgttattattggtcttttgagatggaaagtccaagactggattatgctttcatgcatttttcataagaagtacttccactcttttgacaggaaacgcacagggggtgacatgtggctgcagaagctgatggcatatggtagaaatctgtccctgagtaaaggagagatggacggaggattgggtgaaacattcttaggtttctgtgctgtgcaaggaaggtgtaaaacatatttgagtctactacaagtcaacattacccaagggggaacccctgtgactccagcaatgactctgcctcagaatcactaaagagtccttcctttcattagagtggaccacaggatctgggccatagcatagacgtcagaaagcagcagcttgacacctgatccatgtgcattttcctgcctttaaagggagggagagaggtgtattctcagggtcaacacactctttgttgatttttacacagaacactggcatttactttatttcattgaaagatatatgaacagatgtgtgtctgcaaatgattgtaattttcacatttattccaattgcataatttttaaattctgcttgatgtcctggcacacagttgtgttttctataggtatttttcaataaatcaagaaaatacattttccactttcactggcttttctccatgtgcagaggccttgagtagatcatgtctgactattagtctgttttcatgctgctgataaagacataccagagacttggaagtttacaatagaaagagttttattggacttacacttccacatgactggaaaggcctcacaatcatggtggaaggtgaaaggcacatctgacatggtggcagacaagagaagagagcttgtgcagggatctccctttttacaatcatcagatctcgtgaaactcatgcagtattacatgaacagtgctggagaaacccgcagccataattcaatgacctaccactgggtccctaccatgacactgggaattatgggagttaaattcaagatgtgatttgagtggggacacagccaaaccatattattttgccccatggcccctcccaaatctcatgtcctcacattgcaaaaccaatcatgcctttcctacagtcccccagagtcaacttgtttcagcgttaactcaaaaatccacagtctaacatctcatctgagacaaggcaagtcccttccacctataaacctgtaaagtcaaaagcaagttacttcctagaaacaatgggggtactggcattggataaacacacccatccaaatgacagaaattgcccaaaacaaaggggccctctgcaagtccaaaatccagcagagcagtcaaatattaaagctccaaaatgatcccctatgactccatttcccaaatccaggtcatgctgatgcaacagatggtttcccttggtcttgggcagctccacccctgtggctttgcagggtacagcctccctcctggctgctttcacaggctggtgttgagtgaatgtgccttttccaggcacatggtgcaagctgtcagtggatctaccacactgggatctggaggatggcggccctcttctcacagctgcactatgcaataccccaatagggactctgtgttggagctctgaccccatatttacctttctcactggcctagcagcggttctccatgagggtcccactgctgcagcaaacttctgcctggacacccaggtgttttcatacatcttctgatacccaggcagaggttctcaaggaccagttcttgacttctgtgtactcactggctctacaccatgtggaagctgccaaggcttggggtttgcaccatctgaagccatggcctgagccctacattggcgtctttcagccatagctggagtggctggacacagggcaccaactccttaggctgcacacagcacgggcaccctgggcctggaccacaaaaccacttttgcctcttaggcctccaggcctgtgatgggaggggctgccgtgaagacttctgacattcacaggagacattttccccattgtcttgaggattaacatttggctcctcattacttatgcaaatttctgcagctggcttgaatttcacctcagaaaataagatttcttttctactgccttgccaggttgtaaattttctgaacttttatgctgtttcccctttaaaactgaatgcctttaatagcactcaagtgggctttttgaattctttgctgcttagaaatttcttctgccagacaccctaaatcatctctctcaagttcaaaattccacaatttgctccagttcccaatgagttcctcatctccatctgagaccacctcaagctagaccttattgttcatataactatcagcatttttggcaaagcaattcaacaagtctctaggaagttacaaactatcccatattttctggtctttttctgagccctgcaaactcttccaatctctgcccgttacccagttaaaaagtcacttccatatttttggttatcttttcagcaatgtctcactctactggtaccaatttactgtattagtctgttatcacgctggtcccaagactggacaattcataaaagaaaggtttattggacttacagttccacatggcttgggaggcctcacaattatggtggaaggtggaaatcaggtctcacatggtggcagactagagaagagtgcacatgaaggaaaactcccctttttaatccatcagatctcatgaaactcattcactatcacacgaatagctcaggagagacccatgcccataattcagtcacctcccatcaggttccttccatgacatgtgggaattgtggaagttacaattcaagatgaaatttgggtggggacacaaacaaaccatatcactgaccttctccgcatcatctctcatgaccccagagaaagagcagagatttgtctggggtaggagctgctcctgtggaacttagaggctgcagacgaccccagtgcagttttatggagtaagagagttttcccatgtctgggaacttctagcatacccactgccagagattgctggttggctgttattgaggggttcagaattagatcacctggtagcctatctcactgcagccccattgtgtaacttaccaccaatggccttcacgtgaggactcaatgttaactgttctgacctcattttcttacctcctttatttgtaagtttggttacagatttttttttactttaatttcagggatatgtgtgctgaatgcgcaggttttagtttcttattcaagccttataattgctcaactgatcaggaataatacaacatgtatgcagttttggggaaatataaatgaacatccatgcaaaattttttgtttggatatgtccgtcagttacacccctatgaacataatagccggtcctcaccagaaattgctggtcctcaccgatctcaaaagcatctagatcttcaacttcctagccttgagaattcagaaaacaatgtttatgatatttctgagccacccatttaatggagttctgttatagcagctgaaacagactaaaccatttaccaagtctcagtaagggcagtgaggatccaccatgcttgagagacaagcattactctctcatttgcagctcaggatgacagaagcatgatcatgagctgatctgaaaagaagatgtggctttctctccctcggatctcagttgaagccatggtgtcacatctctatggtggagactaaattccagtctgtgatgtaatggatgcctgcctcctcccaccctcacttacgagacagagtttccatgccatgcgttattgaccaagaaccaagaaggactccaattattctcacccctgctcacttgtatggcagaggttctggggatattcctgggagaggcataatgagactatttaagtccacgattcccaaacagttttatgctcttaaagcaggagtatcactttgagatatatgaataatttcatgtgcactaaggtggaggctgttatatttttataggtaaagatgcatggcataaagacagagatacagcactctggaaattgtgtgactatgtttgcagttgactgtgaataatttttaccatgaagttatcctaaaacacataatatatttttactgtaagtaattaatgaaaagctgacagctccacaagagcaatatccacttggtttagcagagagaatgagaaatagcataatttaagaataatcagttagacactgtgccatgtgcctgtattttcaactagtgaggatgctaatgtgggaagatcacccaagcccaggatttcaaggccagcctgcaagatattgctagacccattttcttaaaaaaaaaaaaataacattctgggtcatgacaaacctcaaaaactgaccctctaaataggaacaaatttaattgcattaaaatgtggatgaatttttgacacaaaacagtgacagcatgccagcaatgagtacagaataacatccagttgttatgttaagagatacagactccgaaaaagagacatcaggtagaggctgtcaaaggcctcactgcctaatgactgcttttccattgatactgtgtgtatatcccggaatgcacctgtgaatgaggacatcatgtctttcatagtgtgagagaaagagacattactacccatctgacaaaggattgatcagaatataccaggatctcagacaactctataggaaaaatatctagtaatccgaataaaaagcaggcgatatttatttcttaaaataagactttcaaattgcaaacaggcatataaaatgtgctgtgtaacactgatcatcagaacaatgcaaaacaaaactacagtgaaatatcatctcatctgattttaaaatgatttcatccgaaagccagacagaaacaaatgctgggaaggatatggagaaatgagaacactcataacctgttggtgggcacttaagtttataaaaccactatggagaacagtttagagtttcctccaaacctaatagtagtgttgtcatataatccagcaatcctgctgctggcatgtactccctcccacaaaaaaaaaatgttgtttgcactaccatgtttgttatagcactgttcgtaatagccaaaatttgaaagcatcctaactgcccattaacagatgatggataaataaaatgtggtacatatagcatatggattaatattatgccataaagagaatgagattttttcatttgcaacaacgtggatgaaactggagttcattatattaattgaaataatcccagaaccgaaagacaaacttcacatattctcatatatttgtggaagttaaaaattaagacaactgaactcgtggagatagagagtgaaaggatggtcaccagaggctgggaaggtctatggtagatggggattattggggatgctcaatggatgaaaaaagtggttagaaataacaaataatacatagtatttgataacacaacagactaagtataatccttaataacataattatagattgtaaaataactaaaagtgtataaatggaatgttggtaactcaaagaattaatacttgaaaggatgtaggaaccattcatcataatgtgagtattatgcagttcatgctatatcaaagtcaggtaccccataaatatacacatataccatttacccacaaaaattcaaaattaaagtatttatgtatctcatcttctgtatctatattacattaaacctaagaagatactggtttcttcacactaccaagatccacatagacatccgtagcttctttctttgcctgtccataatctgacattgaaaaatgaggaaacctttcctatcatatgacattaatttacttagtgcacaatttcaaaatacacaaattgtgttagaattattaaactgacccttgttgaaaatatgtttatcgactagaataccgtgcttatatgcagcttatttatattttacaatcacaacatcaaattatttccaaagatacttgtttctgatattcatgcccccctttctgcagtgaaattagtacaaacctgtttatcattgttagatatttttatacagctttcattttattctgtgtttcatgaccagctaaatacttttgaagttgtatgcatttaggttaacactttgtctcaaaaaattatgagttttcacaaattatttatgccatgtgtttatcattgaacaccatgaaaatagtttcattgtgattaaaaagtgtgtgtttcacctaatccacacaccttttccccagattcctggaaaaccacaaaggtttactggatctatatttttgtctttggcaaaatagcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgtgagagacacagtgagggacatatgggtgagtctagacgcaaacttccctgcaggaagacaagaggggactttgtggtaaatggtgctcagaaccactaggggacactcagaaccactaggagacactcaggatagcagaaggtgctcaggatgccgcagggtgctcaaaacactaggggtgctcaagaccagcagggggcactcaggacaccaggagacacttaggacatcagggggcgctcaggacaccagggggcgctcagcacaagcaggggccacagaatgacaagggtgcattccagaccaccaggaaacactcaggaccaacaagagattctcagaaaccaccaggtgtaacaggaccacctaaaggcccacaagacaaccaggagacactcatggccactgaagaacattgaggacaccaggggttcagggccaacagggagtgctcggggccaccatggggctttcagtaaccacgagggaatcaatcactcaggacaccacggttttcttaggaggcagctccacatcaggtgcctggggaaggtgacgtttgcttttagacctagctgattcctgagctggtcaagcaaaagtcttcccacgatctctcactatttcttccttgtaacccatggtttctttcacatacaaatcattaacttaggataggaattcaattcaacttttaaccttgcatatttttagaataataatagcaatagtaattcaatgtgttttgataataagaaattgtgtatgcctaattcaaactctggttccacgcatgggtttttgtttcttgtgctgtgccagtcacactacagtcaatgcttttctaataataactcaacaatgtcacggtgttaagtttcctttcattttgtctgccatttgtggagatgaaacaccactttcacgggtcagttcctccactttggttgggttctggtcttctgctcttcacactgtttctccaccttcccttctgtcaaatccttttgtcttcctcagtctcctggcaaagaagcaacaaatctatttattttgtctcctccacgtctggtgaatctgttcacttctcttcatgatcattgaacccaaccatgtttagaaggataacagttcaccttacaatatgctcatgtaggtcaggtgcagtggctcactcctgtaatcccagcactttgggaggccaagacgggtggatcatctgaggtcgagtttgagatcagcgtggccaacatggcaaaaccctgtctctactaaaaatagaaaaattagccaggcatggtgtcgggcacctgtaatcccagctactcgggaggctgaggcaggagaatcacttgaacccagggtgagaggctgcagtgagctgagataatgccacttaactccagcctgggcgacagagagaaactccatctcaaaaaaaaaagcatatgttcatctatccgcagactctctgacatcgtcacccttttctagggtcctgcagacatcaccccacaacatccagtccttttcctaagtaccacagagtgggctctgcagctcctgctgctctctgtgtgctcagcgctgaggctcaccagtgctttgatgatgaagttcaaatccctaatgtgtttgcaattctcagacaaccctctagcaagctgccattgtgagtgcattctggggatcctgggctgatttcaggtccatattgctggatgttctctagcatccaggcgtgttggcaaataaacatctagaatttgtattgaaaatttgtggaaaatcaatggtagaaaacaatcctaatttctaaataagaacattttatcctgactttataaaaacacaatgttaatttaaccaataatgtaataaaatgtgtttaaagtgatgtttatcttgttattagatgtattaataattggtattttaaagtatactaacagcataaatgacaaacaaaccaacacagcgattatacataaataccattgtacattaattaatttggcaagaatggcatttattttcatttctaccaaaccttgcctttaaatatgtttgttaattggcattaggatagtgaaacaatcacacagagcaacaacattttggaatattacattatactataaaatagtacattcgattcaattatataattaaaataacattaaataaattcatgttttggtttgatatttggatatgtgttcatttttgtattttctttttttgtatcttttgtagagatggggtttcaccatgttggacaggctggtctcgacttcctgacctcaggtgatttatcgggggaacccacccccaatatttcaatgtagggtctttctattttctgtaagtgtcggctggtctgagaaataaagagaaagagtacaaagaaaggaatgttacagctgggccaccgggggtgacatcacatattgataggtccgtgatgccccctgagccgcaacaccagcaagtttttattagggattttaaaaggagagggggtgtacgaacagggagtaggtcacaaagatcacatgctttaaggggcaaaaagcagggcaaagatcacatattccttccccagggtattaattactaatattccttgctgggaaagaatttagtgatatcttccctacttgcacatcagtttataagctctctgcaagaagaaaaatatggctctattctgcccgaccccgcaggcagtcagaccttatggttatcttcccttgtttcctaaaatcgctgttgttctgttctttttcaaggtgcactgatttcatattgttcaaacacacatgttttacaatcagatttcatattgttcaaacacacatgttttacaatcaatttgtacagttaatgcaatcatcacagggtcctgaggtgacttacatcctcagcttacaaagataacaggattatgagattaaagaaattatgaaagtattgattttgggaactgataaatgtccatattaaaatgaaatcttcacaatttatgtttagagattccagtaaagacaggtgtaagaaattataaaagtattaattttgggaactgataaatgtccatattaaaatgcaatgcctagggccaacaaaggagtcatattaatatgaaaaataatagctgaatattttggaaatgacacatgcagtaacaaatgtctatatgaaattaagaagatattgacacaaaattgagaaaaaattaacataattatgctcactactggtttataaaatgcctataataacactttttaaatcatattatagaaaataaaataactatataaatagcactctctttgcttgattttagtatttggtgcttcaaatgttttttatacaaataaacattggtcattttttgatggtaatttcaatattttcttccagaatacatgttcataaatgtaattgaaattgtataattttcagaaacttattttatcagttgtgacttgtatttttatgatagactttttacatttatatacttttgattcagaataattatagataaaaaaattataaagttaatacagtgtgttcccatctccaagtatctcctaagatgaatatcctctatcatcataagacatggtgttaacacatttacattgataagtgtaaatatattcaataccagaccttattttatttatcatttttccaataatttctattgtaaatgaaaaataaaattctaagcttcctcaagcaactaaatgaactcaaccctcagccaagggaatttcaaagtaaattctaaaacttgttccagcaatgatgggaaagtgagaggtcagacatgcctcattacatgctcctctctttggaattaaggcaccagtggccagcattagtactacaacaaagatcttaagacgggcaaaactatatttttgctgtaaacactttctatagcaaaaagacatcaaattacaacttgattctagtatagcatcacatgacaaatagcaaaacctaatgatttattctgtatgaaatctgctacctggaggcttcatctacataataagaactatgatctccaggaccccttatcttaatccagacactcagttgtaatgattgtattaccttacatttcaaccaattgccaatcagaaaatctttgaattctcctatgtcctggaaccctgtgcataaactttcctgcctttctagactgcataaatggtatagctcacatgtgttgattaatatctgcctgtaacttctgacccactaaagtatataaaatcaagctgtaatcaagccattttggacatgtgttctcaggaattcctggggtcgtgtcatgggccttggtaactcatatatatctcagaatgagccattttaaatatttcatagtttgtcccttttagtggatatcttcttttcttttttttgggacagaatctctctttgctgttgctttcgtatatttgtttgtttccagattccatcaaggccatcagtttgaattcagttgtcttgttcctttattctcttctggtaaatgacagtttgtatttctgaagttttctagttgaatattttatagataaaaatttatcaagtaggttgatagtgccatttgggactcttatatctttacctatttaatcattgcttgttttctcaatcacaatgagtgttgatttctccatgttctatacatgttagtctattttctgttccaaatccatttattaggtcttttaaaatggattttggaaaagttgatcctattattttatgcaatatttcacttgagttgcaaaggtattctttttatgattattttgtctgaaattaacatagctattcaagttttctttggtttatattttcatggtctatatttttccatcttatttcttctctttgtgaatatgttaagaagttttcttggagaaagataattgctgggtcttttttttttttagtcaactatgaggaattattttttaatgatattacccttttgtccaataatggttgttttgtctttttacaataatatgtattgtttctattaatttattatttaattattattgatgaatatcttattggttaccataaggataacaataagacatttctataattgaattctaattcaaaaatgtagtacttctttctctttcttatttctttgagacggagtctcactctgtcgcccaggctggagtgcagtgggacaatctcagatcactgtaagctctgcctcctgggttctcgccattctcctgcctcagcctcccaagtagctgggactacaggcacctgccaccatgcccggataattttttgtatctttagtagagacaggctttcaccgtgttagccaggatggtctctatcttctgacttgtgatctgcctgacctggcctcccaaagtactgggattacaggcatgagccaccgtgcccagcctacccctttatatatagaacagagatattataactatatatgtctaattcctcttttctatcccttttttattttatcagtttgtaattacataagctataaaaatgtaatattgacatttttataattgctttacacatttatgtaataaagaaaacacaaatgcaaaaactaaatttaaacctcatttttttcattgttgacaatctttatcttttggatacattcaggtattggatgtatatcatatggctgctcatctagaaactctgctaaaacgtctatggcaagattaatatgctgggaatagattttctcaggatttgtttgtccgacagagtatttatttgtctttgatttatcatctcaagagacaatgtcaagaagatgctgtttctgcaaatgggcaatctgcaaaccaaggacacgtcactacattactgtgcaagagaagcacatgaggaaaggccggtgtgagacacaaacctccaggaacacctgggctaatgagctgcagggggcgctcaggacccactgatcagtcaaccacagaggggagtgcaaaggttaggactgctttcctgcaagcattgaaaaaagaagaaaaaaactccgtctgacagtttctccaaggaacttctgtaattttagaattctgtgcctaccaatgacatctccaaatatttttttaaaatattgtgtttggaggacatactctcacatggacaaaacacaaattgacacagagatgaaaagccctcaaccatagtcaccaaaattggagacatgtagaagctcactgggacctgttgagtcttctccaatcacactcagaacagagaccttagtgggtctcccttagagtagtcattaaggatggtgataacagcctaaagatggtagaccatggtcagtgtcatatagaatatggggaccctcacaagttttttgtctgacccttctcctgacactaaattatgcaaattaataacactgatctggtgcttcttttgattctaatttattttatttttagttgtcgttctcacttttcctttggattttcctgctccctggaaaaggtaaatgtggtctccgtgacctcaattcaagggctgaagccctttccctgtagctcagctggggctcaggctgtggctactgcagccatgtggaagaggctgaagggactttcttcactctccttgctcaggaccatccactgtattgtgtataggcttctctggaaatgcaagtggccatttgtagtgaaagaaatatgtttgtctggttaaaatgggaggtggatgtagagttaattggctgctacataaactgtccttctccaccagtgcttttaggatgagattgtgaaatttgtaagaatcaaaatggagtcacatatgttaaaaccctgacaaatggattcaggaagtgtagggagaattcttacacacatatccctgacaacaagaactatcataaaatagttcttgcaaaaagaccaacatgacctcataatcatgacttctgcaaagacttctactcagaatctacttgcccagccttagattaatgccatctgaattacactgatcatgttactatcactggtcctcaccacagatgcaacaccctcctgagtcctgaaacctgactccatcccatagagtagggcacagatgaggggaatgcaaatctccaccagctccaccctcctctgggttgaaaaagccgagcacaggtcccagctcagtgactcctgtgccccaccatggacacactttgctccacgctcctgctgctgaccatcccttcatgtgagtgctgtggtcagggactccttcacgggtgaaacatcagttttcttgtttgtgggcttcatcttcttatgctttctccacaggggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagaccacaaagacacagcccagggcacctcctgtacaaaaacccaggctgcttctcattggtgctccctccccacctctgcagaacaggaaagtgcagctgagatacgttttcctgccagggcctgcatttcccatccccattagactcagagccctgtcttcctccttcttctttaataataaatggcatgactcctgttaatagttcatagaagcagaagctgagtcctgtttgtcaaacattcagcatgaaatgttcatgttacctgggccagatgcatcactggtatgtggccgccagtttaatgggctcatactactccaagcggccgaatacaaaacagcagaacatatgcctttattaaactgcaggaaatgacactggagaaaaatgtggggataagggagcaggaggaattgtgaaaattcagataatagcttttctcgtagagagaaaggtgcgttaataaaataattttataaaacaataaaacagatggaatgtgtccccatcacggagtgtctcacagtaacagtgcagaaataaatttctaaaaatgtcgtagggtaggtgtgatagacaaggcttatttccacacagggagcccataaatacccatgtaattaaaaatccagctcttagaaagggagtgcctcaacttgacatcagaaacccacgtcagtgagtctgaggagcaatgtggaaaagaaatggaaaattcaacaatacctttcttatgaaaatcctagctcacgtttcaacatgaaacataactgtctacaattttaggaaaaccatcccatggcaacaagtcactacactcaaaaggtactgagctaacagagttccagcagtgagcaggtcagtgctgaaatccccggagaatcaaggctctcaggtacgttgtacaaaacccagaactgagccacacaatctatggtcaagtgatctttgacaaagtcaacaaaaatatgcacggggaagaggccacgctcttcatgccatgttgctgggacaattggactgccatatgcagaagaatgaaactggacaccaacctgtcgacatatacataaccataagaaaatggactgaaggcttgattataggacttcaaaatataaatgtactcgaagaaaacaccaggagaactcctctggacattgggcttagtaaataatttaccacaaaaacctcaaaagcacaagcaataacatcaaaaatagatgaatggaatttagttaaactaaagagcttccacacagcaacagagtgaacagacaaattgcagaatgctaaaaaatatttgcacacattgcatctggcaggggactgataggcagaatttacacggaactgaaacaaccccaccacaacaacagctatgaaaaaacaaataacctcattaaaaattggcaaaggacacgagtaggaatttttttaaagaacacatataactggacaagtgctaaacatcactgattatcagggatatgcaaattaaaactgcaaagaggtatcttacaccagtcagaatggctactataaaagaagcaaaaatagcagacatcggtggcgatcaaaggcaaagggaagtctcagtcattgttggtgaggatgtagatgagcacagcctctatggaaaacaatgtggagatttttcaaagaaataaaagcagaactacctttgattcaatgaccccaccattgggtaactacccaaaggaaaaataaatcatcatatcagaatgataaccaaacttttgttttcctgcagaactattcacagtagcatagatatcaacctaaggaattaacctgtgtcttacaacagataattttatttaaaaagtcacatatatatacaattaaatactatccagccatattaaggaatggaatcatgtattttgcagctacatggatggaactctgggtcattattttaagtctaataaacgagaagtagaacagcacacaccacactttttcacttataaatgggagctaagtaatatgtgcacaggcccatagagaaaggaatgatggacattgcagactcagaaacatgggagagcagaagttgggagaatggtgagaaattacttaaagggtatgatgtacattatttggatcatggatacattaaagccaagacgactatgcaatatatatatgtaacaaaattgcagtcactccccgtaaatgtatacgaataaaataaaaaaaaatacaattgaaatgtgaaattattaacagttgatcaacaatcctgaaaattaaaacgtgtgatgcaataaatgaaaataattttagttgaacttcatcaaattttaaaacattttctattcaaccgactatcaagaaactgaaggacaagcttcaggggagaaagtatttgcaaatcatacatctaacaatgtaattataataagaaccctcaaaactcaacagtaaaaagaagcaatctgtttataaaataggcaaaggtttgtgcaaactttctatcaaagaagatgtacagatgacacatcagcatatgaatgtaattttccagtagagaaattcaaatcaagaccaaaaggagacacgactttaggctttagaatgaggaaaaataaagaagaaatactgacagtaccagtgtcagtgagcatgccaggccccgagagactaaaatattgctagtgcaaaatgaaagagtttctgggagaactgtttacagtttcttataaaattaaacatgtccttaatccatgacctagaactctcatccctgagtatgtcctacaaaggattaaaatcatgtgttcacacacacacgtattcagatgtttaacattgtgtgtgtgtgtgtgtggtgtgtgtgtgtgtgtgttagaaactaaaaacaacatgaacatctttgaaaatttgacacaaaccattacaggtgaactccagactttcttctgagtgacagaaggcctgcctgaaagatccccagagacacagtcatggatttcactgtcaccctcacatgtcactggcttgggctgggctctctctggctcttccctgaccaggaccagatgttgagctccactacctgcagttggaagtttatattttcaacaatgcactgagggctaagttgctctacagactgaaccaaacaaacatgggcgcctttgaacaaacagtgcctgacatttgtactgaccccaggagaactcttcccgctctctttcttcttggttctctcctgcaggccagcagccctgcagtttagcctggacctctcatgcatctacccatctcctcccaagtgcattttaccacagcctccactgtttttgtaattctccacactctgttgtaaatgaagtcaggtccttcgagaccagattcgggactctattttatgaccaaatttcagcctcacccccactcctgagacagagctcctaaataagattctgcaggtggagattaagagcgtttttcttcctcaatgtaggagatgagtgctcagtggagggatggggaggagctttccactttaccagcatgcagatcctgctggggtggaccctctgccataggagcagggctgggaaccaggcagccaatgtcctcctccttggtgctgcactcagggcagagcctgcatccatgagtggggctgtgtggaagaagtgagtctctggttctcagtaagtcttgtctagaactgagcctcagcagcatgacctgtgggcaaggtcggagggccaatgtcctggcccctggggaagagtgtgctctgctgggagctgggcagaaggaatcctgtctacttggctgcagccatctgtggtggaatttacatcatgctgagctcgggcatagaaggaaggaagagaatctttgatcaaatatcaatatcatgtctgaccttactgaggttttgtagattatctcgaataaatgttccttcactttctgtatgttgacagggcctttccagacccgttaatttttcaaaattaatctcaccagtttcatggaggcatggatatatcgagctccttataccgtcatgtgagatgtggaactgtttccttcactggttataaaataatgggttgacttttttcccaacactttacagataccatcaattgtcctattgcttatatggttataaccaaagcaatgctgatattattcatttctattctattgcaaggtatgccccctctactcgtctccaattgctggcatgtatttccatttgtctgtatgttttagtaatttgaatatgattcacctaagagtgtttgtgtgtgtgtgggtatgtgtgtgtcgtgtgtgtgtgtgttaagggcttatcctgctatttggtgttctctgacctgcactgatccatgacttacaatttctctaatttggaggaaaaaatagagggaaagtgagtttgagtccagacacaaacctcactgaagtgagcacaggattctaaccccaggggtgctcaggacacgctgatcacaagagccagcctcaggggcaggtgcagatggaggctgagctcttctttcccgtcagcactgtggcttcttctccataaaacatcttcccttgaggaatttatctgaattcatgattttttgcttatctccaaagtctctgaaatgaaaatgtttgttttaataaaagaaaaatcttctcacatgtgtaaaagacagtttcctacagtcgcttaatcttgtctttaaatgtcaattatcaatgcttctgaagtaaatcagctaaatctataaaagacactttgtttaactcaacactgcagcccagcatgacagcactgaaagggccagcaagcagcaggcaggatacggtgcatgccagacactggggcggaaggagttagtatccagtgcaagagaagaaagtgcccgtggtggtcactgtcaggacccaagctcacagctccaattgcaggtgaccccatgcaaaggaagagataccctcaccaatgtttagtgtggatgtcgagtctgatggtgccacattcacacaccacgtgaatatggaaagatttaccaactccattattgaggcgtctgctgagggctgcacaggcctctcaataaagtccaaactggctcaatagagcaggaaagaagctgcctcagggtttttatgatggtttggtgttgaaggaatggtggggcttcctactaaggggaaggagcttgtataatttgaacctaatactggcatccagtgaggacacttccatgattttctactaaatttcccatgtgtgggggacaaaagtgaaggaaaaggattaatcctgtcatcagtaatgaggcatcaaaatagagtctgatgacttattctacttagcaacttaagcaaatgagtgaaaaatgaggtaagtgttcactctgggtggacagcaaataggtctgcagaaaatagagtttttttaagtgtaagcacataacaaaaagaaagagaagaacaaattgaacagggatcttggaccaatgtcctgggtggaagctcttcactctgtgagatcatcagcttgctctgagggtctcgggtcaagtccttcttcaatatatctcaggccttacaggatacatgggaatgctcagcttggtgtccttcactagggaaaagaaagagaaatcagactgtcactgtgtctatatagaaagggaagacataagagactccattttgaaaaagacctgtactttaaacaattgctttgctgagatgttgttaatttgtagctttgccccagccattttgacccagccactttgagccaacctggagctcacaaaaacatgtgttgtataaaatcaaggtttaagggatctagggctgtgcaggacgtgccttgttaacaaaatgtttacaagcagtatacttgataaaggtcatccgcattgtctactctcaataaaccaggggcacagtgcactgtggaaagccgcagggacctctgcccttgaaggcggggtattgtccaaggtttctccccatgtgatagtctgagatatggcctcgtgggatgagaaagacctgaccgtcccccagcctgactcccgtaaagggtctgtgctgaggagggttagtaaaagaggaaagcctcttgcagttgagatagaggaaggccactgtctcctgcctgcccctgggaactgaatgtcttggtataaaacccgattgtacatttgttcaattttgagataggagaaaaaccaccttatggtgggaggcgagacatatttgcagtaatgctgccttgttattctttatgccgctgagatgtttgggcggagagaaacataaatctggcctacgtgcatgtccaggcatagtaccttcccttgaacttaattacgacatagattcttttgctcacatgttttttgctgaccttctccttattatcaccctggtctcctactacattcctttttgctgaaataatgaaaataataatcaataaaaactgagggaactcagagaccagtgctggtgcaggtccttggtatgctgagtgccggttccctgggcccactgttgtttctctatactttgtttctgtgtcttatttcttttctcagtctctcatcccacctgacgaggaatacccacaggtgtggaggggcaggtctccccttcgtacttgagcagccttacaactgggtgggtttatgaattaattcctcggttgcattacatgaaaaatcacacaatctacaaattttaaaaaataagcctttactttttataaaagattacagccatttcacaggctgggaagcacagccattggtgaagacgagagacaggcactcccaaggaggagcggtggggcagaaactttatgctgaacgtgttggctaaacagacataatcaacggattacaggaggggctatgcgtgttcataaaggtggtcatgacacatgaatatgggagcaaacatacacgtcacatgtgacccacttagcagtggggacttagcatttaaatgtgttacagttaggccctaagtgccaaaagctggagcaggggcacaaagaccctcagagcgcagcctccataaatggccagaaccaggccatggtcagtggtctctgatcaggagaaaattcctgaaatcaatctggtgtcccatccaagctggggttatggctgtggaatggggggtcagttagtcaggggatgagctgcagttggttaaatcgtgcttatctcaggatcagtgcttattttgctgctacagaagaaaataacagtttattctttaagagttggggtgagggatgtaacccctgcctggcatggccttaggtcttgtttataacggggcatcttattgccccggagaatctgttctgtcagtcttatgatctccattttaatgttagtgttggtccatgttgtctctgaaccacaaaagggagtgggtataatgaggtgtgtctgatctcttgttctgcccagctgggaactcagtttttaggtgtttttggtgcctccttggccaagagggggaaccactcaatctcatggggtgactgaaattttacttttagtttaaagtttataaatatggacctaagtattgacattctaaaagtcactcctttgttttggctaaaagtacttggcaagagtccttgaaatgaggttcaagagcagtattttctcatgactttatttgcaatagacacatgagagactgttgaaaagatgaagtaccaaagtagccttaatctgttggtgaatggagttggtataatacagaaatcactttcaatattttgtaacacatgcatgcatgcaataagacagcggtgagcactgagtgtaaagtctctaaaggtacgatctttcagccaccaaataatagtgtaataacggacatactctggaggagctgactataataccgtaacaccacggggagaaactttggccaaggaagtccaagattttcttttccttttcctttttttttttttttttttttttttttgttgttgttgtttgagacagagtctcactctgttgcccaggctagagtgcggtggtgcgatctcgactcactgtgacctctgtctccctgattcaagcgattcctgcctcggcctcccaaaagctgatattacaggcatgtgccaccacacccagctaagtttttcatatttttagtagagacggggttttgccatgctggccaggatgatctcgcactcctgacctcaagtggtcctcctgccttggcctcccgaagtgctggtattacagcgtgagccaccacacccagccgagattttcttaaagttttgaaaattttaatttaagggttacaattttttcaacatttccagaaagctgtagacagtattattctgtgttatatgagtgattgtagttccttccatttttagatagtattacaaacaattttagggctgcttgctttaaatagatagatgatagatggctacatacatacatacatacgtacctcgatagagatatagttgcaaacataaatacatagatagatagagttacagatgtattttagttattatgctacttttttctttgccttttcttcctatgttatgttagtcaggtctccaggacttaggagtgcatttacaatcccttcccttgtccattttgacgtgttctagacaatgcgagaatcctttgtgtgtggatcacttccaagtcatgcactacccttgcaataaatgtgtttgtgtatgtctttgccttactgacaagctctgctgagtgcagttatttctgccgtctgagctaactttacacttggtagagaaatatattctagatggaggcttccactattaatttaaattactaattcataacctccagcttaattattgaggtataatctatcagagatggtattagaacaaaggtttccaatgaaatctaacagaagggatgtcaaaaaattttcctaacttaggtaaaataaccctgagcccattcttagtatccagccatgtctcctatctatcacactgaatcccacactaactttgacctgacttgggacttgtaagcttcaaatatgaccttttgattgcaatgcctctaattcaggacgtgtggttattttagccaagagtaaagaaaaccaaatttaactcgctaaaaatgacaaagattaaaacctaatgaaatggaaactgggatatgagtggctccagacttggctattttaagagtctatgtgcccaggtgatttcttttctccattttacacacaggcaaacccaaaacgtcagcttcatctcccgttgactctcatcatctcgttcttcatcagcttgcttagaatgttgacttccagctgcatccatgttgccacaaaagacatgattttattctttttctgtgaatgcatagtgttccattgtatacatgtaccatattttcttgatcaaattcaccatgaatggacacataggttggatttatgtcttaggtattaagagtagcatagcaatgaacatgtaagtgggtgtattttttggtagactgatttattttcttttgtgcatatacccacatatgagatggccgggccaagtggcagctctgcttcaaatacttttcaaatctccagactgctttccacagtgcttggactaattcacattccacccaacactgtacaagtgtttcctgttctccgcagcctctctccagactgctttccaagattcctctcctccactttgacactttggtatatccatgtgtgtcctctctggttcagccagggacagagaaccaggaagacatcatgcattttctagagggagctggcttggggaatcaacgaccggagtagaaagtgcctttgtccatgcatcacaggcctgagggccctgggcaggaggtcaggaagagaggatgaccagacagctggggaaaccgggatgaataaagccagtttccttcctggtgaggaggggcaggtcgaagcctcgtgtccctgtagggatgaagcacactcacctgccactgctacctgccaatcaggtgacctgcagagcagcagctcctgagtcactgatggtgacttcctcctcctccaaaccctctaggatctgtgcttctcagagtgggaaccccagcaggtccccaagttttcaatggattcacctagctagtgtctctcctcagccccatccccaggctcctgccctggtgctgtgtacagtgtcacaacaggggtgacagtaacagctggtgcctgcactttccaggccaagaagtttgaaagaagcaagtcacagggccagccgggatatggggtaatcacacaaatttccttcttggaggaagtgctgggaaacatccttgagtcctcctcagctcacgtgcagctgctgctgttcatcccagtgcgggggacacatgagccctccccatgcccaggatggagctgtttcaatcacagcaggatgggaatgtgtcttctctatgggggcttttgaagcacagctctcctgttcctgagatttgagatttataaagacaagtcccacagagtggacctgcacaaataagacagtacaggatccccaggagagacatcccataagagaagggacaggcgggtcccatcacagacactcatcctcagaaaccctgaccggctactcaccttcacaggtccccagttcctgatcagtgcctgtgtctgctcctgagaagagatgaaaactcaagacaaatacttctcatgatcataggcttaaaaattctcaacgtaggaaatcaaatccagtagtttatcaaaaagttaacacactgcaatcaagtaggctacattctgcaaaagcaaggctgctttaactgctttccacagtgcttggactaattcacattccatccagcactgtacaagtgctttaacctatgcaaagcaataaatgtgatgctctactaaacagaatcaaaagcaaaaaccatgtgagtattccagcagatgcaggaaaaaagctttcaatagaatctaacaacgcttcatgataaaaaccctcaaaattatagacattgaaggagcacacctcaatctgatgagccgtctatgacaaacccatggccaacatcatactgaatgggcaaacactggaagcattttccttaagaacagaaacaagaaaaggatgcccgctctcaccacttctattcagcctagtactggaagtattcaccagatcaggcaagagaaagaaataaaaggcatccaaataaaagaaaaagaagaatgcaaaccctctgttttcactgataatatgattctatatgtagaaaatattgaaggctctgccaaaagtctcctagtattgatacattcgtttaggaatgtttcaggatataaaatcaatgtacgaaaatcacagtaacatttctagtcaccaacaacgttctggctgagagtggaatcaagaacatgctctcccaatagccaccaagacagtggaatacctaggaatagagttaagccaatgagatgaaatatctctaccagaaaaacagcaaaacacatgtgaaaaaaatcagagataaaacaaataaatggaaaaataaacattccatgcttatgaatttaaacaataaatatatgaaaaagttttaaaatttgtgattaattctacgtagcaatgccatttttttcaacatttacagaatattgttgctggtaatagcagtttagcatttgagtaatggaaacaccttacagaatcactttataacagttgcttcctgtagtgggttgcttcagttacctgatgaaaacatctgcatgtcacaggttgaaaacataaaatatgtctatcaactgagaaggttgtaggcttttgtcaaggaattacttcaagtcattcagaaaaacagcagacagtaaacgaaacttgttcaaattccatggagagtcaaagctgaagaaaatccaactagaagtgtccaaaggcccccaaggctcagttcctcggcaagtcccaccttctcaggttttccagaattttgtttttaactgatttacactgagtgaagtagattaccaggagttttccattattttaacataaaatcgggggctaagtgttgttattttataaagacatctttgaatctctcaggaaatttacctcctgagggttcagataagatcctactctaggttaagattacatgtttggcgcaatgaactggtacaaatcttactttagctttcatgttatctatttttccgcactgacttccacctttttattagtcaagtatatgggatggaagagtgcttctaagaggtccttaacttgcccatttcaatggattttcaagaagacatgagaaaccactttgtttgcaaagcatcccaaagccatgtcctgctccagaaacgtgatctcatttcctggtcgtttcttaactgacacgctctaatcagtgcatctgggccaatttgaaatgaggtgaagaaatgtgtcctaaagtaaagctaacattgtaataggaattcgtgtttaaaaacatttagttttattattgggcaggatccatcaacatataacagttgaagtttctcaacaggagtttaataaatataaggaatgtacagaagtgtttcctaatttaaataaaatgtagtgattacctaggctgtgagtgcaatcttggtaatcttctatgtccatgcccatcactctgtgcaccgcaaactaattttgacctcagcagaaacgggattaattttcaaattagtaatttttttccaatttaatttatttagatgattatgaatgactattttagcagaaagagaatcaaggaaacttgaactaaataaccagaatttaaaatgacaaacaattcaacaagatgccaggatgtgagtggctccaggcccaattaattcaaaactttatgtgcccaggttctgtattttcccaaaattacacatctccattccagcttcatgccacagttgactcccaccgtgtaagacatggcgacaccattcccaaaggtcgtgtgcaattctgaaaatggaataagcaaggagaggagatgatagtttatattctcctctgaggaggaagaattgcctcaacagaccacttctcctgcatctgtgactagaactatgtcacaggcacacatggagcaaaatccctcaaggggataatacggtaacattaatcagggtgatcatttttaatactataaaattcatagatgacactgcattccagcctgagggacagagcaagaccctgtctctaagaaaaaaagaacaaatcaatagatactgataccaacattttagataatgaaattttcataatgtaattttaaatacactcacatcattacataaatcttcccagaaatattcctagtcatgttgagtttcatcaacttttccagtgttcaaatctagaaatccaatagactcttgaggataaatcaaaatgagggcagtgaaactggtatctgctcagcacctgttaactcaggaggactcaatacacccttgcacactgctgcttctctgaatggctcacaaggactccagctcactctccatcctcctcaaacatctggcccccacttgccctaagttgactctctgctcttagtctgtgctctgaagtcttcccagaggtgaaagtgagctgtcagatggaacttccctctcacctcagcgtggaatttactgctacatttaactatcactctttccataatggttgatttcttggtctgttcattacagatcaaaggcatctgatttgaatctttatttctttgcatttgtctccatgacaattttgggaggttttaccgccagcactatgacacgatgtagtaacatgacacatttgtggttaacaacacctacaaattcagaagctcttcggttgtcttcccagcaaatatagctgcttcttttctgtgtatgaacacatcctggaaacacgtacacacccacatagatatatacatgcctatgacattttcttctctgtaagtgaaaattaacctcaatttcatacgaagttcatcatttccctgaaggtgaaggtaggtcgtttttcatctgttctaacaaatgctcagacaccagctagtaagtgaggagctaccctgcttctggatgttggatctgtctcttcccctttgctttaccacagaagattggccacttgtccaggtcccaagaagagagtccaggtttgtcctgataatatgactcatccaacttctgataactctactgttacacacattcatggaggtagcctattaattacataattcactaaacaaataccaaatacccacattgcaataccccatacccaagggtatgttcatgcattcagtgaaggaaaaggcttttcagagacagatagatcaggctagattggtcaatatatgggtgaaaacactggacttgaatgtatctgttttcccccatgtcacatgtgagacctgtcagacaggaccagggttccttgtgcactcagaggtgagggctcacagaattcctctctggtttccaggaaaggtaactgcagtaatcttggtaatgagaatatcctccagtgctgacctattatagagtttacatatgaaattttcactgcaattcacaatctactctttcacacagaagtgtacagaggtcaggacacatcctcagggtcacacattgagaatgatgaagatatgtcccacgagtttttcctaaggtctcagaaagaattccaggactcaaaaggtctcagagggcagctcccagtgccttagttaaaatggtggctcaggcctgtaatcccagcattttgggaggccaaggcaggtggatcacctgaggtcgggacattgagactagcttggccaacatggtgaaaccttatctctactaaaaatataaaaattagacggggggggttgtgcatgcctgtactcccagctactcgggaggctgaggcaggagaatcacttgaacccaggaggcggaggttgcggtgagccgagatcaggacactgcactctagcctgggcaaaggagcaaaagttcatctaaaaaatttattttaatttaaaaatttttaaaaaatggcccactccctagaacagagagattccctctaaacatgatggaggtcccgaactatacattaagtgaatcctggtgtgtctgaactcacatgattattacgttaagctgctgttccaatctacttcctcacctgggaaaagaggagccagggcatggctagttgaggccccaggaagagaactgagttctcaaagggcaaagcaagcatcctcatcccagggtgagcctaaaagactggggcctccctcatcccttttcacctctttatacaaaggcaccacctacatgcaaatcctcactcaggcacccacaggaaaccaccacacatttccttaaattcagggtccagctcacatgggaaatactttctgagactcatggacctcctgcacaagaacatgaaacacctgtggttcttcctcctgctggtggcagctcccagatgtgagtgtctcaaggctgcagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagacacagtgaggggaggtgagtgtgagcccagacacaaacctccctgcagggaggcggaggggaccggcgcaggtgctgctcaagaccagcagggggcgcgcggggcccacagagcaagaggccgggtcaggagcaggtgcagggagggcggggcttcctcatcagctcagtgctctccctcctcgccaggacctcagctgtccccaggcctcctctttctttattatctgtggttctgcttcctcacatcctcgctgcaggcaagaaagaagggagaaatttctctgtttaccattaaggttttaacagtcactggcacctttttttcaacaaattcccacaaggcccattttaccttcttgacaaagtatttcaaggcttctcaccatctcttgattggcgtcatcggctgcatcgtgtcctgctcttaaattcatgtgatgaaaccccaatcccagtggctctgtatttggagagagggattttaagaaggcaaataagttaactgtggccataaatgtgggaccctaatccactaggactcttgtccttatgggaagtggaagacatcagaggcctctctctccacatgcacacagaggagaggccatgtggggacgcgctgcatgagaaggtggccctttgcaagcctggaagtggcctctcaaaaaactaaccctttcttcacccagatcttggacgtcaaggctccagaacaataagaaaattaatatttgttatttgaaacaacctagtctgtggtatcttctgatggaaagccaagcagattcacagatacaattgtgttagctccgtctcctggagggagaagcagcccaccgaggctgacacatctctcagattatttttataaagaaaaatagatccaagatgaaaaccccaccacatttctgctgagtcattcacttagcaggcttctctgagatcagccctggggggctgtgttctaggtcatgtctctcactttccactatgagaatccatgtagatcatgagaaccagccagatggagtcctgatcccggcccaccttctgctgctccccaagtatcccaaagaaaaccactccagcgtcacccctgtgtcttctactctctaaaatcccactaaagctgaccttaaaccaggagatatttggggccgggctcttgttctcttcttcttagtcttccataaggtccaggtgctgagtaaagcctcagtaaagattgagcttcagttcccctaacccacatcattcccttacatccttgtcatgcatctgtcctctgtgggcactcagggcaggttacacaggaattgcctgaagctggcctcaactgatgtgctgagaccacgggtcatgcacatgtatgattccgggtcatgcacatgtatgattccaggtcatgcaggctctactgcaggacagacctgtgtcctgtggggcacagacagctgctgaccccgggtctcctctaataactcacacacctggtgtttgtgtgtgtccagatggccccatgagcacagcacactagggtggccaaccttacaggtggggccgtcagatggaatggacaggctggtcactcccatcatcagtgatttcccagtgaattttaaataaattaaacaaaattaacaacaaaggggaaggatatgtacctgtctctgggaggtatacagggtcccagaactgtgctgggagtgggtgtgaaacgcccttttgtgtggaaagccctccagcatgagtgaaagctgaaggaatgatcactgtgcaggtggaggatgataggcagctggcagggtacatttcctgaagctgttcctgggtgcatgatggttggatggcccatggtgttgagggctggactcacataggaacaaggaaattatcccatgggaatggcagaaaagaaaatggagatggacacccctggagacagcttattagatttggtggaggaaaaatagaaatttattccaatgaccccagcattttcagctaaataagagttgcattaatagacagaattatgaaaggaagggagaaggagtttatggagggaaaaaaaaagaagataaattaaaatttaaaactatgcaaatctatcaattggcagataacagagtggagctgatgcagctacttccttgttctggaaacctgccagagacacttagcattcctgtaaggccagtctagtggtgatgaacttgtccactttttacttttttggggaacttctcaaacctcctgcattattgaagaaaagctttaatccatgtaacgtatttatttggaagtttcttggctttgtttttattttcagcaacttgaacagaatcatgcacatcatgatatttcggtgaacaacaggccacctacaggacaaaggtctcattagattataatactgtattttcaccgcatttttccatgcttagatatgttcatctgtataaacatctaccatggtgattcagctgcccacagtattcactacacttacatgacatacagatttgttacctaggagcactatgctatcccacgcagcctgggtgtagcaaggtatttcatgtaggtttgtgtaaacacactctatgatccttgcacaatgacaaattgcctaaggacacattgttcagatgtattcctactgtttttcatttttttttagatggagtctcactctgtcacccaggctggagtgcagtggcacaatcttggctcactgcaacctccgcctcccaggctcaagcgattctcctgcctcagccttccgagtagctgggattacaggcatgaaccaccacgcccagctaattctttttttctattttttagtagagatgggatttcaccatgttgccctggctggtcttgagctcgtgacctacatgatccacccactttgccctcccaaagtgctgggattacaagcgtgagccactgcgcctggccaatgtatccctactgttaagccacaaatcatcgtatctcatttctctcccttttttgtccctgttaatattttcatgttgtgcgtgcattcttctcctagctcagtgaacatatttataaggtttactttgaattttctgctaggtaatcaatgtatctccttttaatttgtgtcagtttctagtgctttttttgttaaataatttggaccacttttttctgttttgtgattattgttattattattattttttactttctctgttgctttctcctcattagaagaaaaagctaccgtaatcactcttcacagaatatgcccagggaaaatgccatcacctatcaacccaggctgtcattgtggcatctcttaaaacttcataatggttgaaattttttgttgttgttgttattagtggcactcagacctacagaggattttaagttttgctcctactctaaattaggtggcattgaaattcatcctgcaggcagtctctgataaagtggaggaattgggcagttttgttatgcatatggttcataaaaataatatgagtttaaggttttctcagccaagtgctatatcctgatattttataatcacttctttgaatctctcttgggtttatcttttgaaaatttagatcagaatataaaccaggtttgaggctttttgtttggtgtaaacatctcctataggtcattgcgtgaaaaggcacagagtctatctgaggaggagaactcagggaagcctcacaacaacaggggagacaaaaccgaggtcactaaaaaaatatgaagcttctggctcctgcagcctccagacatgccccacaccctctcattgcacagaaatgaattcctttctctttcctgagtgatctttgccaagattcctctcctccactttgacactttggtatatccatgtgtgtccattctggttcagccagggacacagaaccaggaagacatcgtggcttttctagagggagctggcttggggaatcaatggttggagtagaaagtgtctttgtccatgtgtcacagccctgagggacacgggaagaaggtcaggaagacaggatgaccagacggctggagcaaccagtatgaacaaagccactttctttcctggtgaagaggggcatttggaagcctggtgtccctgtaggggatgaaccacactcacctgcccactgttacttgccaacgaggtgacccgcagagcagcagatcctgagtcaccgacagtggctgcttcctcctccaaaccctccaagatctgtccttccaggagtgtgaacctcagcagatccgcacgttttcaatgggtccacttagctagtgtctgtcctcagccccatccctgggatcctgtcctggtgctgtgtacactgtcacaatagtggtgacagtgacagctggtgcctgcactttccaggccaagaagtttgaaagaagcaagtcacagggccagcctggatttggggcaaacacacaaatttcactctgtggggaagtgctgggaagcagccttgagtcctcctcagctcacgtgtggctgctgctgctcatcccaggtgggacacatgagccctccccatgcccaggatggagctgtttcagtcacagcaggatgggaatgtgtcttctctatgggggcttttgaagcacagctctcctgttcctgagatttgagatttataaagacaagtcccacagagtgaacctgcacaaataagacagtgcaggatccccaggagagacatcccatatgagaagggacaggcaggtcccatcactgacgctggtcctcagaaaccctgaccagctactgaccttcccaggtcccctgttcctggaacagttcgtgtgtctgctcctgaaaagatgcccatcaagagtccccagggttctgcccccttccttgatgtgcctctgggagtggggctggctgggctgtgggtctggcgtgaccctctccacaggtcagcggctcagtgcaggctgcaccgactcggtggggctgggctgtggctgaccctcccagggggagcctggactcttcttaggggtatctgcaggatcccaggttctgggagaacagggaagccacagtgtgtgcagggccccatctccagtaaagtgtttgctgtcgctctgttgacaagggcatatccccaggcctaggggcactgtgggcgcacgaccaatgcgcgagacacagggagtaaggcacagttccctcccattactgtgaggacactagacacagtgtgtgtgtgtgtgtgtgtgtgtgtgtgtgtgtgtgtgtgtgtgtgtccattactgtggggactctaaccaccgtgtgtgtgtgtgtgtgtgtgtgtgtgtgtgtgtgtgtattaggagttttgcagtggcctctgagacccatgatcttgcaggtttagaaattatctgatgagatgttcatccacaggaaccgacaagagattaggtgttctcccaaagcccctggaagctcctggactcactgtgagtgtggactgatccagtgcttccagagctccacagaaggggctccctggtggtttcatagaatccttgcttggggtgtttctgcagagttcactggctttcctacgaccaatttaccattgcaagcgatggcgtcagcagcacatggtgtcacgtgtcactaaaggagcattctgagccaggacacagccacttcatactggggggaaaatgctctgggagcccagacaggagcctctctgcagtgcaagggctgggctgcagggggcgctcaaggcccacccagcacaggctccagccccagagcaggtgcacaggaggctgcggatggagtccccttaagatctgtgtcattcttctaaaaaaatctaaaataagtatttgacaaaaactgctgaagagtccataaatatcctattcaactgcaagaatttatcaatttacactggagatttctaaccctgctacatatcttaatagtaagcatctggaggtcaattaagcttttattttatataaataagtgcaacttttggagaaacacactcatcccccaaataacacattcatgtattaaagcctagaaatattttaaattacctctgagctattcaagtgtgggttcccagtgaagtcctgttctagggaaaattgttctccagtgggagaagctctgtcaacatacagtttagggatatggcagggcacacatggcctctaaggggattatagcttgaacccttagcatcctcctgttgggtaatccatgtgtcatctctccactctttctcatgctgtgttaggtatgaaatagcatcgctcatgaatatgcaaataactgagatgactatagatatctttgtgccctgagagcatcacccaacaaccacatccctcctcagaagcccccagagcacaactcctcaccatggactggacctggaggatcctctttttggtggcagcagccacaggtaaggggctgccaaatcccagtgaggaggaagggatcgaagccagtcaagggggcttccatccactcctgtgtcttctctacaggtgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagacacagtgtgaaaacccacatcctgagagtgtcagaaaccccaggggggaagcagctgtgctggcatggaggaaatgacaaagattattagattgaagactttctcagaaaatgatattaagtcattaaggaaaaggaacaatataaacgtgtatttgagaaattttaattatttgagagatttttcatacaatatttattctgcaagcaaatttcagggattgaattaataaaactgatacagaacttcctctgtaggtatctgtgtaaacatcaatttctgaatcagtgttgtaaatattttggaacacacacacaaatcacattttatctctacttttatctctatttttaaaaatgccaaaaaaactcattttgtgcatgtagcattttgaattcccaccatcaatgcatgatagttcttggttttccacattcatattgccatttatcattatgagaattgtgtgttttaaccattctaataggtgagtaatggtatctaatttttagttaaatgcacatttccctaataaaaattcacatttaacaattttcatataatttttgccaagatgcctcttctcatatttggttcatttttaactgcattgttttcttttgattagttgtaagtttacttgcatattgattataaaatcatttaacaaattaaaagaattcatttaacaaatatgtgacttggaagtattttctccaagtctgcggctgtcttttactcccttatcagtatgtattgcagaaaagtgtgtgtgtgtgtgtgtgtgtgtgtttatacaaatttagatttaaaaaatgtaaaatgttattcatccacagatcatgtctttggtattatatctgaaatctcattataaaatacagtaatagcaattactttttccacgtctctaatctcaggctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagactaccacatatgttcttacatttactctttcctcagaaaacagacatttcctcatgtggactcttgtctcagacaagcaaacatgtctccatgtgaactcttcactcacataagtacacatatgtccacattgactgtttccttacacaagtacatatatccaatgtcgaattgttctgtggcaaaatgatctcaagataatgataatcataaaccccctccctgacaaggcatagatctgtatttttttcattgcaacctaactttgccttattgtcaagaacagtagtttgcagctctaaatataccaattagagacaggtgtccattttctctggaaacgtatttttatgttcttactggacatatttgttgataatgtttgctattatgaagataccccaacagtgtccacattagagaataaaaaatagtaatgggcagattaactctgtgcatccagacccagaaatcctttgaccttgacttccctgaaatgtagacacagaggatggatgagcaatgctgagcagtgcacccatgaccacaaaaagaaagacgtggaaatgtgtcccctccacttctcatgaaaggcagctcatcccctgttccctcaggccctggcgaggagccaccccatgtctgtgcccttcctcagtgtccacaccgtggggtctgcattgatctggattctcttctcatccccgtcaatattagtgtccttcgtaaatcaggtccagctgtggcttctcctcacggggctgttctcagtctgtttgctgtgttcacggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtgacacagtgagggaaaccctgtgtgagcccagacacaaagctcaccgcagggagacaggaggggactatgtggtagatgctgctcagaaccaccagggggcatcaggaccatcagggagggtgcacagaaccaccaggaggggctcaggacaccagggggcgctcagaaccaccagggggccctcaggacaccagagggtgctcagaaccaccaggaggcgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcgctcaggacactagggggcgctcagaaccaccaggaggcactcaggaccatcagggagggtgcacagaaccaccaggaggtgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggatgtgaccaagacaccaaggggcactcagaactgccagggggtgctcaggacaccagaggattctcagaaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactagtaggcactgaggaaccaccagggggcgctcaggacactagtaggcactgaggaaccaccagggggggctcaggacactagtaggcactgaggaaccaccagggggcgctcaggacactagtaggcactgaggaaccaccagggggggctcaggacaccagaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatatttaaaaagtaaatactggctgggcgcagtggctcacgcctgtaatctcagcactttgggagggtgaggtgggtggatcacctgaggtcgggaattcgagaccagcctgaccaacatggagaaaccccctctctactaaaaatacaaaattagctgggcgtggcggggaagctgaggcaggagaatcgcttgaacctgggaggcggaggttgcggtgagccgagaacacgccattgcactccagcctgggcgacaagaccaaaactctgtctcaaaaaaaaaaaaaagtaaataccattgtacacttaagtaatatatttggcaagaatggcatttacattcattcaaaaatgaaactgcaaatacgagttacattcaattaaataattaaaataatatagaaaaaaatgggtgtgttgttttggtgtttaatatacattcatttttgcatggacgggtatatgtgtcattgctgggctgttgtgtatgtgtgcgtgtgtgtgtgtgtctgtgtgtacaactatgaagtttaaaatatattattaaattacgtagttatattaatccaaatttatcatgttaaaatattaggaaaaaaacaccagtagagaaattacagagaacatcagcaatgcctacagcatttacaagagtcacattaataacaaacaaactagttcaaatgtttagatatgacacatgcagtagaaaacgttcacatggtattaacacaaaaatggtgcacaactgaggaaattataatacgttcatgatattggctacataaatgcttatgatagtaatgcttttcatccatcaaatgcttatgataatgcttttcatccatcatattatagatgataaaacaactctataaacacttccatcactagcgtttaatatgagatgcctcacatctttttctgaaataaataaacatctgtccaccacttcgatgatcatttcaggattatcctctgaaataattatccataataattttagtaacaatattattttcagaagcctattttataaggtctttgaactattatttttatgattgttactttatattttacacactttttatttggaataattataggttatcagaacaattgtaaggaaaatacagtgtgttcacatccatctccaagttttcactaaagttaatatgtcaaaaaaaacatgggacatgggactaatatatttacattgataagtttctgtttattcagctctgggatttatttgaattttgccaatttttaacagtttccttttttcctttttcttttctttttgagataaggtgtcactttcctattgctttttgtttgtttctttgttcaacccacgtaaccacatcaaattcagtcaccatgttcctctcatatcttctggttaatcacagtttgggttcctgctgtcttcccattgaatattctataaatgaaactagtcaaataagttgattctggtcacttatatatttacctattttatcacgtttgttttgtcaatcacagtaagtgtcgaattcgctatctgttatagatgttagcctattttctatcccagatccattggttaaatctttggtgatgccttttagaaaactgatccctttaccctatgtaatatgccccttgattcctgaaagtcttatgtctaccttgtctgaatttaacatagctaagcacgctttcttttcgttcatattttcatggtccatgttttcctgtatttaacttttctatgtagagcaaatttctgtacagagctagtagttgggtcttgctttttaaatcaactataataattctattttaaaactggtattactatttttctgttaatttctgttttaatttggcattttatgatcatgtttatttctctattaacttattgtttagttcatcttttatgaatattgtattggccctaagatatacaataagaattgtgtataatcagattctaattcaaataacgtaaaacctcttcataggttgtagagctattataacttattcttctaaacactctttctcatccgttgtcttagtttattctcagtttgcacttatatgtgctataaaatataatatgtgcatttttatcattacatagacatatattagaacaattaaaaatataaaaactacatttcaacttcattttttcattcttgaccacatgttttatttggatagattcatgtttcggatgtatatcatatggctactcaccctggcagaaaatttgccaaagcacctactgaaggatgaatgcactagcaataaattttctcagaatcgatttgtcttacagggtattcatttgactttcgctttaaatgaaatttttaatatatatagaattccagtttgactttaatttgtaatttattttcttgtactcatgtattcattattttcttcctgaagatggtcacacattccattctgctgggccttcattatagatatttgtgtgtatctattcagggctatatttgcaatttatggatgccacaattatcagagttgaagtcagcttctgctgtccacagagatttcaagttcctcccatgatacttgcttttgtgtccctgtttgatcctgggtctttatatttagttttccccagggaggctgtctgtttcagctgtggaaagtgcaccctactgacagtttaaattgatgactgtgtggtgaaggaggttggacaaagcgggacttcctccaaccttctgactgagtctccttcttatgcaggagtagtaagcatagttctggggagtggccttccacattgtcctgtccttaactctttccccagggctggaacgtcttttcccagacacaactgtttttcaccagtgtccccagctttttacccactatccttaccctaaagagtaaggatttctttcctgaggaaggagatgggaggtgtttctggatcaagtttccttggtgtcgtctgtttccttttgtttctgttgacttcaccacagctcatatgacacatgctttggtggatttcccctggaggtagtggaggtgcattcaggcattccacaggagctgctgttcttttccccagtcaacaccacaagacaccagatgaggaagttgtccgtggatttttcaagttctctaggaaaagcttgcaagcactaggccaatctaacaccattagtacatgcatactaaaaaaaaaaaagtcattaagtatttctaggttagtctgtttctatctcaaatgccatccagtggcacctgccctacgtacactagcaggtaggtcctggttctctctgcaggctcctatcttctcagatttcagttttcttgtttgcttggtgaaatcaactcagatatgttgaatgttttttctctcttttatttgtagctgttcagcttcgttgttaatgaggtcagaataaaatcacagttttctcatttttttcacattcccacactgaatagctgctttccgtataaaagccagaaactgagagaacacattgaatatccattacaggtgaatgttaaacaatttgagatatgtttgtgtactggaataaaatgctgcattacaatcaagtcatcactcattcacataaaacatggccacattctcaaataatgtagggacctgagtgcccctccatctactggcctctcctggggccctagcctggccacaccttcttgcagggcagtcttggacgccctgggatcccgcaccaaaatttctgccctggcagaacatgcctgactggtggagagctccaatcgggcagccctcatgtgcacacaccagcttacacacttcctccgaatactgtaggttcacccaggcccacgtaacttcccacatcactttgcagtcacatgtctgtataggtgggttttgcttttcttgtcccaccattgcgtggagtgcagtcccctccccccaccccaaccaccatggcagaggaagctttggtggggaaaaagccagggccgctcctgtcagcgtcccgcacttgcgctaattctgcacagagaatagcagatcatctcacacattcagaaatcactcctgcttgtggggcatgaatacggcacccgggcctgtgcccacaagtgtcccatccctgagccaacacctcctccagtgtgaccttgaacacagtcaccaacagggccccacagacgcaatgcctctgccactgtggcgaacacctgcagggaggcaggcacccagacacccactagcactctgccacagctgccacacctccaacagcccaggacagtggattcctaaccttaaggagccggagaaccaagtcagggactagtataacttcccccagagtcagagcacacagtctaggtgttgggagctgagcactggccacctaaatttttccagaaatgaagccagttggctgaatccaccttataccacaatcaaaccctcaaggtcatccaatagggtaaaagaaaataaaaatgtatccaaaggtcagcaacttcaaagattgaaggtggataagcccacaaagatgagaaagaaccagtgcaaaagtcctgaaaacaaaaagggcgccctctttcctccaaacaaccacagcacctcttcaacagcagttctgaatggggctgagatggctgaaatgacagaaacagaactcagaatatggagagtgaaaatgtagatgaatacagctatttatggagaatactataaatgttcctcaaaaaataaagaaacaaaatctactgtagaatccagcagtctcactgctggctatgtatccaaaggaaatgaaatcaacatgtcaaagagatatctgcactccatgttcacgttcattgcagcattatttaaaatagtaaagatatggaaacatcctaaattcccatgaatggatgaatgaataaagaaaatgcatacagacacaacagagtaatgttcatccttaaataagaaggaaaccctgcctctgtgacagcatgcatgaatctagaggaccttatgccaagtgaaacaagccaggaacagaggaagagtcattcatgatttcactgtatatattaaagcagtagacttgcagaggtagagtagaatgttggttaccagggcctagaggggtggactgggaaagggagatgtgggttaaagtgcacaacgttccagttagaccggaggtataagttatgcctttctaatgcacagcatgtcaactatagctgataaggtagtatatatttcaaaattactaaaaaaataaacattagaatttccccactaagaaatgataaatttgtgaggtgatgaatataagcggcttgagttacccagttcataatgtatacatgtatcataactaaacaacatatgtcataaatatatgcaaaaattatttgtaatttataataaaataagtttcatatttaaataattacattaagaaaatgaacagaaactttcagatttcaagaatattttatatatatatatatatatcttaaaacaaacttgcaacagaatatagaaataagttttacgactcaatggaaaagaacagaattcaataaaaactggctaaaagaaacaacagctgcatcattatagaaaattctggaataatcagccatataaagattctcactctcttagaactagaattccgtaggacttgtaattcctcctgacctgggtgggaggcaaaaggaagaacagctaatggtgattcagtgagttttatacctgtgtgtacttctgtgctcactcagcagaaagaaaagaagaaaagaaagaaagagagaaagaaagaaacagaaagaaagaaagaaagaagaaagaaagaaagaaagaaagaaagaaagaaagaaagaaagaaagaaagagaaagaaagaagaaggaagaaggaaggaaagaaaagaaagaaagaaagagagagagggagagagggaaggaagggacagcagaagtcattgtggtgtgtgtgaaagcacaatccttgggctcccccacatccatctctactccagtcccatcaatgtccagcaaatacattttctaagatgaagtattttaaactttctaaatcctgctagaaaacccctcagctctttcagttttgctctatcacttgaattattgaattaaatctagtttttgtgggcctatcaataccataagccaaaataacacatgaagaaattgcactgagacacatgaaaaccttctgaaagctccataatttcagatctgcattcttatttccccgaacctaaatcactgaatagagactcagaacgagttgatcttgttcctgaacgtgcacagagccaaggacatcctgtctgtctggaacagctcaggtttgttcctgtttctcctagaggatataaaatcttgagttagggaaaaacagccagggacaccctgggctttgttcttctctcccctggaggcaggatgtccttcagagctttgtcccagtgggtaacacagctgctgaggtgtacaacccacgtggcctcgttttggtcacttttgcatggtgagcctgctttgcaccatggcctacaatatgcgtgtgtaactaatctgtctccatcttcaaaatgacattattccacatcaaatctagtgcaggtgcctcacacagaacattctcaattacctccatcattcataaaattgatgccattaatttcaagtatacatacatcagactcatttaacgtattgttattctcattgtttgaaacataacttttagatcaaataattaacaataataaaaatataaattttgaagtcaggtaatgtgatttctctagttgtgttctctttgctcagaatggcttgggctgttctgcatcttttgtttttccacatatattttaggattttttaaaaatttctgtgaagaatatcattgttgttttcatagggattgtactgagtctgtagattgctttaagtattatggacattttaacaatattgaatctttgaattcataaacatggaatattgttccatcttgtgtcctctttatttcctcaatgttttatagatttattgtagtttttttttactttgttcattacacattgtatgcctgtaccaaaacatcacatatacccaacaaatagaaatatatatactattatgtgcttataacaattaaaaattatgtatgtatattgaatctattcaaaatcagaaactatttctttttactgtttgtaaggtcttgtctctaggctataaaaagaatttgtaaaactcaacagaaagcataatataaacagaattctaaaatgagtgaaaatctgaacaaacacctcaccaagaaaaaatgttatctgaaaataagaatatataaaattgttcagtatcaattgtcataaactgatactcatatttaccaaatacaaaagtaaacatgatgtatttcaacagaattgattctcaaatatttgtatactcatacagtggaatactatcagtcataaaaactatgggttattaattcagaagacaacattttaacattttttctaagtgaaggaagatggacaaaagagactaagtattgtacaattccattcatgagacctgctaaatacagtaaaattaaaaggattttaaaaacaggtttgtgataggcagggcttttggggaaagacaagagactgacttggcaaagctcaggggatatttttagggtaaaacaaactgtgtgccattgtgatatgcctaatttcttattatatttgttcagagttaatagtgtacgtttcaaccaactcggtgattttatattttctatttgctgatagagacatgttcatttttgtcaatcactttgctaaatgtggctgagaggctgttgaaatgaacgctgagcaaatgtattcaccaaatctacaagagcaaattatttgccaattgctgattgagtggggtctataatgtatttgagattgggtgtggggatgttattgtgtgagatcatgatgtttagaccatgacactctctggtgagggatcactcattcattgcacatttaatgaaaggcaggtaggaggagcagaaggggatgagtcacactcctgaccacagccacaggttattgaaggcagaactgatgtaatcccctaaggtagaccactgcccctccaaggtgaccttatcctagagttgacacacatcctgggacaccagagacaactccttctctcccctttctctgcacttcagctggaagcaactgtctcaccgagcaccttgtgttaaggaatgagagttcctgttccaggtgtgagggcccaggtgcatccacttgatccagcacaagagcaagaacagccttccagaaaatgacatcgcctgaggtataaccagctctcacctgctgcagcttcctctgaataaaaaggaaactgttgaaacttcctcataagtgtcctgctgtgccattccctttgtccccacatgttcagttgtgtctgtccagatgtcacttttgtgtagggagattagggttctgcttccagtaccagaacacacatgacctcttaggggacttcagggttttgctgacatatgtgatgatcttaaaagtcattagctccatttctacatcaaaaaacatctgaaccaaaggagcacataggctcaggcctgtaatcccagcactttgggaagccaaggcagaggaatcacttgaggtcaggaatttgagaccagcctggtgaacatggtgaaaccccgtctctactaaaaaatatatacaaaaattagccaggcgtggtggcactagcctgtaatcccagctacttgaaaggctgaggcaggagaattgcttgaacccaggaggtggagattgaagtgagctgagatcgcaccacttcactccagcctgggcgacagagtgagcctccatctaaaaaaaaaaaaaatttatatatatatatatatatatatatatataataaatatatattatatatcatatatatattttatataatatatatgtatatttttatatattatacatacatatcaatatatgatatataatatgtatatataatatataatatgtatattcatatattatataatatgtatattgatatatattacacatatatattttgatatatatatatctccaaaccatctaaatatcaagtattttttaatccatctaagagctgaaattgctgaaaaaactactccctccaaaagctgtagagacaggcacatccacagtcacagcagagacttgctgacttggaagagaagctcctggagacacattggtgagaacatttacctggtgattatgctgaatgtctggaggacaaatgtggactagggggagggtgagcactcctagaggctgtacaccccacacttgtgtggacttgccctccagggccttcaggttctcgtggaagcaattaaaatagattccctatagccatgaactggggaggagtaatcacggagaaaagatgcacaaaaagacttttctagaaagctcatccaagggaaggtattctccaaaatcttagtttatgtgggggaaggaaatacttccaaattacagacccctcctcctcagccttcctctatcacgcaaatgataaaattagccaagaggagtcagattcaaggcggtagccctgggtgcagcatctgcagaagggaggaaagagagaaaatcagctgtatcactggagattccttgtgaaggtcactgctcaggagaagagggcaaccaaaccagggagagtcaactgtaagaacataccatgctcccctgccccacacattacctcctcaacagcatcattaatatggattaaagagggcagtgtgattgctttagatctgtttgagaaagaaagtcacatactgaggcctagggtcagggtcggcggcacttcccgtgagtaagatactacgaagaaggaaaaattaggggtccataactgtgaaaatcagccacagtgtgtgtgagaatgtttgtgtttgtgtttctgtgtgtttgagtaggagttattggaacagcggacgtggagtgagctttaatccacatccatctgcagcttcaggtattctcagatgcagtattcatctgcaagagccgaaatgagaaaagagccacctccaacccccccagagttttagcctccctttgtttccagtgatccagtgcatctagacctccaggaagtggactccctggtgattttagcgattcttctcttggagccaccctgaagaggacattgggtttccaaaggcccattcactatttcaagaagtggtgccatcagctcatgttgtcactgaaggagcattctgagccagggcacagtcacttcctagtgagctacagaggctgagagaaaaatgctctgtgagacccaatgggaagctccctgcagtgcaaggtctgggtggcagggagcgctagggcctcgcccagcacaggctgcagccctggagcaggtgcaagggaggctggggaggggttcctcccagggtctgatgtcttccttttctcggacaaacatgctttaataagttaaacaagactttagtaaagactattgatgtgtctttgtgtctttcagtatacagttctatttgtaggatttatctaacctaacaagtcaatgagaatcacatgtaaaaggagaaatttctaggattttcagatatcttaataggtaggagatggagaaaagggatggttttattaattcagtgcttgccaatcttaacagagacagtagtaagacatgcagaaagcaaagcccagaaaagtatgaaggtgtcaaagtgccatttaagtatgggttcacttggaggaccatgttctgcgggaacttgttttcagcagacaatctattttagcagagttctgggcatacaaggggacacacatcattaaacaaggattgggacagggacttcagcgtcccactgttgcatggcccataaattatgtgtgttctctttctcatcttggatcaagtctagagctatgaaatagtatccctcatgaatatgcaaataacctgagatttactgaagtaaatacagatctgtcctgtgccctgagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacacagtgtgaaaacccacatcctgagggtgtcagaaacccaagggaggaggcagctgtgctggggctgagaaatgaaagggattattatttttaatgttgtttacagtatgtcattaataaattgaaaaaaagtaacaatagaagtatatactctaattatatgggaactttgttttttcagttttttcatttttttttttttttttggtttgtttgtgacagagtctcactctgccacccaggctggagtgtaacggcacaatctcagctcactacaacctccacctcccaggttcaagcaattctcctgcctcggcctccagagtagttgggattacaggcacccgccaccatgcccggtgaatttttgtatttttagtagagacggggtttcaccatgttagctaggctggtctcaaactgctgatctcaggtgatctaccctcctcagcctcccaaagtcctgggattacaggcgtgagccactgcgcctggcccaattatatgggaattgtttatataattatcaccctataagcaaaattcatggaggaggaaaagctctactgaagaaagctgataccggcattcccatgaaagtatctgtgtagaagtaagtattaaaatcagttgaataggcaaggcatggtggctcacgcctataatcccagcactttgggagaccgaggcaggtggatcacaaggtaaggagttcaagatcagcctgcccaagatggtgaaaccccttctctactaaaaatacaaagaattagctgggcgtggtggtgggtgcctgtaatcgcagctattcgggaggctgaggcagagaattgcttgaacctgggaggtgaaggttgcagtgagccgagatcacgccactgcactccagcctgggcgacagagtgaaactccatctcaaaacaaaacaaaacaaaacaaaacaaaaaaacagttgaataaagtaccttagagtcatctgttcaattaacatgtttaactccaaagaaatactgaaaatattttccaaaaaggaagtgccattttacgttcctaccaacagtgaataagattttcttttctggagccttgtcagtattcactaatgctttgctgtgcagccgttgtaatattatagtaaatgagtagcagtatttaatggttgttttaaatatacatattcttaatacaaagtcttgatgaacacttttttatacattgttttatgaggtgtgtgttcagatctatgtatgccagaaatgcctggcagcgttaatttaagcacactgtgagaatgaccctatagtttatgaagaatgtatgttcagagctctgagctaagaaatccaggagctgtcaacccagaagtttattccttgtctgtgaaggacatctgaatccctggcctatcccttggaacacaggatgtccaggtgattgatgctctttgttaaatctggaggttgctaggtagagggtgctaagtgaaaatcataatataaactacacgtgttttacaaatggtagtggttttcctgtccaacacacttttcctgggccacattgtatgcaagtcctcaatacaccctaggtcttgttcatgggctccaggtctcctcttcagccttttggacatggtgccatgcctattacagtcaataggggtctagcatgacaactggtaggcccagaacaaggtcaaagaaaatcctgcaagctcttagacaacagtgtcaaggaaggggagacctgtggggaaatcccaggcaggccatgcacatctctgtgggcccaacagctgcaatccttgatggatggggcccgctgcatgtgtacggggatgcctccaaaatgccaaaagttctggaggacctgttgcctgaggtggatgtgacaatgtgacaaagtgacagtcagattcctgagctgtggcagctgttggccactcctgactgcactctgagcaaccactgaggcagagctcattgcacaggctagggtgtgtcagccacgagaacagttgtaactataatgagatgccgcctgtagggataggatagcaaattggagaccattgtttatttggtaggccatttaaagtgttgctgactgccacaccaatgcattaggactactatgactacgtcatcctgggagcctaagtcctggcgtccgatgtagagctccagtgggaaggagatgaaggttaggatgagtccataaaggttcttgctctgcagcccctgctttgctgtctcacttggtgaacagagaatgggaggtcaatgcggacaaagtccagggtccaggcttatcagtcaaatacttggtgtcatctggttacataagactatagttattccatatttcatcatagataagataagatgcaggtctactcatgtcccaccacaccaaagcagttggaaacctcccaaggcctcctgggacattggcgatcctttattccccatttcggcaaaccccttgggcccccatggcacttagacaagaaggtgccccactgcgactgttccaaaagggaggatgagggctctgaagaagctgaagtcacagtgaaatgaatacaaaccttgggagttctagtgcagggacagccctgtgaattggatgtagtcagttaccctgaggggtttaggtggggactgtgttaaaggcaaggacataagtgtgtgtccctaagaccctggtctcaaagacagaaggaagctgaagtgagatatactgtttaggagtagcaactgcactacatgtcatgccttacgagtgtaggatgtgacaaagagggccactccacatccggaacaacctttagcaggctggctaaaggatgccttccagacacaaaagccttggaatgccaggacacagtctgtagccaaatggtacttgtggtggtcaccaccaacataaaagtgggccaactgtgccagcagaagttagccccacagaactttcccccacctaagagaaggcagtgcaccacaatgcggaattccaccactgtggaattgggggagcttagaattggattcagacacaaggggagagagtggatcacagggtggcttctctatgggatagggggtggagagtattatactctctggactcaagatgagtaaaatgacacccatcacaaaccatccagccctatgatggcacctttatggtaagtggttgcaggctccaagggggccgggtccaatgaggaagatgcccccacagctcgttctcaatggcagactatagaagagttgcaggatatcttctgggagtcgagatgaggcatgctaattatgctgagaattattgaagtcccaacaatgaattgtttactgcaaaataaaagctacagttatgtattcagtgcctacccaatggcatggtgcactgatttccacgttaagccccctgggagggcagccaacatttcatgtgccccaggtagttgctgacttaggagaaaagaagaaactgagtaagcaagggatgcaccctactgtgatgaagaacaatggcaccaaaggaagagagacagccaaggagccagtcagggtggccagacaacgaatgtgctctaactggcaacacctaccagttctctgggcccatagcggcaataggtggttatggaagggccacggaagtcagaccggttgaactagtgatacgacctgggggactgccacccagaccctgtgtagtatacacagcttccatcctagaacacatgagaatggatatcttcttaggcgtgaccctccaaacaacggccagggaattccaacggagagttagagtggtgatatgtgtgaccaagcagaaggcaaactggatgccagtagagctgccaacccatggggagtcccacagctggagcaacaccacccgccctgggaggggaagatgatccaatcatgaagattgttaaggagctagcccaggtaggcattaggaggccactgcatggttcctacaacagacctgcatggcccatgcagaggccagttgagacatggagaatgacagtagattactgggagttaaataaggtggtctcccgagtgaatgcagctgttcctaatatctcctccagtctgacgagaataggagaggtgttagccacgtagcatttccttatcagtttagtcaataccttcttcagcatttctgttgccccagagtcaagatcaatttgcattaacctaaaaagaacaatggacttttactgtcttgttccagggatatttacacagcccaaatctcacagcctagtgacctccaacctcagtcgatgggctgacccaaaggggatacatgttttccactacattggtgttatcatgataacctctgagtcttttttcagcttataaattacagcccctgtcttgctgtctcacttgctgaatagaggatgggaggttaatacagacaaaatccagggtccaggcttatcagtcaaatagttggtgtcatctggttgggtaaaactaaagtcattccatctgccatcatagataaggtgcaggcctacccacgtcccaccacaacaaagcagctgcaaactctcaaggccttctggagcatcagtgtccttttattccttttatttgacatccctgaaggaggctgctaggggagactgtgtccctcctaaattcatgtgctgaagtcccaacccttggtccttcagaatgaaatcatacttggattagtgtcctttaaagaggtgaataagttaaagtgagattcctggagtggggccctaatgcaatctgactgttgttataagaagaggaagcaggagggagggtgcacaggccccgagggacggccatgttaccacagaacagtgagaaggcgccatctgcatgccagggagcgagacctcagaggaaacccacccagctggcagcttgatcttaggctttcatcctccataagtgtgaggaaattggttttgtattgtaagccatccgatctgtggtatttcgttataaaagccctataaaatgaatacagtaggtaataggagagcttctatacattgaaaaagtcggatggccagaaaaacctagacactcctgttcagacctgagcagggtgatggacctgctttgggacaggagaggggaagagatgaacccagcacccagacccagctgagcccattcctcagcaggccgtccctgggccggagcttgcacaggtgtgaaagagcctgtcttggtcttcaggggctcatggagttggacggagaatggtgtagactcaagaacacgtcatcggtgtgcccgtgtttatctgaatgggatgtgtttctagggtgtgctcatccccaaagaagaattaatcaggtctcttgggctaaaaagaggttgtggcatttgtgtgtattaataactgtggtcggacagtaaattatgttaaactgcttatgggaaggcacaatggaaagaaacactttgttacagaaggaaaaaaaaggtgattatttaaatgaggtgcctttgaaggtcaccatgccaagaggagcccatcacatgatagtgctggctttcatgttcaggagatcaggagggtccgtccgctggcttttatgacaccctagacagagctgagagtgtaatgtatgaatggaggggaagtggagagaggggaggccaaatgtttggtgggaatggagggtcactattggagccattaggaaatacacaagcatgaattatgctggaggacagaacagtgttcctggggaatattgtgttgctttgggagctgctgaacatacaggagtttcactgttcctagttctcaaattctctagactctctggacaacccagttttaaatattgggaatataggtaagacacattcgttattaaaaattattaagagaagatgtaggaagaaatttaaagtaatccatttggttatgaaaatttagttacagcgaactgtgatgtccgtttcttacttggaataatggaatgtaagtcattagtcatctcaacggttcatttttccataaccatcaattacaaaactgctgagtaatttcctgaattgcccaccatagaaactgacctcacatttcctcaatgagaaactgccagtcccgttgatccagcctcgttcttcccatcagggattttgtatctctgtggacgtgtggcacagtgctgcatatccatcggcatatggcctcaggaaaggcgccagcctatccatgcatgatgaagcttacttaggggatgaagcccgcatgctgggtgagccagtgccaacagctgaaagaatcaactgcctggtgtatgatgcttttatgaaaacaagcccagggcctcttgcattcttctgtattagattctctggtgaagatttttattcatttctgcctgaaattgccacatataattacctggaagcattacaataaactgatttggaagttaactgacttcctggtgaggttaaaatgagtgtcaggtgcatagtgagacagaccggagacatggatgcatagcaaacttgtgctcaccatggtttctatcttagttagggaaacttctgtaccttccttagatgttcaggcactccattgaggaccctggcataacattatttattgacagaccatagctcaaagtatagaactggatactaccaaggaggatatactattactattttatctttatcttaaaatatactcttccatctgaggtgaaaattaatccagatggtagaacttattgcagttactacagcattttagcaaatcaaaagccgcagaacaaacatatggacagatggcaggtatgttttcggaatcgtaaacaagttcgtgatgactgtaaaaccaaggggtgtctcacgagggctggaaacctctcacaatgaaacaacacaatgaggatctttgaaaagtactctgacctcctggtgagctggctgatatggaggctgagctccatgtagaaagccaaaggaatttctgcaggacgtcatcatgccaagcacagccgtaacctgggtcccagcccttttcacacgctcaatggttagatcttgggagggaatcaaagaagccatagtaaaatatcaaaatttaaaccccgattttgaatttaaaaagtgttaaaatatggttgtggcctacactcagaaaatctgtgtccttcagatggtttctcagtggcaccagatggtttcaagtggctattcattaagtttctcagtgaaattaccagacatagaataaataaattgtcactgtcttaaatcaacccatgggaaaggaaaactgtgtaaatacagcagagaggaaacattgctcaagggaaaaacaatctccagaaagtattgttaaagaaacagaggccctctttccagccagcgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgttcccaaaaaaaaaaaagaaagaaaaagaaacagaggcatcacacttactagaaaaacatattctatttcatatattatggggatatgacgtgatgttttgacatatgcgggcattgtgaaattattaaatcaagtaaataaacatgtccatcacctcacatacttattttttatggtgtaaacgtgtaaaatctactctcttatcagttttcaagtatatagtacattagtatcatggaagtcaccatgctgtgcaatagatcttcaaacgaattccttctatctaaccaaaactctgtaccctttcaccaacgtctcagctttcacatgcccctgacgccagcccctggtaggcaccattctactctctactctgagttcaacatttttagattgcatgtgtaagtgagatcatggagtaattttttatacctggcttatttcactcaacataaagagtcaaatgctcaacatcactaatcatcagggaaatgcaaattaaaaccacgataagatatcacctcacacatgttacaatggcttagtctcagtctgtctttttgttactataaccgaataccagagactgggcaatttctaaagaaaaggaatttatgctttatggtgcttgagtcagagaagtctaatatcaaggcactggcatctcacaagggccttctcactgcctcatctcacagcagaggtgggtgagcaagagaccatttgtccacgagagaaaagagaccatcttttattagaaattcactcctataataactaacccactccattgatagtgacagtaatccattcatgaggacagagccttcatgacttgatcacataataaaggtcccacctctcaacactgttgcattaaagattatttccagatcctaaactttgggagacacatttaaaccatagcattccattcctaatatcaaaatttatgtccttatcacaatgcaaattacattcattccatcccaattgtctccaaagtcttatccagcatcagtgcaaaagtctgaagtccaaagtctcatctaaatcagatatgagtgtgactcgaggcacaatttagcctgatataaattgtttccatctgcgagcctataaagtcaaaacaagttatctactttcaaatacagtgaacaatggggcaggtatgggatagaaattcccattccaaagctcagagagaggcaaggagaaagcggtgcctagttcaaaacccaacagggaaaaaaacattaagtcttatagctggaaaatcatcctctttaacggcatcttgtgcacactggggagggggatgggcccccaaggcctccggcagtcttgcctctatatattttctgggttcagtccactcagccgctctcacaggtgggactctcaggcctctagctctcctaggctgactggaaactctttgtggtacctccaaacccacatttctgcttggcattgtgctaagggcccagtgtggtgactctgtctctgcaacaagtcactgcccgagaccttaggctgtccttaggctgcccgagaccttaggccgtccacagcattctttgaaatctaggtggagaaagccatgccctcgtggttcttgtattctgcacacctgcagaattaacaacacatggatgccatggaagttgatgacttgtaccattaaagtgatggcttgagccacacctaggtcctcctgagccacagcatgggcagccaaggagtgctgtgcctggacaccgggaacagagtcctaaagtgcctgctagaagtcaggccatagatttccttcaaatttctcccaccatataacctcgttcatggctctgaacttccaccttacagaaggacctagggatgaacacaattcagccacgttctttgccactttatggcaaggatggcctttgctccattttccgatgagctattcttctttttctcctgagacctcatcagaacggcctttattgtccacggttctactgacattctaatggtcatcacctaaataatctctaagaagtttcagaatttcctcacagctctcttcttctgagtcctcaaaagaatcacctctagtgttctattcagggcaatccagactttttatagtctgatcctccaaattattccagtctttgtgcattactacatccacttctacattttggggtatttgttatcgcaacagccccacctcttgatactgatttttcgtcttagtccactttgtggtgcaatgagtgaataccacacactggctaaagtataaggaaaagaaatttattttctcgcagctctagaggctgggaagtcaatatcaaggtgttagcatctggcaagagccttcttgctgtgatgtccatgtggaaggcaggagagcaggtgcgaaggatggaaaggggtttaaactcattttttaatgaggaacccaggcctgtagtaactaatctgctaccacaatgagtaacctactctgacgataatggcattcattgcttcatgagggcagagccctcatgacctaatcatttcttaacattcccacctctggacactatggaatttgggattaagtttccaatacacatcctttctaaacagcaggggctttttaataggttgaccacccaaggctgcaggaggctctgaagcagtggcctgaggttggctgtcctttgtgagaatggagagaagtgaactgactcatggagacacaagtagatgaggtaaaggcattcattgcttcattacatggatggtgaggtcgattgaaggcattaacggattaaagatggtggcaaaaccgtctgaggtggagaccacggggagtccatcagaaatggaggacacgtcccaataaatggtgcttcatttccctgcaaagcagaagaaagcaaagaacaaaacacaacatcatagtgtacactgagcagtggattgagagaagagtttcctaaggcataactgacagagtggagaagacacacaaatctttgcatgatgctaacatttggactgtggcttcattatttcttattaatattttactgaaatatcgctagaaggagactgaaaatgaagtgtgaaaagttaaatgggatttctgctctatgtccttttcagatgagaggaactagggaattccagggaagaaacaataatagctgctgagcaaggcttttgcagggcaggacaaggaatccccaaagagaaaacggaaacctcagcttcactttgcatctgctcctgagccaggtcctgagcgacccctgtaggtcctgagtgcccctccgtaggttctgagcatcccttggttgctgggcgccctctggtggtgtctgagcccctctggtggtttctgagccccccgccttatgtctgatcctccctggtggtgtccgagtgcccctgctagtgtctgagccccctggtggtgtctgagtccccttcttagtgtctgagccaccctattagtgtctgaggacccctgatggtgtctgagcccccagttagtgtctgagccaccctattagtgtctgagcccccctggtggtgtctgagcacaggagagctcctctgaaggaagggtctacatggggacaggcgtgcttgtctcagggaagggtccatgtggggacaggtgtgcttgtctgaaggaaggttccacatggagacaggtgtgcttgtctcagggaagggtccacatggggacaggtgagcctgtctgaggggacagaagtgcttgtctcaaggaagggtcctcatgtggacaggtgagctcttttgagggaagggttgacctggggacaggcatgcttgtctgaggtaagggtcctcctggggacaggtgtgcttctctcagggaagggtccacgtggggacagaggtgcttgtctaaggcaagaatccaagtagggacaggtgagctcgtctcagggaagggtccaggtggggacagttgtgctcatctgagagaagcgttgaagtggggacaggtgtgcttgtctcaaggaagggtccatgtggggacaggtgtgctagtatcaagaaagggtccacatagggacaggtgtgcttctctcagggaagggtgcatgtggggacaggtgtgcacatcggagagaatggtccacctggggacaggtgttcttgcctcagggaagagtccaccttctcagggaagaagtgtgctcctctgagggaagggtgcacatggggacaggtgtgcttgtctcagggaagggtccatgtgggaacaggtgagctcatctgagggaagagtccacgtggggacaggtgagctcatctgagggaagggtccacatggggacaagtgacctcgtctgagggaagggtccacgtggggacaggtgagctcgtctgaaggaagggtccacttggggaccggtgtgctcctctgagggaagggtccacgtggggacaggtgtgctcctctggagggaagggtccacgtggggacaggtgagttcatctgaaggaagggtccacatggggacagttatgctcctctgagggaagggtccatgtggggacaggtgtgcttgtctcagggaaaggtccacgtggggacaggtgtgctcaccttggggaagaggacagatgagctcatctcagggaaggggccatgtggggacaggaccaagggttgggacttcagcacaagaatttaggaggaacacagtcttccctagcagcctccttcagggatgtcaaatattttccttctgttccctgtgaaagccttaaaggggtagggaaagggcgttcaacctgcacactcgtagaggggaaaccagcttcattagtaatcgttcatctgtggtaaaaaggcaggatttgaagcgatggaagatgggagtacggggcgttggaagacaaagtgccacacagcgcagccttcgaaacacaccacggtcacgttaagtttaaatggagtgaccacattcgccaggaaagggaaatatttacacttttgaagaaacagtaatttgtgtttctgattatgatctggccttggattttccctcccctcataagcaatgacagaattggcagaaatatgtgaaacgttagttctcagacatgagacacccacagagggccccctgtgcccttccctgagagctgatcagctcctgcatctgaagaaatgaccaaagaccaggagagaaccacacagaagcatcggagggacagcacctggggctctgatggggtcaggaatagcatctgttcccaatagatggactaagtaaaaagtatcataattcacaagagttttacatagcacagaagaaaaagttaccctatatcaactgttgatcttgtgaatccaggaactctggattcaaggtggtcgggcacatcttgatttacgcatttcagggacacatgagacatcagtcaatataagtaagaaggacattagttccatccagaaaggctgagacaactcaaagcaagtcctccccacttagggcttccaggtcacaggtaggtgagagacagatggttgcattcttttgagtttctgataagtgtttgcaaaggaggccatgaggatatgcacctgtctctgtgagcagagggacaactttaaatagactgggaggcagatttgtcctgagtggtttccagcttgacggggcccaagatattttcctttcacaatctggtaacttcaaacaaaacttcaaagccacaacaaaacaacacaacaacaaaaagaataagacatgggtacttattaagagtagaaaaacattcagtccccaaggaaaatattggcagtgtctacctccacatgacaaaggagtaagcagtgtgagccacagaaaggagcactattaacccacagagcaaccgagaataacacgggtgatgcgagggcattggacgcacatcattgcattttgtagattcagaaagaaacggaaaagattgacggtggtaaaagagacagccctgcttccctctcccttttccctccccgatgaggcctcacagccatgaccctcagcctcatcccgcagtgcagcagctgccgtcctgtccaggcccaccccctgccccgccctgggactgttacctcattccctcccggagtccaggtgccccccggggtgtggtgcgggagcctggggaggccctttgttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgcccgtgcaagaccaccacgcttggcacggccccacctcgtgtcagggcctgtgtcccctgccccaccccctaaacagatgggaaccactgggactctgctcagggcagggggcggaggtatgtgtgaaaggaaggcaaatgtgcactctgttggagaaatattataggtagtttgagcaaaaaatctaatgccatgggaacttttagaatgatacgtattttaacaaagaacatgaccaatagagtttgtattgaagccaggaaaacactatttagagcaacagcaatatcaaaaacacaagccaacagttcaccaagaaaaaccaccattaaccccatggaaatggtcttccaagagcatcggcacttaaatcctggaaatctgcctgcctcagcacctgttgtcctgacctgccctcctgtgtgtcctaatcactcccaaacacggggcctgcactgtgggagattcacactgtgccaggtggagggagcaggacaactgctaacaggttgttggtgtggatgccgaggccacccaagcaggtgtaaactcccacctgtggggcagggaagagtgcacgggagacatgtcccgggcatagggtgagggagagctgtgggggctctgggttctgaagtgggttctgaagagggttctggcctggcagggataagaccaaccagcatgtgaggccaggctggagtctggacctctgaagctgcaagggtcatgggctgcttggccccaggggctgtcctggttctctatggagtactttcaaacattctttcttcttccaatccccctccttctctcccaaagcctgcatctcccaaatcctctttgtcggatcctcggcttcactctgcatccgtcctgagcatcgatcttccaattccatcctcttctcttctgctatgtctaagctgctgtgaagccacctgctgtaatttactgctttatatttaatattgtaccgtacatctgttctgtttccctcatcataaatgcttcatttcatgctcagcatctgagaacacaaggccttgtcagctgtcacctccttccgttctctgtttccttcctcctatccccatattgctcatcatgtccagtctcctgccatcctgaatgcttctgatggaaggtctgagatgtctcatgagcactgtgaagattctttgtaatgtgagcttgttccaggcaggaattctccttcacccagccctggaagccaagtataggcagatggccatgctcaatcaaagactgagctaacttaacagtggctttggttttaaggtttctccaatccccagggcacaggatttcagggaattcaggtgagagtctgggtgttacccttcaggaggctgtaaactccatttcacctagtctacaccacagactatggaaactatatatatatatagttctgtccctctagagaaacctaatatgtatatatacaatatataatacgtattatatattatatataatacgtattatatattatatatattatatatatattagagtttattgaggagtattaaactcacaatcacaaggtcccacagtaggccatctgcaagctgaggagcaaggaagccagtccgagtcccaaagctgaagaatttgaagtctgatgttcgacggcaggaagcatccagcacaggagaaagatgtaggctgggaggctaagccagtctagtcttttcacgtttttctgcctgctttatatcctggccacactggcagctgattagatggtgcccacctagattaagggtgggtctgcctttcccagtttactggctcaaatgttaatctcctttggcaacaccctcacagacacacccaggatcaatactttgcatgcttcaatccaatcaagttgacactcagtatcaaccatcacaagtccaccccttgtcaacttgaacccatacaaatctcctgagatcatacataatcttcaaataaagacaataataaggtcataattacacctaatgtaatacaactatcttttgtacaaccagaaatgcaccaatccccaacccaaatgctattatgtaaagttaagaacacttaaatgctgatatgaagtcaataaattttatgtcacatgataaaggaaaaaagaaatgaaggaattttcttagtacaagtgtgtacatgcacaaacatgtttttaacaaaagaagaaggaaatactgatgacaattacagtcctcatttctgcaactgatcacgtggttgtagctggtattgatgactaccttcttctactacccattctgtattccctttgccttcagcaagcatcacagcaggtagagttttttctcctagtggagtgatgcaaaccttcattcctgaagggtctgggccatttgtagtcctgcctggattgggctgttgtagtttcccgttgaccttaatgacagggcatggtaatgttaagagacgccctaatggatctcctgtattccatacatattcttccttacctccattgtggagtaatagactgattgcatcttgatagtccaggtcaatcagcccagccaacactgtaactcccctcttagcctgtggacttaaaggtaggaggggcccaaagtggccaggtggaaatctttacttccagtttaatggaattgttgttgtttctcctgatggcagcattattcccactggaactaagacctctaggccaacagaatgtaatgtcatgggaccaggaagcaaaaattttgctagtggatcactaggggtgatggtgaatggtgccatttccacttccaccccttgattcctggatccatgaattatggctatgggagaaagagtaccatatattggatgctgatttggagcatacatggccttttggagagctttgccccagccctgcaaagtattggagcctagttgacattgtaattgtgactttgaaaggccattccattcttctatcaatccagctgcttcaggatgatggggaaaatggtaagacaagtgaatcccatgagcatgagcccactgccacacttctttagccgtaaagggagtgccttggtcagaggcaatgctatgtggaatactgtgacagtggataaggcattccatgactccacagatggtagtcttggcagaagcattgcatgcatatctgcagtaagtgtctatttcagtgaggacaaacctctgccctttccaggatggaagaggtccaatataatccaacctgccatcaggtagctcactgatcaccctgaggaatggtgtcatttgggtagagacccagagccaaaccagatcacgccacccaacccctcccaaatctcatgtcctctttgcatttcaaaaccaatcatgccttcccaacagtcccccaacatcttaactcatttcagtattaactcaaaagtccaaatccaaagtcacattggagacaaggcaagtccctttcatctatgaacctgtaaaatgaaaaacaagtcagttacttccaagacaaaatgggggtacaggcattagatacatgctcccatttcagttgggagaaatgagccagaataaaggggcttcaggtcacatgcaagcccaaactccagtggggcagtcattaaatcttaaagcttcaaaataatctcctttgactccattcctcacattcagggcatgcttatgcaaagtgggggctcctacaaccttgggaagctctcaccctgtggctttgcagctctgaccccatggctgctctcatgggctttgcagagttcagccctcctggctgctctcattgagtgcatgcagcttttccaggtgcacagtgcaagccgttaatggatctaccattctggggtctgaaagatggtggccctcttctcacagccccattagtcactgtctccagtggggactctgtgtgggggctccaaccccacatttcccttctgcactgccctagcagaggctctccatgaaggctttgcccctggcgcagacttctggctggacatccagtcatttctataaatcctctgagatctgggtggaggatcacaaagctgaactcttctcttccgcacatccctaggcccaacatcatgtagaagccaccaatgattggggctttctgaagcaatggcctgagctgtacattggacttttttagccacagctagacctggagcagctgggacacagggcaccaagtcccaaggctccaaagagaagctgggccctggacccagcccatgaaaacatttttccctgataggcctccaggcctgtgattggaagggctgctgcaaagatctccgacatgccctggaaacattttccccattgtcttgattattaatattcatctcttcattacttatgcaaatttctgcagccaacttgaatttctccctagcaaatgtgtttttctttactaccacatggccaggctgcaaattttccaaacttttatgctctgtttcccttttaaaaataagttcctatttcagatcatctctctcaagggcaaagttccacagatttctagggcagggacaaaattccatcaagcttggttttatacattttagagaggcatgagacatcaatcaaatacatttaagagacacattggtttggtccagaaaggtggaacaactcaaagctagggcttccaggctataggtgaatttaaatattttctggttgacaattggttgagtttgtctaaagacctgggatagatagaaaggtaatgttcaggttaagataaagattgtagagtccaaagttcttttgaagtcttatagtggctgcccttagagataataggtgacaaatgtttcctattcaaatcttagttgaactctttaggattgggaggttctagaagaaaaagatctagctatgttaatagagattctttacagatgcaaattttcccccacaaagaacagctttgcagggccctttctttctttctttctttctttctttctttctttctttctttctttctttctttctttcttttttagatggagttttgctcttgttgcccaggctagagtataatggcacgatcttgtctcaccacaacctccacctcctgggttcaagtaattctcctgcctcagtctcccgagtagctatgattacaggcatgcaccaccacacccggctaattctgtatttttagtagacacagggtttctccatgttggtgaggctggtctcgaactcccaacctcaggtgatccgcccacctcagcctcccaaagtgctgggattacaggcatgagccaccatgcccggcctgcagggccatctcagagtatggcaaagaaacatgttttggggtaaaatattttgattttcttatttgtctcataatgttatgccagagtcagtttggaaagtaaatcatgatatataggtttaaataaaacccatctgatgagaatttatgatttgtagagcatgcctccccagactctttagataggaatttgggcaagatgaaaaaaaaatcagagtttagtcctcactacctaagaccagctcagcttggacttcactgttcatgtcactatcagcattttagtcaaaaccactcaataagtctctaggaagttccaaactttcccacatcttcccttctcctttcaagttctccaaactgttccaaccgctgccaggaggtacccagttccaaagttgcttccagattttgagttatctttatagcagttccccactcctggtaccaatttactatattagtctgtttccacagtgctataaagaactgcccgaaagtggttaatttgtaaagaaaagaggtttaattgactcacagtgctgtgtggttagggtcggaggctcaggaaacttgcaatcatggtggaagtggaagcaggcatgtgacacatggcagcaggtgagagagagaaagagagagagagggaatgaaggaggaaccaccatacatggataaaaccatcagatctcatgagaactcactcactatcaggagaacatgaggacagcatgggggaaaccacccctatgacccagtcacctcccaccaggtccaccccttgacacataaggattactatttgagatgagatttgtttaatgacacagagccaaaccacatcagcatgtgacaaaggtctaatatcaagaatctatgagggggcagttccaaaatggctgaataggaacagctccagtctacagctcccagcatgagctacacagaagacaggtgatttctgcatttccaactgaggtactgggttcatctcacgggggcttgttggacagtgggggcaggacagtgggtgcagcccaccaagagtgagctgaagcagggcgaggcattgcctaacccaggaagtgcaaggggtcagggaattcccgttcctagccaagggaagcggtgatggacggcacctggaaaatccggtcactcccaccctaatactgcacttttccaacggtcttagcaaatggcacaccaggagattatatcctatgcctggcttggaggttcccatgcccacggaacctcgcttattgctagcacagcagtctgagatcaaactgcaaggtggcagtgaggctgggggaggggtgcccacaattgctgaggcttgagtaagtaaacaaagtggctgggaagctcaaactgggtggagtccactgcagctcaaggagacctgtctgcctctgtagactccacctctgggggcagggcatagctgaacaaaaggcagcagaaacctctgcagacttaaatgtccctgtctgacagctttgaagagagtagtgtttctcccacatggactttgagatctgagaatggacagactgcctcctcaagtgggtccctgacccccgagtagcctaactgggaggcaccctccagtaggggcagactgacaccttacacggctgggtgcccctctgagatgaagcttccagaggaattatcaggcagcaacatttgctgttcagcaatattcgctgttctgcagcctctgctgctgatacccaggaaaatagggtctgcagtagacctccagcaaactccaacagacctgcagctgagggtcctgactgtcagaaggaaaactaacaaacagaaaggacatccacatgaaaaccccatctgtacatcaccattatcaaagacaaaaggtagataaaaccacaaagatggggaaaaaacagggcagaaaagctgaaaattctaaaaatcaaagtgcctctccccctccaaaggaatgcagctcctcgccagcaatggaacaaagctggatggagaatgactttgatgagttgagagaaggtttcagatgatcaaacttctccgagctaaaggaggaagttggaacccattgcaaagaagctaaaaaccttgaaaaaagatcagatgagtagctaactagaataatcagtgtagagaagtccttaaatgacctgatggagctgaaaaccatggtatgagaactacgtgatgaatgcacaagcttcagtagccgattcgatcaactggaagaaagggtatcagtgattgaagatcaaatgaaagaaatgaagggagaagagaagtttagaggaaaaaaaagtaaaaagaaagaaacaaaccctccaagaaatatcagactatgtgaaaagaccaaatctatgtctgattggtgcacctgaaagtgacagggagaatggaaccaagttggaaaacaccctgcagtatattatccagcagaacttccccaacctagcaagacaggccaacattcaaattcaggaaatacagagaaccccacaaagatactcctcgagaagagcaactccaagacacataattgttagattcaccaaagttgaaatgaaggaaaaaatattaagggcagccagagagaaaggtcgggttaccctcaaagggaagcccatcagactaacagctgatctctcagcagaaactctacaagccagaagagagtgggggccaatattcaacattcttaaagaaaagaaatttcaacccagaatttcatatccatccaaactaagcttcataagtgaaggagaaataaaatcctttacagacaaacaaatgctgatagattttgtcatcaccaggcctgccctacaggagctcctgaaggaagcactaaacatggaaaggaacaactggtaccagccactgcaaaaacatgccaaatcataaagaccaccaaagcgaggaagaaactgcatcaactaacgagccaaataaccagctaacatcataatgacaggatcaaattcacacataacaatattaacctttaatgtaaatgggctaaatgctccaattaaaagacacagactggcaaattggataaagagtcaagacccatcagtgtgctgtattcaggagacccatctcacatgcagagacacacataggctcaaaataaaggcatggaggaagatctaccaagcaactggaaaacaaaaaaaggcaggagttgcaatcctagtctctgataaaagagactttaaaccaacaaagatcaaaagagacgaagaagaccattacataatggtaaagggatcaattcaacaagaagagctaactatcctaaatatatatgcatccaatacaggagcacccagattcataaagcaagtccttggagacctacaaagagacttagattcccacacaataataatgggagactttaacaccccactgtcaacattagacagatcaacgagacagaaagttaataaggatatccagcaactgaactcggctctgcaccaagcagacctaatagacatctacagaactctccaccccaaatcaacagaatatacattcttttcagcaccacaccacacctattccaaaattgaccacatagatggaagtaaagcactcctcagcaaatgtaaaagaacagaaattataacaaactgtctctcagagcacagtgcaatcaaactagaactcaggattaagaaactcactcaaaaccactcaactacatggaaactgaacaacctgctcctgaatgactactgggtacataatgaaacgaaggcagaaataaagatgttctttgaaaccagtgagaacaaagacacaacataccagaatctctgggacacattcaaagcagagtgtagagggaaatttatagcactaaatgcccacaagagaaagcaggaaaaatctaaaattgacaccctaacatcacaattaaaagagctagagaagcaagtgcaaacacattcaaaagccagcagaaggcaagacataactaagatcagagcagaactgaaggaaacagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaactagaaaatctagaagaaatggataaatttctcgacacatacaccatcccaagactaaaccaggaagaagttgaatctctgaatagaccaataacaggctctgaaattgaggcaataattaatagcttaacaaccaaaaaaagtccaggaacagatggattcacagccgaattctaccagagctacaaggaggagctggtaccattccttctgaaactattccaatctatagaaaaagagggaatcctccctaactcattttatgaggccagcatcatcctaataccaaagcctggcagagacacaacaaaaaaaaagagaattttaggccaataaccctgatgaacatcaatgcaaaaatcctcaataaaatactggcaaaccgaatccagcagcacatcaaaaagcttatccaccatgatcaagtgggcttcatccctgggatgcaagtctggttcaacatacgcaaatcaataaacgtaatccagcatataaacagaaccaacgacaaaaaacacatgattatctcaatagatgcagaaaaggcctttgacaaaattcaacaacacttcatgctaaaaactctcaataaattagatattgatgggacgtatctcaaaataataagagctatctatgacaaacccacagccaatatcatactgaatgggcaaaaactacaagcattccctttgaaagctggcacaagacagagacaccctctctcaccactcctattcaacatagtgttggaagttctggccagggcaatcaggcaggagaaggaaataaagggtattcaattaggaaaagaggaagtcaaattgtcgctgtttgcagatgacatgattgtatatctagaaaaccccatcgtctcagcccaaaatctccttaagctgataagcaacttcagcaaagtctcaagatacaaaatcaatgtgcaaaaatcacacgcatttctataacccaataacagacaaacagagagccaaatcatgagtgaactcccattcacaattgcttcaaagagaataaaataccttggaatccaacttacaagggacgtgaaggacctcttcaaggagaactacaaaccactgctcaatgaaataaaagaggatacaaacaaatggaaaaacattccatgctcatgggtaggaaggatcaatatcctgaaaatggccatactgcccaaggtaatttatagattcaatgacatccccatcaagctaccaatgactttcttcacagaattgggaaaaactgctttaaagttcatatggaaccaaaaaagagcctgcaatgtcaagtcaatcctaagccaaaagaacaaagctggaggcatcacgctacctgacttcaaactatactacgaggttacagtaaccaaaacagcatggtactggtaccaaaacagagatacagaccaatggaacagaacagagccctcagaaataatgccgcatatctacaactatctgatttttggcaaacctgacaaaaacaagaaatgggaaaacgattccctatttaataaatggtgctgggaaaactggctagccatatgtagaaagctgaaactggatcccttccttacacattatacaaaaattaattcaagaggattaaagacttaaatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtaaacaggcaacctacagaatgggagaaaatttttgcaatctacttatctgacaaagggctaatatccagaatctacaatgaactcaaacaaatttacaagaaaaacaaacaaccccatcaaaaagtgggcaaaggatatgaatagacacttctcaaaagaagacatttatggagccaaaagacacatgaaaaaatgctcatcatcactagccatcagagaaatgcaaatcaaaaccacaatgagataccatctcacaccagttagaacggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgcggcactattcacaatagcaaagacttggaaccaacccatatgtccaacaatgatagactggattaagaaaatgtggcacatatacaccatggaatactctgcagccataaaaaaggatgagttcatgtcctttgtagggacatggatgaagctggaaaccatcattctcagcaaactatcacaaggacaaaaagacaaacactgcatgttctcattcataggtgggaattgaacaatgagaacacttggacacaggaaggggaacatcacacaccagggcctgttgtggggtggggggagtggggagggatagcattaggagatatacctaatgttaattgatgagtttatgggtgcagcacaccaacatggcacatatatacatatgtaacaaacctgcacgttgtgcacatgtaccctaaaacttaaagtataataaaaaaatttttaaaaaaagaaacacctgcttttttctgttttccatttgcttagtagatttttctccatccttttactttgagcctggggatgtcattgcatgtgagatgggtctcttgaagacagcatacatttgggtcttgcttctttctccaacttggcaattctctgccctttaattggggcatttagcccatttacattcaaggttaatattgatatgtgcatatttcatcctgttatcatgttgttagctgctcaatatgcagatttgattgtatagttgatttatagtggcaatcgttatgtacttaagtgtgtttttgtggtggccagtaacgttcttccattatcatatttagcaatcccttaagggcctcttgtaaggcaatctagtggtgatgaatacccttagcatttgcttgtctgaaaaggatcttatttctccttcacttgtgaagcttcatttggctagatatgaaattcttgcttggaatttcttttctttaagaatgctgaatataggcccccaatctcttctggattgtacagtttctgctgaaacctccattgttagcctcattgggttccctttgtatgtgacctgaaccttctttctagctgcctctaatattttttttcctttcaacctttaagagtctgatgtctgatggctatatgtcttagggatggttgtcatgtataatatcatgcagaggttatttgcatttcttgaatttgaatgttggcctctctggtgaggttggagaaattttcatggaggatagcctgaaatgtttttcaagtttctttttttctctttctcttcttaagggataccaatgtgtcatagatctggtctttttacataattgcacatttctctgaggttttatgccttcttttttattctttgttctttatttttgtctgactgagttaattcagagaatcagtttttaagctctgtgattctttcctcagcttggtctattctgctgttaatacttgtaattgtattctgaaattcttgaagtgagttttttagctctatcaaatcagtttggttctttcttaaaatggccatttcatctttcagcttctgtatcattttactttatttcttagctcccttggattgggtttcaacattctcctgaatctcagtgatcttctttcctgtgcatattctgaattctatgtctgtcatttcagccatttcagtcaggttaagaaccattgctgggaaaccagtgtgattatttggaggtaagaagacactctggattttagagttgcagagtttcttgcattaattctttctcatctttgtgggctgtttctttaatctttgaagtggctgtcctttggatgtttttgtcttttttgttgttttttggtgtgtgtttttgtttgtttgttcatttgtttgttttttgctcttatcttctttgatactcttgcaggtttgattgtggtataaagtggattcagttagctgtgtttcttgaaaatcttagagggtccaggctcacctcagcactcttgtggtgtgttctctgctctgggactgggcccctggctttattctctggccccttgagtttagaaacttgctgcattggaggggctgaggtgttcccagtccattggccacaacactatagtagggggtgccggccaaagcacttcattagagtggtggcagtgggatccattcttactcatgggtgccagcagttgtggagtcatggcagggtgcacatgcatctgctggggtgggggtactggcaggagcagagtggcagcatccctacataggttcctgctggcagtcacagcgcagtgaggtgcccgtgtgttggcagggacagggtggtggggcacacatgcacatgcttgctggtggtagagggagttgtgatctgctgtgcactcatgccagcaaagcagttgggaggtactatgggtggactggtgcacatcagcagaggctggcctgctggaggtctccaatggttaggcatggtctgctggcaaaggagctatgatgagggcccccaggaaacaccctggttgggcttccaaggctgtactgcaagcaggcacagccagcctggggccccaggagaggccagaaggcaaggaaattctcatttcagatgggccctgtcccatggacaagaccaccctgctttattcaggtcccatagtcactctaaggttaaaatctcctagaggaggttggtgagccttgggggatgggtgtcccctggctgtgctccactacagccattctcatgtcaaacactctgggctttacacagactggagtcctgcccctggcatctctctaagcagctgtcccttccagcacaagtgtccatgggggtcatggggtctcctgctgctaggattctggaggcccatggcaacagcaggccactcctcacctgttcaactcaacctttccccaggagttgctgggagccaggaatgagtcctggtgcttggcatccccatgcagggttcccatcttcctccaccttcagctcagcatctgtgtcctcccccgtctactctcaatccactctcaatgcctccccttcaaagatctgcttggaaagcacccgtcttcctgatgtctcactccctccatggcagatattcctcctggctgcatctagtcagccatcttgactcgcctccaaagtctttttaattaccacttcggttaaattagtaactatcattttacaatggcctgtgattctgttttgatcaaatattttgagccttttagcatctataacaaatgttctcaaaaatcaaaatcctaaatcaagtctctgccttagtcttatttctggggcttattaaggctataaaaattaatcaccataaggttgtacaagctttttacagcttccagtcaggctatgaactccagtatcaccacctccagcctgataattacatatattggaagaaaatcagttaaaggactccctctagacccttgaaagggtgtgagagacaacatggtttcgcctgccttcatgtgtcccagtccatccctgtggctgcctctgtccacctcagcttgcccactgtctttccttcccaactgtctgccctgctgacttctggcctcagtgacagatgcaaagacaaggcgacagccccacatagaccgtttaaccagtcccacatttgcataagctaaatggtcatgtcacagtctgttgcccaggctggtctcaaactcctgggctcaagtgatccacccaccttgacccccaaggtgctgggattacaggcttgagccacagtgcccagccaagaacccgtttttgagtgggcaccttggcacacacctgtaaacgcaacactttgggaggccaaggtgggagtgtggcttgaggccaggaggttgaggttgcagtgagctatgatggcaccacctcactccagcgtgggtggcagagtgagatcctttagaaaaaaaaaaaaaaaaaacttgttttctctgcagccgggctccgtgaccaaacacaaacacaaacttcccctccagagggtccaggaggggctgggctgcaggaggtgcttagggcctcttagggaatggtaagtgaccacccaacgcaggcactcagccccaggggcatatgcagagagagggtccaggaggagctgggctgcaggaggtgcttagggcctcttagggaatggtaagtgaccacccaacgcaggcactcagccccaggggcatatgcagagagagggtccaggaggagctgggctgcaggaggtgattagggcctcttagggaatggtaagtgaccatccaacgcaggcactcagccccaggggcatatgcagagagaggctgggaggacactttcagtgactggggttacaaaccccaaccataagacattgctggctctgtgagccgccacctccagaaatctcccacttagttcttagcacttatccactcttcccttttcctactctcaattcctggaggatgccctcctttctcaggctcagaccaacctaccagctccactctagacctgaacacatgactcctccctctgtctccacctggaaatctcatcagtgcctcacatttacactcctgaaaatcaggtcctgcctacccaccctcttgctccacctgattcctgccctgtttcagccagagaccttgcagtctcctttaactctcaaacccacccatgtcgtgtgagcatactgactgtgttctatgcaagaaagagcagtttcttggtggtcctgcggttttattagtccagaggcaaagcgttggcagagctggtttcttctgaaccctgggagggagattctgttttcatgccttttccagattctagaacccatattccttgctctgtgtccccttcttccatcttcaaaggccatcctctcatctctgtgtccatcatcacatcacccttcccctgactctggttctcctgcttccacttataagcacccttgtgattacatcatacccacccagacaatgcagggccatattctcccctctcgagattaatttaatcacatctacaaagttcctcgtgccatatgaggtcactaaaccacatgttctgggggtttgaatgtaaacatttgggggatgcattattcagccacccacaagcactgctccccactggccacacactatgcacagccgagatcatgcaagtgaggcacgttcatcaacagcagcttcagcaggaaactatatgctccactttcctgccatttgtatctggatttttttttcgctatcattgtagaaagagtggtattgtaaaattaaagatggattattttctttctagaacactttggcaatctatccaacattatttatccccttctgagtgtcaagtgtgaggtcattctttcattgagagctcaatgcctacaattatgataatgcatattgggtactttcacacatcagaaagttcttctttcttaaaatctgttcttgaattattcattcttctctagctttttgttgatctattttataattttagaaaaatcagaaagtaacttgaagtatctgtcatctctacaggtttacctccctctttgtggccttcagaatgtcatgacacgcttttcccttgctcatcacatggtttctatgtatgagacctcatcacaggagctgtggtcccccgggagcaggcatctgtggatggtgccttgctcctggctgctgggacctgtgtgctgccagtggcactccacgacagtgatttcccagctcagttttgcagctccagatggtgggtgagacactaggaccactttgtgaacagcgagggcttggggtttgcttttctaccatgtccagggctgctgttcatgagggaatgtttctaacctgacatcatggctgaagccaacttagaacctctctagccgtatggggagtaggtgagtgatacagatgttaattagctcagtggagccactcccctatgtagacatgttacaaaacattatgctgtacagaataaatataggtcatttttatgtgtcaatcaaaagagaaactaattatttaaaaaaaaaaaaaaaacctctctactcaagccgaaacctcagctccagtcccacaagtcacacaaggctgctcccgtcctgtgtatgttaaacctacctcagaaatgcaagggggcattcaggtttcattctcaattcaaatgccctttttaattttgtctattcctagcacctggcaacttccagctctttttttcggggctcattcattatttaaagcacgtataatttttcacccacattctaacacatgtagtactgtagagaatccttccctaggaggatctacagcattagaaaagaattaagaactccaatatttacaagaaggaaaaagcaaaaagagatcaaaaaatgggcaacttctagaaatagaaaaccctcatgagtatgatgataaatcgctggcacacatgtgaatagttacttgatgcttatagtgatgtctgggaaaataacatgaaatacttataatctgtttctcacacatgtaattcaaaagaatagagagaagatgatttgaaatattcttaagtttgtaggaaaaaagctacttccatatgcataattgcatgtattttgatactgccattattaagaactatctaagagggtccattaaaaataaaatttcttggctgggcacagtggctcatgcctgtatcccagcactttggaaggccgaggcaggtggctcacctgaggtcagaagttcaaaaccagcctggccaacatggtgaaacgctgtatctaccaaaaatacaaaaattagctgggcatggtggcatgcacctgtagtctgagctacttggggggctgaggcaggataatcgtttgaacccaagaggtgtaggttgcagtgagctaagatcataccaccgcactccagcctgacagacaaagcaagactctgtctcaaaaatattaaaataaaatttctcattcctattacagagtaatttaattcattaatgccctgccctgttacaaaactcatttgtaaaatactaattgtaattgtgaaaaaatggcaattgatactaattttaaattctaaaaacagggcacccatattaaagattattctgcagtaagagaattagctataacattttgtaataaggtggagaaaacattctccaacttacaatggttggtgagaagaaagtttccagcacggtagatggaccctaagagcccttgttgaaataataagacaaaaagatatacagagagatgagccagatgaagggagacagagagagagagagagagagagagagaggcacagaaatgagagatacaaagtgaaagagggcaacctgtggggtcatcagatatttgttttctgttttgtttattctaacataaaggcagtggtgggtcatcgatgtatttagagtttgcacaatcactgtggaacacagacagacacaggggaagaggagaaacacagggcggtggcttgcccttggactgttcttagttcctcaaaacgtaacagctttgcccaacctaagggaactttcagcagctgctcttctgccataggcctctttcctgccttgttttcatgtggctgactgtttctgttcctgcaggtcttagctcatcagacaggcatttattacctctgtgtcaacagtgggagcttccattactctctagcatgacactccccttcctcttttaggaaatttaacatggaagtgagtttgccatcggccttctccccacagtgttaacagtggtgaggaagccagcctgttccaccttgcccctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaacttggctgagggcttgcaaaacctgtggaattctcctgttgcaagggctgtagatgtttgcagtggcagtgggtgctggcgggaaatctgcttaccttttccctacatgggaagtccctcctgtgtccagaccaatccgatctgggtggggaagacaaggctgcaaaggccaggtgcctccatgctgccctccgatcaccacgggtgcgtttccacacctccactgcactccgtcagtctcccttcaacactccagtcaaaccttagctgtttcttctttgccttattccttcctcatggggagggtgtgggtgaacaccaggcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccaggttgggaggcattggtttgggtggtggtcaggaagggcagagtgatttgagtagggtctgagtggataatagctcatcagtttggaatttataaatgaccagggatgatttaaggagattcctgccagacacctatgccatggccatgccctatctggatctccagccgtgagatgagaacccagccatgcgggggagtctgttcgttctgctcaatgttgtaagtggcacatgctattggataatgtagaattgaatggatatcattttattattataatttacaaacttcctacaataaacttatcacctttatacatagaaacaaatataagtacattttccctcccctatgtcattttgagccctctctccaaaccatcctcccactctgcgactcactgtcctgcatttggctatgctctggcaagtcctgcttagacaagcactcaccagaccacctactcagcctcccttcagcgcccacctggcccacctgctcaaatacatgttgagtggtcacacacatggactgaacaccatctattccatgcactgccccagtgaccgcactgagcagcaagagagaaatgatcgcattagctatcaattatgccaattcaaatgctggagtctttctcagatacttttcaatgttcaagaattgttgattgtgaattctatacccaatgaaactatccttcagaaatgagcagaaaatggataccttctcaaataaacaaaaactaaaagaattcttgctacaagatgtactcttaaagactggctaaaggaagttcttcaaacagcaaggaaattgaattgatcttatgtcctgcacacttgctaaatttcctctcaattttagcagcactgtttagattccataggattttccatacaaacagtcatgtggtctatatatagagacagattttcctcttttccagtggggataaatttatgtctttttctttctgtgttacagcaggtaggacctccagtacaatgttaaacagaagtggtgaaaacagacattcttgcctgtttcctaacgttggagtttggtcttttactatggtgtcagatgttagctgtagggtttttataaatgcccttcatcacattgaggaagtttgctcctatgcctaattttctgagagtcttttaatgtgacactcatgctagaatttattaaatgctttctgtctactaagatgattatgcagttcttatattaacatgaataattacatttatttattctttaatatcaaggcaattttgcattcctgagacaaaccccatttagtcatcatgtgttgttattgttacatattgttggattcaatttcctcaaaatttgttaagaattgttacatctatgtttacaaggaagattagtctgtagggtattttttcttataataactttgcctagttttgcaatcagggtaatgctggactcacagaatgagttgggaagctatttcctcctcttcatttttctgaaagaatttgtataaaattggaattatatcttccttaaaggtttgcaagatttcataatgaagtcattggcctagagttttctttgtgggaaagtctttgtttgtttgttttgtggtttgggtttttttttaagagacacagtctcactctgttgcccaggctggaatgcagtggtgtaatcatagctcacagcagcctcaacctcctgggctcaagcaatcctcctacctcagccttcagagtagctgggactacgggcatgtaccaccacacccagctgtttgtttgtttgtttatcgctttgtcttgtttttgaggtcttattatgttgcccaggctggtcttgaactcctggcctcaagtaatcctcatgcctcagcctcccacagtgctggaattacaggcatgagccactgcacacagactgtgggaaagtttttaactaaaaattcaattttctcttccttttccagtgagctttccagtgtctttcaattaatgtatctattttatctaagttgttgaatttattgtcaaaatttttttaaacaatattcctctcttagaggttgaacatctgtagaatctgtagtgatggcacctcttaaatccctgatcttgctcatctgtgtcgtctctctttctctaatcagtatgcctaaagtttaatttcattgattttcttaaaaaactggttttggttttattgatttttttccctagttttttgtgttacatttcattgacttctgctctgatatttactatttcctttctactgcctacagtaagtttaatttgctattttcttagtttcctaaagtggaagctaagtttattgacttgaggcctttcctctgtctggatgcggatatttgctgctaaacatttccctccaacaccatgctgtgagttttagttacagcgggcttggagttggcctgagaaattctacttaaacagctgcacctatcatgtaagtgataaatgatgtacctgcctggccctcacccctggtcaaagaatgggatgtactaatgagcaatgttgctgcgtagctgtggatttcaaggtattttctgtgtggttttatcatcagcattgtttgttgatgactgcaagactgatgatttgcacctggcctcggtgagatccccgaaagaccctgcagatgggctggttacttagcagaaaatatgacaacgtggccagcaggaaacaggaaggtacaatcggctgcaggtgagctgttggaagtaagttccaattttcctattttgtatttgcattttaatagtgagactgcgcttatgttatttgtgtgaaacagctttattcatagcactgtaatttaaagagaaaacccattcatgggaacaacaaacgacctagacaccaaggtagctcatgccatccaaggctatactgtgcagtgattgggaaaatgggcactggtcccagaagtctgatcgacactctgccactggctagtcccgtgctggggggcgaggatccacactctgccactggttagtcccatgctggggacaagtatccacactctgccactggctagtcccgtgctggggggcgaggatccacactctgccactggttagtcccatgctggggacaagtatccacactctgccactggctagtcccgtgctggggggcaaggatccacactctgccactgattagtgttgtgaagatttaaataaagaacccacaccatattctttgacttgtgctttccgtatactgagagatagtaagagtacattattattatttataaagtaaactagaaagcacatgggaagacaagaagaaaacctgaataaacatgaattaccccattttcctcaggagaaaactttcacactctgaaggtacacaaattagcctacaaatttaatgtaaagcaaatagactgttgtaggtaccaattctcaatgtcacagtgttacatggaaagtaaaatacacaagaacagcccaaaagatggaaacaatggacgtggtcaaatgacatcagtacaacatccatatggtcctaagtagccatctttaaaatgggttagaaatgccttcaatcattcacacagacacatgcattgaacaaactctaagaagtgttcttacacgggaaaagcaagttacagatgcatgggcatgatatggatgtagatgtgtgtatgtgcatcccactcatacacaaaatacccagcatcgcccacatgcctgctgtgtgcgtaagtgtgagcgagtgcacagacaacagcgtgcagaaattcaaaccaagctgtgggtacttgttaccactgggaagggagtcggtcacagagggaaagagaaacaggacatcagcctttgacttcagaactgttcctgccttttcacatcctgtgctgttttcagcatcatcggagcccttaacacacatcacgggagtaagagtgtgttagagggagcattcggtgggacagatattgccatggcttgtggatagagttcacagtccttaataatccccgagatggcagccaagagctacgttctcaatcacgcagcttcaccccagaaactgacagaaacccaacaaccaaaaggtgtccattctgacagcctcagcctgtgctggctcagatgagcaaaaatgtacagatattaataatgatgttgatttgaagagcacagaggggggtatgcatgataagggtccaaatttttaccttaaaaaagaatacatttacttctcaatcacctacataacgatcattttttaaaaaactgatcaaatttggtgttacaagggcacgttgcaaattcttctggctacttttctctgactattctaattacgttaccgtgttttctcctgtatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatttctggctacttttctctgactattctaattacgttaccatggtttctcctatatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatccaggcagatttcccaaatccggcttcctgtaaccaagggctgaaagagggaacggtttcctgggaatcctttttgcagtttattttacccggaggcagaagcccacggttccgtgaagagtctattgctctcccctctctccttttgtgtctctatttttaattgacaaaaaagcaaatgtgaagattcctggggtacaatgcaaagtgacaatgcctgtctatattgtgggatgattaaaacaaggtaagtggcatatccatcacctcacacacttatcattttgtggtgagaacatttaaaatctcatcttttagcaattttgaaatagtcattattgttaactatagtcaccatgctgtgcaacagatcaaaagaactgactcctcccatcagcagaaacttcatgccctttgaccagcatctctcctttccccgtccacgactaacccccagcccaagagaacagccaacacccacctcgctgctgccacacgacatgtcgggctttgatgggatggaggtgagggtggggaagacaattccaaagctggagcactggcctcacagctcagacactcttctacttatcctgagagaatgatgtgctgagaccaactaaacctcccctgctcttcccacatggcagaaaagaggcaacccagggaagccattgccaggacatcatggtcacccaacccttgtgcagaaaggaagcacctgcccaggatgccatagcacccaaccctcatccccaaggaaacacagcccagggcaccatggacacccaaccgtcatccccaggggaggacacagcccagggcaccatggacacccaaccctcatccccaggggaggacacagcccagggtatcttggacacccagccctcattcctaggggagtacacagcccagggcatcttggacatccaaccctcatccccagggaaggacacagcccagggcatcttggacacccaaccctcattcccataagagcacacagcccagggcatcgtggaggcccgaccctcatccctaggggaggacacagcccagggcaccatggacacccaaccctcatccccaggggaagacacaacccaggccaccattaacacccaatcatgtgcagggagggtgtccttggagcctgggactcttgccagtgaagcggtggacaagaaactgaggatgcgatcagcacacagaaatctcaggcagcctaggatacatgaggcctctcacccctgggaacactgagcagccaccaggagcccacaccttgaggtacagcaggagccatgcgctcttgctcttgctcactcacactcctgcacacagccactgacacacgccctcgtgcacgttgcagattaactccactggccttgcacttgcaacgctggaggctgagaggtatccccaggttcttttctcgtgagaggggcaggctgactttcactctcctccatgtgctagaggcagctccaccaacactggctgccctgagtggatgcacctggctctggaattcctgtcatttgctttggatccaggagcccctgcctcatgtagctacttaacagaaaggaggaatccacccaggacatgcccagacgggagcctcacaggatggacagtggtgtctggggtcacgggcagccctgacccagcagcgccagcaccagcacacccagtggggaaggcggggaggcccaaacgccacccacagtttgttactccactgggtgggacccggcacccctgccttcctgacaccctggagtccctgcctcctcctagagcccccaagcccatctgcctcagagcatccagagacagacctggggagccatttcctcaggccctggacaaggaaacagggaattccaggttatgggtgcctggggcaggtctcaggcaggtgctgggaaccagagagaggggtcaccgcgaggcctcaggcctggcaccagcactttgagcctcagtttaccagcccacgaggtgctgagtctggactggatgaccttcccacccccagtgacctctgccctttcccgagcatgtcagctctgctccagcatcctggtgtgagcgcaatgccactttttttctcaacaaatacgaaaggaggaaggtgcccccagggccctgtgccctgaggatgcctgtgtggaggggtccatttcatcactggtgtcactcacaggaagggacgaagccacctgccttgacggagcttactccacctccgccgaaggccggggaggtccctcacagagaacctgaggcccagcaggctgcagaggtgctggcatggaatgactgctcagacgcccggggccggcagagaggacggatgtgggggaggtgcacactgaggagcctctccttggaggtggagacacgtgcaccacatggaccaggacacagtccacgaagcctcgcatccccctgagctgcagctcaagggcctctctctgagcccagagtcccacccctgggaggcagctgccccagctctgagggaggagggcatccaccaggccctccatctcctgggggcaccagcccagcccagaggctctgcaggactctgcacctccaattcatggccaggactttctggatgtatcttaaggactgaggactccacatcagggaccacacaagaccggggtcccggacacgggggttgggggtgagcatgtcaccgggatgggctgtggcgtcactctggtacttcatccggacagccagggaccaaagccacgccctcagccccaccccacccctgcctcacatggcaacgcagggtctgcagatgcaggagagtgagaagcatggtagccaggcagactagaggacccgagctggggttgagcacctccctgtctacccagggcatggcctgtgagactgcaggtggcctagtgtgtgctgcaggctcaaggtcctgccccagggagcatgacattcaggcccagaaattgcatcgtgctgcacacagtccaaggggataaccctgtgaagttcaggtcaccagcaggcttggggtcaagaccgagctgcagaggacaggtttctggaaggcacagcatcatgggtggagggacttggagcaaggtccttagccccgggaccagtgaatgtgtgcccttatagggaaagggggtctgtgcagaagcaagttagctgaaaatcatgaagtggagaggctcccctggattaaaggggtgagccctaatgtaatcacaagtgtccttctaggaggttggcagagggagactgacatagacagaagccaggtgaggtgggaagcggaggcagaggccgagagagcagacgctacgccctggccctgaagacggaggaggagccgagagctcagggatggagagactggaggaggcagggaagttctccccgcaagcctggagggagcatggcctccagcacccccagaccttggccctgcaggattcatctggacctgtggtataaatggtgtttaagccactgggctgtgcaaattgtcatagcagccatggcgcattcctagagggagccctggtggggacccagcaggcagcgacggggccctcacaagcctgtgagccactcagagccgcgagagtggctaggcttggtgaggtgcaggccacgcgcacctccactaaggcagccttagggcccacacatcctctctctctctctctctctctctctctatctctctccctccctccttccctccctcccgctctcttggttggacagctctccatcatccccctggacacgaccacctcccaaggccgagctggggcgctttgctcgaggtgagcactgacatcctgggggtgtgaggggcacctgcccagcggccccgtgtgcaggatgggcggtgggccctagctggcactgggcatatggcccggctggtgcctgcaggctgcagcttttctggggtggctgggatcagtgaaggcctccagagtctgggcctgggatccctgcagtgctggctgaggacaggcggggctgggcagtgagggcactgggtcactatcaccacccacggtttattacttcactaggtgggacctggcacccctgccttcctgacaccctggaatccctgcctcctcctacagcccccaagcccatctccctcagagcctccagagacagacctggggaggcatttcttctgcccccagcagaagcccgggaggccgggaaggcacagtgggtctaaaggagaggatcccaggactgcctgaggggtgactccgacgaggcaagcatagagcccactgagaagcggggtgggagccccaccagggatgggctagttcctcatgaaggaccaggacccaggaaggacaagggggcctgctggggcagggtctgctatgccggagtccctgtgagcctggcccagacctgcctctctctttcctcattggtccccacaggtccgtggtggttgccgtatcgggaggccccatggtggcaggggtgggacacctggtatacgtcgccaggtgtgtccaataggctcatgctcacaccttctcctggcacctgggcaaagcctgagcacccaggcactgaagtgagggcaaggcctcggggccccacaggatggccgaggagacagctgcagggcgcctgggacccctgggctcaggaggtagaaggatacagcctgaaaacccacaccacaagctcaccggccagtgcaggcccacagagctcgaggaggcagccctgagcctcccagggagagatgctctgtgcacgccggcacaggccctgggttacaaaccctaggcacagcccaggagaggcccaggccccagtccagcaaggggttgcaggaagcaagaggtccccggccacagcatgagataagcccatcaagccagggccaggtgggcaatgggaggcaggcagggcttgggggtgagtccctgctgcagcgccgtccactgtcgaccggaggagtttcttccctgtgcggagtccacgggcctcctgtgagtgtgtgcatgggcacaagtgtgtgtgtggctctgctgtgtgtctgtacacacgtatgttttgggtttttttgtgtctcagaccacagagtctgcccctcccaccaaagcccaggcagaaggatgaacccacgcccctggggcccaggcctcagcagcctctgcaggatcattgttcccagttgtcacttgcctttgccacagccctatttctccacaattccttaaagtcctcaacatgcatttaaggcacaaaggtgaaactgcccagaaacatctgactccgccgtggaacccaggagcaagctgggttagctaaggagcggggccgttggcagaggctggggatccaggctgaactttggaggaggcatgtgccagcatgggctcctgactatgtcctcctgggacaaacccaaacccactctttgaatatgggagggactttgctggccccggccctgaccgcagcacttggaaactgaggagtggtcgcctcctccgtgtcacagctgcccgttcaccatcatagaagcaactctgtcacctccatgggcccctctgtggctgctgcctgggtccaagctgagcccagctgcccaggcccagaaggaaagcccaggccaggtgcccagcacagaggcagtcacataccccggggagagccacagcaagcagccaatgttgcccaggagaggagtagctgacaaggtagaacgtgagctgccatcggctcgagaggctttgctggtcctcctggggctctggacatgaccaggaggagcgagggaagaagtcgcatggtggtcccatcctgggtggggcctgatggcagctggccacccgtcccagagtggcagccagatgccagcgccattcccacagtcacatcattggtcacagaatgcaggacatagagtgtcttctttccatcacagtgctgtccagacccatagcctagggtagacctggaagattcaatgtccacacccggggctggagcgtagccatgagccacgccccctgcccgtgcatggaaagccagcccaagctctgctccatccctagccaaagtcagtgtcctttccccttctcccaagtgagctctagccacctgcctaccctgccatctgaggatgacagccttcattccattggaacctggctctgccaccagcaggcttgcagtcctgggcagactccgtcacctctctatgcctcagcctttccatctgcacaggaggaagatgatgatggtggtgatgatgatggcgatggtttccttttgcatctgaggcaaggactaattgagatgatacacatcaggcactgggtatggtgctggtccttcctgagcactcaatctatgtgagctgtccttgtgaaatgggtgtcaccacatttccccacgcagaacatcctttgtctgccatacttgaaacatctgccccaatattaacagttccttcatggaagatgtgcacacccacccaccctcatactcccaaaggtgcccgtgctttatcaagccaaagtccagccaggaactttacagcagcatccctttccctctccaagcaccaaggagcaaggcaaagcactacatcttccatctggaggcaatgccaccctcttctcccattttcactgccatccctaagaggcagtgcttccccaaaaggttccatagcagcctgcctacagcaactctgttcacacgagtttcagcatccttgcagtggctcccctgccatgctgtggctcttcattcaccctcttctcctgctccccgtgacaggcatagattctgagtgatctggatacattgctttgtttaataacattacagcttctgtgctgaaaaagatacagcagatagagaaggcaattgttgaacacaaaatagtgacagcagagatgacggcaagttggcatttttcttttctagcaataaaacttaaagctgactcaaggagaaatggaaatcataattggaacagtaatcctcaagaaagcattaagattattaaataattgccctcacagatgacttcaggccaagatggctttatgggtgaagtttagactttcacaaaactaatcagttcccataagaactgctccaggatttggaggaacatgggaaagtctattaaagggatcacaattcacagtccccagagtaaaacatgggctaacttgcattttggcaaagagccaaatgttataaatgacatcctagaaggccaaattctgtccatctcgttgaacaaggacttacaccaggaatttagaactatttatagctcatcccaccactcaggccaatgatgacccatgatcatctcaccagaaatggaaagactcagatgattaatagagtctcaatttctctgagacatctaagagcccagcccaagcccagacccaggagggcacccaggcctggacagagaacactgatatcacaccagccctccagagggaagcagagactccttcaagctctggaaacacaggcccagacagctgcctaaagttgggcaggcttcactgcaaacccaaatcatgaagctaggtaacacctttacagattctttacatttaaaaatcatcaaaacaagagtaaataataaactcaaataatattaatctaatatgtaaaggtcttgtaccattattatgcaaacaacatacataagctaataagaaaaagaacaaatcccttaagaaatcggcaaaaaggatataacacaatttctaaaagaaaacaaatggctagcacacataaggaaaacactttgtgaacagacattcttcagaacattatttataattataaaatagttgaaagcaagatagtgcctgaagaaattatggtgcatacattagtgggactattctgcaaacattcccaattatacttgtcacatatctgtgataacgtgacagccagcattcatggggtgacctcatttggtaaaagggtgcaaagctcaacacgcattgtgagatgactgtggtgtaaaattagtgggattattccgcaaacattcccaattatacttaccgcatatctgtgataacatgacagcattcatggggtgacctcatttggtaaaagggtgcaaagctcaacacgcattgtgagatgactggtgtaaatacaaagaccaaactgtgaaaaggagtccatcaattaatcgatgcttaccttcagttttgggctaatttttaaagtatgctataagcatatgctcctgttataacagaatggagggattatgagagatgatgcaggtgtgtcctgggcctcccctggcccactgggccctagagatgccttcccaggcatcgctgtcagggcttccctcagagggagtcctgtattgacctcaccaccaaggtctggagcaggggatccttagatattggttggggttatctcaccttaggtctgaatttggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccaccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggcgagggtctagtgcaggtgcccaggacaagaaagattgtgaatgcaggaatgactgggccacacccctcccgtgcacgccccctcctgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactccacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactctctcctggcccctgctggaggccgcgccagagaggggagcagccgccccgaacctaggtcctgctcagctcacacgacccccagcagccagagcacagtggagtccccactgaaccccactgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgccccggtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccctggtcctcactaggcctcagtcccggctgtgggaatgcagccaccacaggcacaccaggcagcccagacccagccagcctgcagtgcccaagcccacattctggagcagagcaggctgtgtctgggagagtctgggctccccaccgcccccggcacaccccacccacccctgtccaggccctatgcaggagggtcagagccccccatggggtatggacttagggtctcactcacgcggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgctcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccctgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctccaacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatgcccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcagaacatatgtttgtcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaagagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacctgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaacctgctgccacagccctccctgtggggcaccgccgcgtgccatgttaggattttgactgaggacacagcaccatgggtatggtggctaccgcagcagtgcagcctgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggccggcccacattaccatttgctgccatccggccaacagtcccagaagcccctccctcaaggctgggccacatgtgtggaccctgagagccccccatgtctgagtaggggcaccaggaaggtggggctggccctgtgcactgtcactgcccctgtggtccctggcctgcctggccctgacacctgggcctctcctgggtcatttccaagacagaagacattcccaggacagctggagctgggagtccatcatcctgcctggccatcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccgccagctgcaccagaccccgtcctgacagatgccccgattccaacagccaattcctggggccaggaatcgctgtagacaccagcctccttccaacacctcttgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaagaccactcatggagcccccagccccaggtacagccatagagagagtctctgaggcccctaagaagtagccatgcccagttctgccgggaccctcggccaggctgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccatgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccagggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtcctcgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcacccccaaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccatctgctctcctctcatcaccccatgggaatccagaatccccaggaagccatcaggaagggctgagggaggaagtggggccactgcaccaccaggcaggaggctccgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcccatctctctcacccacggactcacccacctcctctccaccctggccacacgtcgtccacaccatcctaagtcccacctacaccagagccggcacagccagtgcagacagaggctggggtgcaggggggccgccagggcagctttggggagggaaggatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggcaagacccaaaagcccctcagtgagccctccactgcagtcctgggcctgggtagcagcccctcccacagaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccatggcaccctgccatgtcctgcatttctggaagaacaagggcaggctgaagggggtccaggaccaggagatgggtcccctctacccagagaaggagccaggcaggacacaagccccctccccattgaggctgacctgcccagagggtcctgggcccaccccacacaccggggcggaatgtgtgcaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacagtgtccccactggatgggaggacaagggccgggggctccggcgggtcggggcaggggcttgatggcttccttctgccgtggctccagtgcccctggctggagttgacccttctgacaagtgtcctcagagagtcagggatcagtggcacctccctaacatcaaccccacgcagcgcaggcacaaaccccacatccagggccaactccaggaacagagacaccccaataccctgggggaccccaaccctgatgactcccgtcccatctctgtccctcacttggggcctgctgcggggcgagcacctgggagcaaactcaggattaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatggacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgtgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggccacatgtgtggacactgagagccctcatgtctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggccatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcctgccccagagcccaggaggctgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggccaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcaggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccctggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaagaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgcacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggcctggcggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacaattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcctgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcctgccccagagcccaggaggctgcagaggcctctccagggggacactgtgcatgtctggtccctgagcagccccccatgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggtcactgttgtctgtactctgccctctgtggggagggttctctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcaccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacacagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcagcaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggctcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtggctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccgccctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgccgagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccacgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcggcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccagaccatagggacagagaccagccgctaacatcccgagcccctcactggcggccccagaacaccccgtggaaacagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctggggctgaggggctgggggagcatctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctgagcagggccttttgctgtttctgctttcctgtgcagagagttccataaactggtattcaggatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggacaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgactggactcgcagggtttatgcacacttctcggctcggagctctccaggagcacaagagccaggcccgagggtttctgcccagaccctcggcctctagggacacccgggccatcttagccgatgggctggtgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctctcttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggccctctccttatggttcccccacctggctcctgccgggacccttggggtgtggacagaaaggacgcctgcctaattgtcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccactgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcatccaccgacccgcccacctcctctccaccctggccacacgtcgtccacaccatcctgagtcccacctacaccagagccggcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaatggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcttcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagccctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcgcttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaagacaaagaaatttgtttttttgaataaagacaaatttcatcacacgaagataaagatgcaaagctccagacaggaaggcacggacagcacagtgaagcctggagcgggcgctggggggccaggggcatggcgggggtgccagcgtctctcagtgcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgtcgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagagaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagcccagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttgtttttgtttttagacggagttttgctccagcccaggctggagtgcaatggcacaatctcagctcactgcaacttccacctcctgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaaggcatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactagcataaaaacagacacagagacaaacagaacaaaatttaaaaacccagaaataaatccacacacctacagcaaattcatttttgacaaagttgccaagaacatactctggggaatagataatgatatctcttcaataaataatgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttactacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataaaaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccaacctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcccccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagcgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcagggcacctcccctgcccccagacaccctgtgcccatcagttcatccccagcagaggccctcaccaggcacacccccatgctcacacctggccgcaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttctggggggaaataagggtgctgggtctcctgccaagagagccccggagcatcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcaggtaagaatggcctctccaggtctttatttttaatctttgcctatggagttttcagagtattgcatactaaccccggagatgtgtcaagctggccgggagaagctagggactaaactgcctaggggatctcagagccttggggataaactaagaatctctttgatggtgttggtagagtccctaaatgatggagcagggattttggagcctcatttgagggagatgctaaaaagattccatggctaaagggatagtttgggctgtggttggagattttcagtatttagagtaatagtgttagctgagaaatataattcaggaccctctgagacagcatctgtacagtatctgatgcacagggacaaagagtggagtgggacactttcttcagatttgtgaggaatgttctgagtagattgtttaaaacatcatttgttgaaaagagaacttttagtgaatcaatcaaggaaggaaggaaggctcagtctcaaaagggtagctgatatccagaggaatctggataagcctgcaaaagtctagctttcaaaggaatgcagaagtatgcatgtggaaaattagaagatttttttttacccttaaagtggttcctatgatagttagaatactgtgactttactatgtgagagagttttcaagtattcacttttttttttaaatgtccaagtacgaaaaaattttgtcagtttgaagtcaggtttgtacagaattgatattgttgaaagtttaaccaaagaatgggaatgaggctctttcacaccctattcagaactgacttttgacaataataaattaagtttaaaatgtttttaaacaaattgagcaatgttgagttgcagtcaagatggccgatcaggaccaggacacctgcagcagctggcaggaagcaggtcatgtggcaaggctattttgggaagggaaaataaaaccactaggtaaacttctagttgtggtttgaagaagtggttttgaaatgctctgtccagccacgcagaactgaaagtccaggctgagaaaaacaacacctggataatttgcatttctaaaataagttgaggattcagtcgaaactggaaaggtcctcttttaacttagtgagttcaatcttttaattttagcttgagaagttctagtttccctcaaacttaagtttatcgacttctaaaatatattcattttcaaaattaagttatgtaaaaaaattgaaggacttcagtgtctttaatttctaatgtatttagaaaactttttaaagttactttattattcttccctctgattattggtctctgttcaattcttttcccagtacccaaagcatttacagtgactttgttcataattttttttaagttagttgttttctgccttactattaagactttagcattctggtcgaagtggcttcataaatctttttcaaggccactttttaggagaaagacatcttttttttaatgaatgcaattatctagaattatttcagttaaacatgttagttggtggttgagaggacactcagtcagtgcagaaggtctgtaagccagtccacagagacattcctgggtgaactccctctggccctgcttcttgttggagaactggccagaggtctgagaccaggctgctgctgggaaggcctggactttggtctcccagtaccgcccagacctggggatgtatggttgtggcttctgccacccatccacctggctgctcatgaaccagccagtcttgatggctttgaaggaatgattccacacaaagactctggacctccctgaaaccaggcactgcaaacggtaagccagcggcagccacagctgtggccgctgtccttaaaccttgtaattgtttctgcttgattgagtcttaagtcattgctttaggaggagaaagagacatttgtgtcttttgagtaccattgtctgggtcactcgcatttaactttccttgaaaaacttataagagaaaaacgttgcctgttaaccattaactacagggctcgtgatactttgagaaaatcttagaaaaaaatgtatacagttgtctggaattatttcaatgaagtgtattagttggggtactggcgctgtctctacttcagttatacatgtggttttgaattttgaatctattttgtctcttcttaagcaccaagtatagatacagtggatacactcactggtttttaacggtggttttaatctagaaggaatttaaactggaggctaatttagaatcagtaaggagggacccaggctaagaaggcaatcctaggattctgaaagaaaagatggttttagtttttatagaaaacactactaccattcttgatctacaactcaagacggtctaatgaattttgaagttactggtaaatatacttcctggttgttaaggaatgattatcaaatggatcagtgcttggatctgaggtcagtgtgagaggacagggcctgggctgtggatatacagaaggaaggccacagctggatagaattgaaaaagaatggagacctgctgctgaggcaagcagatcagccggactctttccagccatagcaaagaaccagattaataaagagaaggccagattaataaagcttgctgagcaaaatttagtgaacaaggttgacagcctggctaggaagctaggctctagttaagcacagttggactgagatgtgtaggcttccctgagcccttcaaaaatgtgctaagctgagatgattactctgaggtagccaaagctggacttgagcaggaacgaggtagactgcaatgagctgaattgagctaggccggctaagctaaactaggctgacttaaccaagatagccaaattggaatgaattgtcttgatctgggctgattggagctaaactctactggactgctctgaactgagctgtgttgggctgtgttgtgctggggtgagctgagctagcatgagctactctgtggtagctggggtgagctgggatgagctgagctgggtgagctgagctgggtgagctgagctgggttagctgagctggggtgagctggggtaagctggggtgagctgagctgggtgagctgagctgggtgagctgagctgagctgggtgagctggggtaagctggggtgagctgggctgacctgaggtggttgagctgagctgggtgagcagagctgaggtgagctgagctgagctgggtgagcagagctggggtgagctgagctgagctgggctggggtgagctgagctgagctgggtgagctgagctgggtgagttgagctgagctgggtaagctgagctgagctgggtgagcagagctgggggtgagctgagctggatgagctgggctgaactggggtgagctggggtggggtgagctgggtgagctgagctgggctgagctgggctgagctggggtgagctgagctgggatgagctgggctgagctgggctgagctgagctgggctgggctgagctgagctgggctgagctgggctgggctgggctgggctgggctgggctgagctgggctgagctgggctgaactggggtgagctggggtggggtgagctgggtgagctgagctgggctgagctgggctgagctggggtgagctgggtgagctgagctgggctgagctgggctgagctgggctgagctgagctgggctgggctaagctgagctggactgagctgggctgagctgggctgagctgagctgggctgggctgggctgggctgagctgggctgagctgggctgagctgagctgggatgggctgggatgagctgaactgggtgagctgagctggggtgagatgagctgaacagggctgaactggggtgagctgagctgggatgagctggggtgagctgagctgggtgagatgagctgggtgagctgagctgagctgggctgagctgggtgagctgagctgggtgagatgagctggggtgagctgagctggggtgagctgagctgggtgagctgggctgagctgggctgggtgagctgagctgggttgagctgagctgggctgagctgggctgagctgggctgagctgggctgagctgggctgagctgagctgagctgggatgagcagggctgggatgagctgggctgagctgagctgggatgagctgggtgagctgagctggggtgagatgagctggggtgagctgagctggggtgagctgagctgggatgagctaggtgagctgagttggggtgagctgagctggggtgagctgggctgggtgaactaaactagggtgagctgggctgagctgatctggttgagctgggctgggtgagctgagctgggtgaactgagctggggtgagctgaactgagctgggtgagctggggtgagctgagctgagctgggtgaactgagctgagttgagttgggtgagctgagctgggtgagctgaactgagctggactgagctggggtgagctggggtgagctgggctggatgagctgagctgggtgagatgagctgaacagggctgaactggggtgagctgagctgggatgagctggggtgagctgagctgggtgagatgagttggggtgagctgaactgagctggactgagctggggtgagttgggctaggtgagctgaactggggtgagctgagctggggtgagatgagctgaacaggtctgaactgggatgagctgggatgagctggggtgagctggggtgagctgagttgggtgagctgagctgggtgagctgagctggggtgagctgagctgggattagctggctgagctgggatgagctgggtgagctgagttggggtgagctgagctggggtgagctgggctgggtgaactaaactagggtgagctgggctgagctgatctggttgagctgagctggggtgagctgggctgagctgggctgggtgagctgagctgggtgaactgagctggggtgagctgaactgagctgggtgagctggggtgagctggggtgagctgagctgagctgggtgaactgagctgagttgagttgggtgagctgagctgggtgagctgaactgagctggactgagctggggtgagctggggtgagctgggctgggtgagctgagctgggtgagctgagctgggctgagctggggtgagctgagctgagctgggctgggtgagctgagctgggtgagctgagctggggtgagctgagctgagctgggtgagctgggctgagctgagctgagctggggtgagctggggtgagctgggctgggtgagatgagctgtgctgggctgggtgagctgagctgggtgaactgagctgagctgagttgggtgagctgagctgggtgagctgagctgggctgagctggggtgagctgagctgagctggggtgagctggggtgagctgggctgggtgagctgagctgggtgagatgagctgtgctgggctgggtgagctgagctgggtgaactgagctgagctgagttgggtgagctgagttgagtgagctgagttgggtgagctgagctggggtgagctgaactgagctggactgagctggggtgagctgagctggctgagctgagctgggtgagctgagctgagctgagctgagctgagctgagctgggctgagctgggctgggtgagctgggctgagctgggctgggtgagctgggctgagctgggctgggtgagctaagctgggtgagctgggatgggtgagctggcctgagctgggtgagctgagctgaaaggatctgggttggagtcagctttgcttgggtgagctgagcagggtttagctgagctaggatgagttgagttggctgggctgagctgggatgaagtaggctaaataagctagcttgagctaaatagagctggggtgagctgtacttaaatgagctgtgattgaagtgggctgggatgagctcagctgaactgggctagctgatgtggatgatggtgaggctgagttaggatgagcatgactgagctggtttggacatgaatgagctggacccggctgacttgggctggttgagctttgcaagatgatgtggactaaactgggctagctggcaggatgagagaggttgaactaggctcagatgagctaggctgagcagggcttaggtgaggtggtttgggatgagctgggataagttgggctcagatgagctaccatgaactgggctgaggtggcctgggagaacatgaatcgagttgcactgagtacagccaggatgaactgggataaactgggctaaactgggttgggctaagaatggactgcctgagttatgctaagctgagctgggatgaattggggattgtcaagacttaaatgagccagactgaactggttggacttgggtgagctgaggggacctgctgcagggccggcatagctgagttgaatttagatgaggaagggtgagctagactgagcaaggctagactgcttatgctgagctacactaacctggcctgagttgggccaggctttgttggccatgtctaaactgagttaagatcaacagggagtctagaggggtaggggatgaactaagatgaattacactagctgagctgaattgagataaggtatggtaacctgagctgaactggaaagagatgtactggataaccttaactgggctgagatgagctaggtctacccaggcctggatcagcttaattagggtaggctagaccaaactgtagcagtatgtattagcctgtgccaagctgggctacattaaactaaactggacttagctaggctcagattagtttcgctactctagatggggtaagttgggccaaactgggatgaactaatttaactagcctgagatgggcagatctgaagtgtagcaaacacagccagggtgaactgaatgagtttgaccaggcctggaccagttaggctaaggaccttgtcctgggcagaccgtgtgctatggtggagtttcatgatgatgccataagagttcccccaccataacccacgtttctcctaccccatatacctgtctggtgtgtaaacctaatctttgtgtgctgatacagaagcctgagcccatcccccttccaccaccacctacctattgctttggaatgagcaaggttatctcagcgaatgtctcaaagggaagccgggacctaggcctgtccctgagagcagatgttcatgcccctggagtggctgccggtggctgaagggccagaaccacctactctagaggcatctctcgctgtctgtgaagtcttccaaagacattcctgtggttagaaggcagccctgctgtggctctgtcccatagaccaaacttacctactatctagtcctgccaaccttaagagcagcaacatggagacagcagagtgtagagagatctcctgactggcaggaggcaagaagatggattcttactcgtccatttctcttttatccctctctggtcctcagagagtcagtcctccccaactgtcttccccctcgtctcctgcgagagccccctgtctgatgagaatttggtggccatgggctgcctggcccgggacttcctgcccagctccatttccttctcctggaactaccagaacaacactgaagtcatgcagggtgtcagaaccttcccaacactgaggacaggggacaaatacacagctacctcgcaggtgttactgtccgccaaaaatgtccttgaaggttcagatgaatacttggtatgcaaaatccaccatggcaacaaaaacaaagatctgcatgtgccgattccaggtaagaaccaacccttcccgaggggatggggagagggggcaggcccaggcatggcccagagggagcagtggagtgggtcttaagccagcctgagctcacacctcaacctttcattccagctgtcgttgagatgaaccccaatgtgagtgtgttcattccaccacgtgatgccttctctggccctgcaccccgcaagtccagactcatctgcgaggccaccaacttcagtcccaaacagatcacagtatcctggctacaggatgggaagcctgtgaaatctggcttcaccacagagccagtgactgtcgaggccaaaggatccagaccccaaacctacaaggtcataagcacactgaccatcactgaaagcgactggctgaacctgaatgtgttcacctgccgcgtggatcacaggggtctcaccttctggaagaacgtgtcctccacatgcgctgccagtgagtagcctgtgctaagcccaatgcctagccctcccacattagagcagtcctcctacggttgtggccaatgccacccagacatggtcatttgcttcttgagccttggcttccaacagtggccaaggccaaggatgagcagtaggcagcagggggatgagagtcagatggagggaatcagcatcttcccttaagcagatttggaagatggagactgagcttttatccaacttcacaactagacacatcacaacctaacacagtgttctcttgactgcaggtccatctacagacatcctagccttccccatccccccctcctttgctgacatcttcctcaccaagtctgctaagctgtcctgtctggtcacaaacctggcaacctatgacaccctgaatatctcctggtcttccaaaagtggtgaaccactggagaccaacactaaaatcatggaaagtcaccccaatggcaccttcagtgctgtgggtgtggctagtgtttgtatggaagactgggataacaggaaggaatttgtatgcactgtgactcacagggacctgccttcaccacagaaaaaattcatctcaaaacccaatggtaggtatccccctttccttcccctccaattccagagcataccctgtacctcacagggagggcaggtccccttctaccctatcctcactattatctttgcttacagaggtggccaaacatccacctgctgtgtacctgctgccgccagcccgtgaacaactgatcctgagggagtcggccacagtcacctgcctggtgaagggtttctctcctgcagacatctttgtacagtggcttcagagagggcaacccttgtcctcagacaagtatgtgaccagtgccccaatgccagagcctggggctccaggcctgtacttcacccacagcatcctgactgtgacagaggaggaatggaactccggagagacctacacctgtgttgtaggccacgaggccctgccacacatggtgaccgagaggaccgtggacaagtccactggtaaacccacactgtacaatgtatcgctgatcatgtctgacacaggtggcacctgctattgaccatgctagcgctcaaccaggcaggccctgggggtcgagttgctctgtgtatgcaaactaaccatgtcagagtgagatgttgcattttataaaaattagaaataaaaaaaaatccattcaaatgtcactggttttgattgtccgatgctcatgcctgctggggcaactgttgtgttatgcttgtcctgcacacaccctgtatacttgcctccaccttggcccttcctctaccttgccagttacatccttgtgtgtgaactcagaaaggcttacaacagagtgtgagcatgccattcctccagctacttctagatatggctgaaagcttgcctaccttggtgcaggcagcattcaggcacatccacagacacacagagacagacatgcatttatacatagatctagagatggacatgtatagatacatgcacgaatatgtattcatagacacacagatagaggttccgcatgcgtgcatggacaaatacaaacaccttcagagacaaatatgcacagacacacaaccacacatggaaacaggcacaaacacacatgatcatgtgtgcaccaaaacagaatataggcaaatatagacaagtgaactacatagacatgaagacatgcatacacagacatgtaaagaaacatcttgaaatgtgtacactaacatgtggacagacatggcacacagttacacctggtctctgaccaggaccataatctccagggttcagggctcagagagtccatactaggctgggtggcactgatactcctcagggtcccactctatgattaggggaaatagcccgaggagcaaaatgtgcatttttggctcaacaccatggggcagaagataccccactaaccacccatgacagaaaattagccttggttgtgtctccattaatagaatacctcaggagatcaatgagagagcgcttgacccactcacttcccagtccagatgcagaagacacaatgcaattgtccaaaagaattgtacacacacacacacacacacacacacacacacacacacaccaacaaaggaacctctataaggagtcaccacccaataacattgcctctttggattcacatcctggacattcttcatattcatatccatttgggacctgggctttagaaatccccaagggctcatctttacagaggtcagagatcccaataaatgccctggtcccacagcctctctatctcttggtaccaagactcaacactgctggcaggggtagaacaatcaacacacaggaactctgatcaaagagaggcatgagatgcctgggtccttcaggaagtaaggagggataacctctgatatgcctactcttattcccaaagcccaggagaagggaaacctgctctgaattctcagtctaacagccccgatggtgccacctgctcagagaaagtccaaagaacacaaaaatcattatgccacatttcctgagtctgcctttacccatgtccgtatgttgcatctgccttgcttgctctgctgccccagagttcctgggacaaggccccaagttagtgcctcctccagtttgacctgtgctttgtctctgtctagcttgagctattaggggggccagtcaattctccagaaccagcagaacacccccaaccctgaggcaaatgttcaatcaccccaaggcttggcttgaccctccctctgtgtgtcccttcacagagggggaggtgaatgctgaggaggaaggctttgagaacctatggaccaccgcctctaccttcatcgtcctcttcctcttgagcctcttctacagcaccactgtcaccctgttcaaggtagtgtgtgtggtggggctgaggacacagggcagagacagggagtcaccactcctcactgcccctacctctactctgtaaaagggaacagcaattcacactgtctctgtcacctgcaggtgaaatgactctcagcatggaaggacatcagagagcaagagaccctcccacagggacactacctctgggcctggggttcctgcctgtatgactagtaaacttattcccacatctttcctgtgttgccctccagctttgatctctgagacgggcttctttctagactggccaaagactttgtccacttgtgcaacctggaacaatgtctggaaccacagacagctgtgctgtatacaaatgtcactttgaaataaatacttcaccttgcgaacccactctattgtgaaggaatttgttcttgttttcaaacttttcctgtggtgttgacatcccaaagactctctaaatagagcctgggaacttgaagtgaacagtctgatggggcttaagagtgaaagagggaaaggaggtgtggaagaagagagagagagagagagagagagagagagagagagagagagagagagagaaaccaccctgacagcaaagtatagcacaggcagccaatgggtagcagtctggtttatccaccctgatagaagaaagtagggcagagaaaactccaggcctgatctcacaaaagcaaccgaatctgaaaagtagcctctagcctggggtgtctgctccatccctcagcccaccctcttgggctggcgttgcttccagctagtgcaatactttggtgttagccaaacctttgtggtatgtggggtgtgccttgggagagttggctgagatctctaggatgtttgtatcccttctgcaacatgacaagccctaggggttagcccataacttgaggactcaaaccctctgtctataacaactgctgtggtcactggagaaggacagctaaaggcctgctcacacagcaggaaaggaaagggaggtaggtcatgtacttcagctcagaggaggaagcacagcagatacaaggtgagggcagtgctaggggttctgctgttcaccgtgtggatggctggaggaacctcacagaggtgggactagctggttacattgagagcaggacctgggagcagggcataagaaagaatatcagacagtgggagggaactgtgtagatgccagggtcctaaagagagtctttaaataagcatgtatggtagcaccttggtgatggcccctttctgagttgggtttctagtgggtagctgcaggagagcaacaagcatctattgagaaaacactgtaaagacgatagggcccaccaccaaattccagatatattttaggcattcacctcaataccctactttccataccagcatctgttttagtttccctgggctgcgggtgcaaagtgccacatgtggcagtttgagcaacagaactctgttctttcccagttctaaaggccaggattctgggcttcagcaggctggttcctctgtgcggcagggagaatgtgtcacagacttccagctctgaagccatagcatttgactaatacttgtctcctggcaccaacaccccagttactgtttcaaatgcatagcccatccccatgtgtgtttcctttgtacttactgccacgtttcacgaacccagttctgctgggtttgatgcccaccctcattcagcacaagttcatctcaggcagattccacccactacgacctcagagctagaagtctatgacacgttctccctgctgcacagaggacactagcctgctgtagcccagactcctggcctctagaactgtgaaagaacagagttctgttactcaaactgccacgtgttgcactttgccccagcagcccaagagagctacatagatgttagtatatgacgtaaggtgcagaggtgactttggaattgggcgatgaacctccaggcagtaaacagcctgctgacctttgcattagctgtgtgactgagatcacatcagttcccgacccccaagccccttcagacgtcacatcaatagagtcaaccgttagagtccatcgctataggaatgatgtcgcttgcactttagaaaggttttataaccaggactgtagttgtaccttaagctttgtgatatgtaaagaagtgagctaattatcaaaaggaaacattctgccaagtgatgttgtacttgaatgtgcccaaaacaaacatcccagcatcaaacgctagtatcttaaaccaacacaggtactgagtcatattaaactgaacgtacttcttgattcacacagacctacactgctgtctctgtttgcggagacccatgcagactaggtactggtgcacatagtcaacgagatgctgagggaggagagcacatactttaaggtagattaaaagggcactggacttggctattgacctccaggccacgctcaatgatgaggcaactaagagtctctgtacagccagaaatgtccccatatgctggccaggtataagatagatggtactagacacttggtgcaagagaaagagagtgtatatgacagacataggcacttgtagacttagtacacagcccactcagggccctaactgtctaaaaatgtgaaggagaatccataactcagtccatgagcattacatacacacctgtagctccacccacctcatcttcacaccttttaacatacagatcatcaggttatatcaggcctgtggcactctgaacccatctccatggctagtctatatccagaatgctgatggaccagcggtcaaggaagcctctctacctaccactctgatgccttttcctcctgagcttcatggtcaaagagaggatccatgagagcatccagggaccaaccacagccctatcagcacatggttctccagccatgtcgtcaactctgtctacccttggttattgctctttaataggtaccttgtctcactgtggcttataggttccatacgtgactatgatatgatagttcttcatctcaggtcctctgagtatcaacattctcacagacctagagcctgcctttgctctgaaagctgtatcttctcaacttggcactgacacagacagcaccctccattcctgtgtattgacccacatcctacccggagatattcctcaagaagcctcctccttaacctatgttcttccccggccagcacaagctcctaaatctgtgtcctgggtctgagccttggacctcataacgtggatcttctgtttacagaggttcaccccagcatcctacactacaattacccagcatgggcacctctgaccagacataaccttcctgattaacaatctgcttcttgttctccacattgcagtctttctgatgaggcccacataacctacaggctcctcacctctttctctgacacttcacaacacattcttccttcccttccattacatactgtcagtgtctctaaacccagagaaacacctggcttttcctagcagtcccaatcattcaagttaaggaccctcactttagtgaggatggccagtcccatgacccttcagaatttgttcccatctacatagttctgaggccctgaaggtcaccctctcccaatatctgtacctaactcctcctgcaaagacctgcaatgagctcctctactctgggggatccactaacctgtgtatcatgtgccagagcaggtttgattacttcattccgtattctcatgagcccctgagaccagaactggaatccctgattccacaatctaaaccatcaggttcccatggcagtccattttagagaccttctggtccgtgcctcttcttaatttatccaaggcattctcctgagtctcagcaatgcttctgtctgaagacataatttcctctacttggacactcaggcagagactcgagcctcttctttaaccgattcagtttggatggcacaccaggcttatcagtgttttcttgagatagcactagctagagacagggacagagaggtttagccaccaaagctggacttagatcacacatgaacaagaggcccagaggctatgaaccctctccaatgagctggtcaggaaagagtgggcataatcactcagcctcagccagctcagggacccagaaggcccaggtgcacagagtaggagcacatccaggcttcctaccttgtcccctgagtctcaagagtaccacatcaactactcccacacatccacatgaactaatctcagtcagctttggactccccctcatgtccagatacagaaacctccccagaataaaggggaacctcaggaaataccttatgccacccactgtcaatcatgttcttactcaatcatagggtggaaatagggtggcattcgcatctctggaacaaaggctgtgactctgggaaagacaagagaaagccaggaacaaatacatctgctttcacagcttccacatgtcaaaggggtcagcactaaatgaagctgcagaagaagaagacctcacagacagccagcatctgtagcccttccagatctttgagtcatcctatcacaggagattgagaaggagttgacggaccagcccaagcagaggaagcctgtgtgttcaacagtaaatgtgtttgccagcagcctgatgtcaactgagaagactgtggcgagtgcttgggagacaatcacgggcagctagagctgcacaaccccatagacaacaagcctgaaacacaaggagatgatgaaatatatccagaagactgcggaatcagtttggcctggaccacaggttgatagaaccaaggcagctgagccctgtggtaagtgaccaggagggcagagggagggagcttccaggagcatgcctgggaatgccttcaggccttctgagaagcagaaagtaggcaccctggggttccaggaaccatcccagcactcaagagttactaagggaatagaagcaaacctgagctgaaggagagaaagaaaagtggagggaagcccaagccactcaaagtaacaggcaggacaacttccagtgagctgagagaacaggagtgctggagaaggcagagcaagcccagcagatcaggagaacctgcataggagtctggatgactagagaaacccagaaggtgagagaacaggcttaacagctgtcatggacttagggatatgcaagcctggggcaccaagctgatctgcatagagggcaagggtaagtgggaatccaagagatctaagaatgaccagcgctgggcagagaggtggcctgggagaagatggctggtcttccccatgagtccaatagcaagattgtcggaataggttatcctatgacagatggcagtatcagtgaccaaatgaagacgctatggaagaattggaccatgtgggagttaagagttgaggacacaaggctgacctgcccatgggaactacagctgataaaagtgctgtgattcagggcatttctggaagctctgtgatccaggttgcagtacacaagtaaactgggacagacgggagttctgggggttcagttcagatactaggaacttaggaaactgggaaaagggaagttggggctgatggcagaactatgagaaggcactggaattctgaagaccagaccttctaatcaactatagaggaaatggagtgggtaggagtggtggatacagctgagcatcacaggggacctggggattggggacagctatactggggctagcagtgcaaacacagaaattgggggaccaaagggggaattgaggatgaccttgggtagatagaaatgctggatgcctaaggtacctccaggagcttagggaacctcgcagagcagctacaaagctggtggtgttagtgacactttcagaaccagatcgggcaggttggcatgtagaaatggggttaatggagacccaggacagtggcagattcagaataaaatacaaacaaccgaaagagttatgtgccctgtaagaagttgatctgacacccacagcagagacatctaaggtctcacagcccacatcaaacaggcttctgatctaaggacagcacaaaaggaaggaggcatcaaaccatcctggggaagacagtgcagtagtagccagaagtgtaagcccaacagcagtgggactggtgtagcagccagggacagggtccctgccaagatgagcctcaggggagctgagcagctgagaaactcaccagctgagaagctcaggggaatcagggtaagtggaggttccagagaatcaggggaagtcaagagctcagaacccaagaaggggcacctgcaaaagagctaaggcctatgagagtgtggggaacactttaagcagctttaggggagccaagacaggtagaagtgtggggacccaaacagggaagctccaggggagctaggaaaggtggaactgtgggaatccaggcagagcagcacctggggagcaaggaaagaagtgtggggatccaggcagagcaggtccaggggagccaaaaagtggaggtgtggagacacaagcagggcagcatctggggaaccaggacaggtggaagggtagggacccaggcagagcagcaccaggggagccaggacaggtggaactgtggggatccaggcagagtagcaccaggggaccaaggaaagaataagtgtggggatctaggcagaacaggtccagaggagtcaaaaagtagaagtgtggagagccaagcagggcagcatctggggagccaggacaggtggaagtgtggggatccaaccagagcagcaccaggggagccaggaaaggtggtagtgtagggtcacaggcagagtcgaaccagggaaccaaagaaagaagaagtggggggaccaggggagccaggacaggtagaagggtggggacccagacagagcagctccaggggagccaggacaggtggaagggtagggatccaggcagagcagcaccagggaagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaataccagggaagccaagacaggtagaagtgtggggacccagacagagcagctccaggggagccaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaagggtggggaccaaggcagagcagctccaggggagccaggacaggtggaagtgtagggacccaggcagagcagcaccaggaaagccaggacaggtggaagggtagggatccaggcagagcagcaccaggggagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaatgccagggaagccaagacaggtagaagtgtggggacccagacagagcagctccaggggagctaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaggtgtggggacccaggcagggcaccaccaatggccaacaaggtagaagtgtggggacccaggcagagcagctccatgggagccaggacaggtggaggtgtggggaccaaggcagagcagctccaggggaggcaggacaggtggaagggtggggacccaggcagagcagctccaggggagccaggacaggtggaagtgtggggacccaggcagagcagctccaggggagccaggacaggtggaagggtggggacccagacagagcagcaccaggagtgtcaggagaggtggaagttaagtagttataggggaacaggggcagaatagaatgagggatgcaggctgagaggatacaggggaaatgtggcaagtggaagggcaggaagagaggcagagtggctacagggaagttgaggcaggtaagactgtctgttccaggtcaaaaaacactgaagaccagtagaaaggaaactggtgcatgtggtagtgggggattcttagcttagcagtcacagggaaagtgagccaagtaggaatgcaggcatggggggcaggcacagctgagcaaacactaaagagctgtagctgaagggttataaggtaccaagctgagaagctgctgggaatctggagctaatggggtgtgggggagcaggctgagcaactacacaggatcagggataggtaactgtgtaaggaggcaggctgagcatctccatgacagctggagctactatgaatgttaagctccagactgagcatctgcagggaaacagaggcaagagggagtgtggggatccaggctgagtaggtccagggaagctgtagtaggtggaggtggaggcccaggctgaggagctacaggagagatgggacactagggagggcagggatcatggccaagcagatactcagtagctgagatagatgtggggaatcagcttaagcagcagacacaggggagcaggatctagtcagcttctagggatccaggctgtgtagacatggagggactgggggagctataagtaaatacactaggcataaaattacagggaaacggaggccagtgggaacgtgggcctcctactgaacaagtaacagagagccagaactgacgggttgaagaggaaccaggctgatgagctccaggaaatctgtggggactcggtcaatgggagaacagggtgagcagctatagaggatcagggataggcaaaaacgtatggagtcaggctgagcagttacatgagagctggagccctagttatgtggaggtccaggcagaggggctggagggtagctgagggaaatggtgctagagaatcaggctaggcagacacaggggagcaggttctagtctacatatgagtggggatccaggatgtgtagagaaaggatagcaaaggtcatggaggattccaggcttaggggtcactgggaaactaagactggtggaagtgggattgtcctaagtgaacaaattccatgaagctagagccagtgggtgtaaaggtagcagactgaaggactatagagtatctgggggtggatgggaatgtggggaatcgtgctgagccactacaaggacagtgtggctagcaggctgtaggagaccaagctgagtatctgaagggaaaccaagggaagtggaagtgtaggattccagaaatgagcaaatgcagggcacttgaggcaggtatcagtgtagggaacgagactgagcagttcacaggtcacccagggtaggtaagagttctggatcatcagagaagcctctggaagccctaagcacctacagtagacctaaggcaggtggggtgcagggaataagttgtgcagctcctgaggaggaggacaggttggagtagaggaggttctgactaaagagttgaatgggagcagggcaggtgggaatgtagaggaactagctagacagaagtccagatgagattgagggccacatgatgccctgagccgatgagctggccttagaaatcactctgctgggaccagggccaggggtttgaggaacaaggctgaggtgaaatggtagcatgacagggaggcaatggcagagaggaaggagaaggcatgcttaattcatggtggagtgcagggagggaaagagccaggaggtctaggctggagctgatccagctttctgcactgatgagaggggcgggactgagttcttttggctccaggagccagggcaacaagacaaaggcgcctagcatagcaaggacacatctggatctaagaccaggagaagagggcaagaccgaaagttcaggaggtcatgggagggagtgggaaatctacaagggactgtctttagaaaagagtaagtgcccagtggagggagtgcccaagcaacaagtccagtgttgggagagatcggggtgggcaaaggctgtatgtgcagtaggcaggcccaagtccccaggaaggaaagaagaagtgcataggaaaacgggtcaggtctagcaggagccaaccgaggtgctcaggactgagaggcagagcccaagacacaggaatcgctgagctcatgcaggtaccaagaataactgagagctaagagaaaaattatctagggaatagggggacatgaggaaggactgttggctgagaagggaaagggacagggagaatcctaagggttggcatagacaaaggaaacacacaggctttgggttgttagtccggggctctgcatatgatccaccgagattgtggaaacagaagagcaggaagatcaaatctgtcccaactatacagggacacacggtcaacctacaaaaggaaggagatgtgaggatcaggggctgagcagtgaggaggtgtgtggaggtgttagagctcaggtgcagcagagactagcatggccctggggatagagggaaggacccaagggacagtagggacaggagggcgaggtgaggtgatgaccagcattatacaaatggtggcgctgtccaacttctagggccctgtgctactgagaaaggaaagggacttccgaggtttggcaatacaagccccgtgcaaaggcagaacccagggcactgtgaagacaacactgcaagacaggagaagccaaggctgagttcaccgaggtcacattagtgagaatacactgcgaggagaggggaggcgctgagcacccagccacaccagacaggcccatgctgagtccctggacagtgggggaggggagcacctggtgacctgtaagaactgtgagactggaggagaaccaaggtaaaaggtgtgtcaaaggacacatgtttagcaggctgggccgacttaatgcaggacacacgtggtggcaaagccaagagggctgcgtatgagccacaagtgaatcctgacccaagaatagagagtgctaaacctacttacatcaaagccaactgaaaggacaaggccagcaaaacgaagctaaggccagagatcttggactatgaagagttcagagaacctaggatcaggaaccattagtgaacagacaaaggcaggtaaagcagcctaggagtggacaaagacaggagaatacagaagacggcagggatgacccgacttcagtttgggcttcactgttgtccaaactgtgtgcagattatggcccatgggtaagaggtttagcattagaacacagatacccacattggacaatggtgggggaacacagatacccatactgcaaggctcttcgggccctttcctaaaagtgtactaggagtgggactgggctcaaagggattaggtgtgatctggcctggtgaggctgacactgacaagcccaatggttgggtgttgcatcctccatttatacagccagggacttggggagggtacaaaatggaggacttgtaggagcttgggtccagacctgtcagacaaaatgatcacgcatactttttcttgtagctgaaacaacagccccatctgtctatccactggctcctggaactgctctcaaaagtaactccatggtgaccctgggatgcctggtcaagggctatttccctgagccagtcaccgtgacctggaactctggagccctgtccagcggtgtgcacaccttcccagctgtcctgcagtctgggctctacactctcaccagctcagtgactgtaccctccagcacctggcccagccagaccgtcacctgcaacgtagcccacccggccagcagcaccaaggtggacaagaaaattggtgagagaacaaccaggggacgaggggctcactagaggtgaggataaggcattagactgcctacaccaaccagggtgggcagacatcaccagggagggggcctcagcccgggagaccaaacattctcctttgtctcccttctggagatttctatgtcctttacacccatttattaatattctgggtaagatgcccttgcatcatgacatacagaggcagactagagtatcaacctgcaaaaggtcatacccaggaacaacctgccatgatcccacaccagaaccaacctggtgccttctaacctatagacaccaataacacacagccttctctctgcagtgcccagaaactgtggaggtgattgcaagccttgtatatgtacaggtaagttactaggccttaaattccagccccaggtccaacaaatgtcctctgaggcccatgttggaggatattggcatatttccacctttcttcttcatctacaggctcagaagtatcatctgtcttcatcttccccccaaagcccaaagatgtgctcaccatcactctgactcctaaggtcacgtgtgttgtggtagacattagccaggacgatcccgaggtccatttcagctggtttgtagatgacgtggaagtccacacagctcagactcgaccaccagaggagcagttcaacagcactttccgctcagtcagtgaactccccatcctgcaccaggactggctcaatggcaggacgttcagatgcaaggtcaccagtgcagctttcccatcccccatcgagaaaaccatctccaaacccgaaggtgggagctgcagggtgtgtggtgtagaagctgcagtaggccatagacagagcttgacttaactagacttctgccctcttactgacctccatgctgaccactctctgtatccacaggcagaacacaagttccgcatgtatacaccatgtcacctaccaaggaagagatgacccagaatgaagtcagtatcacctgcatggtaaaaggcttctatcccccagacatttatgtggagtggcagatgaacgggcagccacaggaaaactacaagaacactccacctacgatggacacagatgggagttacttcctctacagcaagctcaatgtgaagaaggaaaaatggcagcagggaaacacgttcacgtgttctgtgctgcatgaaggcctgcacaaccaccatactgagaagagtctctcccactctccgggtaaatgaccccagagtcagtggcccctcttggcctaaaggatgccaaaacctacctctaccacctttctctgtgtaaataaagcacccagctctgccttgggaccctgcaaaaatgtcctggttctttctgagatacagagtccagcgaggtcatgggctgaggggcgtccagggtttgaggcctgaggtttgactaaggaaaaagggtgatctacactgccagacacagcacttttgatttgctggcatgaacagaatttacctctcactgaaaagtggaggctttatcccgaggcaatccctcttgctttctcttcctctacctaatacatctatagtgggcacagaatatatcatgaaagtaaggacgacccaaactccacctccctagtccacctttacccctcttcctagccaaggatcccactgaaggcactcaatggacacatatggtcacagacagacccttgctattccaccactcaatgcaagaagcgttccagagactaagtctaatgtaacgatgcacatagctgtcactgctctctcactgcccatgagaatcaacatggacccattagacacaacctgatgagcaacactgagggcaaaaggcccatatgtatgcatgcacacacatcttcaaatgcacagcacagtgacacacacacacacacacacacacacacacacacacacacacactggaacctcacatgggcatcctgtgcagtactcccagatgaaaagaaaccaggtctacacacaggatcatcccaacattcacaagtgggccagctgagacagatacaacttttctctgccttggatgcccacagacatcttcatgcacacatgagtttcctggggtcaatctgtccctgaccctgggatggtgccccaacctcacacagttggcacccatccgaaactgtataacttactcacttcccactgtggatcttaactgcagtcctagcatcatggggaatcagctctgcaatccctctggccctcagttctcggtcatcagcagatacaggatcaggcagaccacacagacactacccatgagaggcacaggccctgactcagcctagccaggttcagaactcaaggctggagcacacacagaatgacctagtgtataggccaggccaccatcaggtccagggtgtctggtgagctcagggacaaaactacagcactttggggaactgaagtttctggtccagagagagatcagaaaggagagatggcctcagggagggtctgctggcccagtcaggctgtaactttctcctggaactccacacaacctcatctgacacagggaatggccctagtcacgccgtgttgggataaacaaacgctgacttccctctctgtccagggatggaagtggacgatgcctgtgctgaggcccaggacggggagctggacgggctctggacaaccatcaccatcttcatcagcctcttcctgctcagcgtgtgctacagtgcagctgtcacactcttcaaggtcagccacaccatctccacagtgtccacaccatcctcacactgttcctcatactgtctctgtgatcagctatgccccacactgtcccatgctattgacctgtcttacatgctgggcaatgccacctaaccttctctatgatacagtctcacagtgtcccatgcagtctccctaattccccaagatgtccgcactctattgctgtgttgcctcatgctgcccccacactgtccatccctccctggtatgctatcccaggctgttgtctctattttcatgctctcctcacactgtccctagtgtctcatactgccaatgttggctcccacattgtccccacactctgcacacaaccggacaataaaccctgctgtcccataatgttccctgtggtccccaactctatccctgcacatttgtctatgttccctgaattctcatgttgtttgcacactgttagtgtctaacgaactctctcccaggtgtaccttcttccatgctgtctcacctcatctcccattctgtccttgtactaaccccactctatcacgacactgtccctattcactgtccctatgaagtgcccatgctgtctgcattctgtcccatgttgtatcctcatcccggtctcatgcagttcagatctatctgacactattcccactctatgcacacatttccccctataccatccctgtctgatcaacatgcaatcctctagacacccatgtagcaggttagagactctagggatgggtacctgcctgactgagctacctctcttggtgggagaggaaacacaggtgagagtgcagtcctgatcttatcttattcaccctgtcccacaggtaaagtggatcttctcctcagtggtagggttgaagcagacgctggttcctgaatacaagaacatgattggacaagggccctaagccacctcctataatggcaaaggattccccacgccctagaggaccctgtccaatgtgccaagcagtctgactcagatcacactgtctgctcacttcactatcttctgtctatgagacccaacctccctcaattcttctctctctggaggactatgtggacattagatttccacaagccacagcctccaggacctaaaataccatcacagcagcagccaggacactagatagggtcagaaggaccatagtttcctgactagtttatccaatctgttgggacagaagaatcactgaaaaagtgacaagtgcccaagttgcctgtgttcagcttggaagggaccaaccttggaaccagtcctgtcagcatcatcttctaaaacacaagaattgagtatgtaaatggcagattttggatccccagggtaagacagacttcaaccaggccacgacctgggcaatcatggcccagctgaagttgactgaattattccagtggccttcacatcgtcttgccaggttccttcttaccacttccatgaaccctgggatacagaaaagaactgtgcttctcgggatcttgggacagaactgtctaattggtgggatccttaggtagatctttcttccagtcacgggtataatacaatacactagattctcacataaaggaaaaaattcacacacaactccggccagtcctgaggcctagacaccaccacctctctggaattctgagctctatgctggaggcacaagagaggaaggcctggacttcatggcctctgtgtagccctagtaggtgcagaggcccctaagccggggttgggtgaccagcaaggacctcctggagagggatctgatgagtagattccacctgggacagaaggaaaaagatgaaaagcaacagaggtggaagggcactggagagagccatggtatagcaggtttatcttgcagacctgacatctgtccatgactctgagacttagctaatgacagctggggcagcagtccaaggaattaccatgccccctaacaccaggctcctggagtgtggagtgggtctactccagagctccaatacctgtttctccatcacttctcagccaatgagaaatcggtttccagacaggaagaaaaatgaaggcaggaaggaaaagtgggcacctgttcttctgtgagtggcaggaagttctcaaaagactcaggactttggcttctaacttcctgtggatcattgatgtctctaaggtctctgtctgctttgttggttttgtttgtttttggtttggtttttttttttttttttttggtcaataaaacgttttttcaaacattccacaatctctgtgttcttcctatgtgaaccagccctggtacttagaaacagcactgttaagtagaccagtgagtcatgaagaacatactacctctcctggtcctgtgtcctaccagttctcctctaagggtcccttcacagctgtgtgccagctctgctatcctataccagataggtcctccgtctttcttccctatgggcagtttcttcccagccagaagctgcctttgtcctgtaggttgcccactcatggcctcccacaccagccacacaaactaagaagcaggtgtctcagtgacctcaggctcagtgataacatttctatggaaaagtgaaggaataagaaagagaagaaatactccagagtcagggaagagaaagattataagggatgtttgctttctcaagtatgtttggagaagttccagatcaggcgttgacaaggtcgggttctcagcagggctcttcttgcctggtaggtgccttctcctccttgtgacctcacaggctttccctctgtgtgtgtctctgtcttgatctcttctcataagtacacagtcaggctagaagaggtacaccctagccctaattataacttatcagtttatgaccctgtctgcaaacataggtcatggtggcttaaatgtcatttgctgaatcttctggggacagaatttagtccacatcagctctccctatggaccccaaaagttcatatccttcccacatataatgtccctcaccccatacaaacaccccaaagtctcacccttccaccatcagctctgtctcaattctcctccaagactgctagttaggtaagtgtgagatgtgggtgtgactcattcaggatcaagttcaagccatgactgtcaggaaagaggtttaggccgtcagcgcagagcagattccaggaccatctgagcagttgctgaggttcaaaggcagattatagactgattccttgctatagagaagatagcccattgtgatcctctcatactagttcagtgataacaattctatggaaagtgaaataataagaaagagaagaaatactcgagtcagggaagaaaaagaacctgcaggggctgccaattgtctcttgttctgctgggcgtgtctgtgccctactagagttggattctgtcttcccatggagacaaggagacaccggctccatggcctgagatagcaccgtagaggggcccagaatttgcttctggaatgtaggagtgttagcaccaatggagagctaaggtacacaaaggcctcctaagcaaagacccaaaaacaggagctaggtgctaagtgtgcagttgagttctcagatggtgtttagatgtcctcaggtatatccttgactgttagagactgttcaagccattatgacctctagtgatggctatatgagggaaatcaactgggctggactggtcaagagaagatcctgtcaccacagctacagtggtgaggggctgggtggggggcagaatccaaactggccaatgccattacagtttctggtatagggaaagacatgcttttcctcggacagagaagcagcagatccctgtgagtggtattgctgctggggaagccatagggagatggacctcggagggatttgttgctcatgtgcagacagctgcaaggagcctgggctttggccaagcacactgggcagccgctacaatgctacacactttgggagttaggacagtggaacctagactacaaagaggacagctgcactaaccctgagaaaagttacttaattcttcacaaacctctgtttaatgtgtgaccaaacatccctccctgcaaagcgagggaagaagaacatagaatagtgaatttaaagaacatttaggcctgggacagtttccttgctcagataagaggaaatgtttgttttatctcatagttcaagtgtacagtctgtcacagcaagagtcttagtttcatttctgttgcaatgataaagtaccctgaaaatagcaactttattcagcctgctgtttaaggttacagtctatcaccgtgaaaagtgagagcaggaacttgaggcagccagtcattcacacaatcaggaacagagagaggggtgtgcacgtgcccactacccagtgacacgtgacgttagaaaggaaatttggtggggataaaagaggaaatggaggagagggagtagggacggattttatatattacatgtattatgaaattccctaacaataaagagagctacaaacggctcattaggagaaggtacaatgtgtgaagctcttcagtgggttatgaagtagggatggtgaagcccaggtgcactgaaaatgaatttaccccagaagccgcccttcatatgtgcaccatgacatgtgcacgcacacacatgtacacaattatacatagacacattcaacataaacacaacatacatgtacatacaccacaacaccacacacacacacacacacacacacacacgaaacacatacataaacacacacaatcattcatggacacactcaacataaatacaacacaccacatgccctcatacataccacacatacacacacacatgcacacacacacacacaaaacacatcaatacatgcaccaccacacacataccacacacacaccttcatatacaccactcagcacacacagagacacaaaaaaaatacatatttacacaccacacacacatacataaacacacacaatcatgcatggacacactcaacataaatacaacacaccacatacactcatacataccacacacacacacacacacatacaaaacacataaatacatgcaccaccacacacacataccccccaacacacacacacacacacacacacacacacacactagaacacactaatataataatgtttaaggactgcatcatttttctatctttctgcaggcacttgtctgaggtgctgaatgttttcatgctcccatccttgccaaacagcactttatgaggagttataaccatgccacagcctcagtgtggtgctgacttaaaagttcctccaccaaataaactattccattccttccgaaaatagccagatactttcccagaatgtaatacaggtcatcaggtcttgatgagatcttgtctccccaccctgaaacctcatgagctggatccttgctgtccttaccccctttttaatgttccctgcactgggctttctcgtcccacagcatccatgtaagttatcctgaaagatgccacatcctttcctctgctgacaaatctgtccaccttactgtttaagttcctagagtaggtatattctgagaaagtacttatttatatccagagaatatatacatttcacatagttccttttgttctggttattgatgtcattgggtcctgaagttgtgtttggaccttacaatgacaaaaacccatctttccctttcttttaccaccaattctatctcatctatctccctgtttctctctgtccatatctctgtctttttctctgtgtgtgtgtttctgtgtgtgtgtttgtgtttctctctctctctctctctctctctctctctctctctctctctctctctgtgtgtgtgtgtgtgagagagagagagggggggggggagacatgtgtgtaggtgcgagtgaaggtcagaaaaggcatctgatccctgaaacgagaattacaggaggttgagaaccacctgaccagttacagagaaccaaaatcagggtcctgtacaagagcaatatgctctcttaactgccccgacatctctccagcaccccagctttcttctgaggtcttgtatgtcatacataatgaactcagatagggcacacccagtgtagctcagcgtagccagtacagccacagctagagatttgaagaactgggccatccttccagctgggcactgtggcctggtttctgctcaattagagcttcaatcctcaagatgaaggaatcgagtctgctgggccatggagcaggcctgagtgcttgctctctgtgggcaagcatgtgtcctgtttgttaccacagctagaaacagatgcttctgctgagaagctgcctgcgaggaggctgttgatgcagagtcgtgaagcgtggcgaccgcggcaacccacatgacaaggctgacttacagactgtggcttcagtgctggggcaaacaacaaccaagaggtcctacagacactccagagccacaaggtcaccacatgtctggagcagatggatttcagtcaacacttctaccacccaagaagcttttgtggtgctgggtatagatgaactcaagtagcaaggttcgggctgtgcttgggaatcccggcaacagaagggtttgctggagtggtaccacaagcattgctgtagtgcaatttccatcttctatgtggagaaaagcccaagtacagactgtcaggacaaaaccaggcagcttccatccccaaaactgcccatgagtctccagccttggtaccctatggcctccgaaaccgcccaggggtgtgtgtatgtggtctctaatgaaaaacatcaagccaaaaatccagaaaggaatctgggcacaacctcccagtggccacaatccttccaggaagattttcttcagtaggctgaggtaaacagtcttacggaaagtgccatccagtatctccagtggtctggaagaccctgagaaacacttgctgaccaacatggtcatttgtctactcattactgcaggcgtttgttttttaagtgtgcatccgcctgcgcgtgcccgtgagcctgagcgtacgcgtgtgcgtgcgtgaggtgcggtgcggtgcggtgcggtgcgtgcatgcgttgcttgcgtgcgtgtgggcgggcgtgcaggcgtgcgtgcatgtgagagagagaacacatgccgcaggacacaaagaaaccagaggacttgcaaaagtcagttctctcaacaggtcagtcctagatacggatcttcggcagccttacccgctgagccaccacactggcccattctttcagtcatttctccatccatctggctctcctgaggtgagaaaccttggccctccaatccttgcagtcagcattggaagcagattgacagtgatgggcacataggagagggagcagtgccagatgacagggcaccgggagacattgcccatatcttacaaagggtgaagatccaaggactggtttgggagccttaggggatcagccagggcctctggtgtagcagagacccagcactcctggtcaactgtacctacagaggtttaatcatttctctttggtaggctgctatgaccaatggatgctttgaaaggtctgtactgacctgtggggctcacgcagaactgggcctagcaggtggggtttgaagtttggcagcctccgtgggaaggatgtgaggaggtagacaatgctctggagagactggagccctgaaaggggggcactggatgtttgctgctcagattgggggtgatggccactcctgggtcacaaagaaaggcagggacttctcatgggatcactcaggaaagagatctggagaacctggaaagagagattatcaggaaagtactccaaagccctctgggagcttttgctgagtctctaggttggtaccctaaagcttgccagggccacaaacctctcttggtgggattaagctgctgcaagggtcccagattttttttctttcacatttgagttgttacttatgggtggcacataaaattactcttgttttcccatcaacgtcgtagggtaggaacccaagatcggagaactgatttcttccatatagtcccaaattcacacccaagtgacttgcttcctctcttagctcctcccccaccatcaccacctcccagtaacactgtcatgctctggatccatcaccaagggcttgacccgatggttagttcagagcactcacgatctcacagtctctggaaagtcctgcatagacagaagtcccatcacttaatccactcgaggggacaagcaaatgaaccgtctcatcggaggatgaagaatcttactaccgggtcccgacatcagcttccatcctgctgccttgtcccaggaatgtcagacttaacacccacgtttccaacccaactgcatggctagtcccttaaaactcttcattccctccccagtctctctgcatctgtgtccatatctgtctaaagaaccatccttccgcaattggagctgtggccataaattttgcgtgtgtcatttatcggttgtttatgtcaaccatctcccttctctgttcctgttgtctgcctatcacctccatcctcatcaccctctgtccctatcatatatatatatatgtatatatatgtaaatatatatatacagttgatatgcaggaaatatatattcagtttatatgcaggatatatatatgcagttgatattgatatgcaagatatatatacagttgataggtaggatatatatgtgtatatgtatatattgtatatatatacagttaatatgcagaatatatatacagtttatatgcagaatatatatgcagattttaagtggactagcaagccccgagccctcaagaaccgctaggatccctgcccagtcatgttactgtcattggaagtcatcttctgtttccactccaccaccacagaaaagatccacttcatctgttgggcagggtggttgaggagaaccaagaccagggccctttaattctgtggaggaaccaaagacagctcctgctacataggagcctgtccggtggtatggggaccagggagaagttagaggtgtggaatacagggatagaatggtgtacaacgagggatcatggtgtaagggagggtactgtgaggacagtgtgtgaacagagtgtagacagtgagaagaacttggaggacagcatccgcagcatgggagagcaaaggaaggtgtgacgacattatgaagatattgtgggaactgcacgtgagtgtgaaagacagcatggggtagcaagggaggagctgtgggacactaagtgtataggagggaagtagcatgagacgctctagagcagttgttctcgaccttcccagagctgtatcctttaatacagttctcatgttgcggtgacccccagccataaaattatttcattgctactttgtaactgtaagtttgctaccgctatggagtatattggaaatacttgttggtatgcaggatatctgatattcagagtggctacccatggcataagaaccactgtgctaagtgggtagaagggccaccatggaaatagcatggggacactagaaagacagcatgatgagagtattgtgatagcattgggatggtgtggggtcttgtgaggatagggtggggacagaagagtagacagcataggtcgtcacagggacagtataggaacagtgtgaggacagtgtggacactgtggagatgttgtggctgaccttgaagagtgtgacagctgcactgtagtacacactgagcaggaagaggctgatgtagatgatgatggccgtccagaccccgtccagctccctgtcctgggagtcagcacaggtcttgtccagttccagccctggacaaagagggtagtcagtctctgtcccaacaaggctgggacaattccctctatggcaggtgcatcagcaatgaggtacccactggactgggccagtagattgtttctggggccagccttctgccctctccagaccagcagactacactctcccaactgctccaacccaagtcccggactcagccagacacaagatggcaatctggactgtgtaagaacccttcccacctgctccactcctcagatttggggctgtctgggctgaatcagagcctgtgaccactgaccctctgcctatgaccaagcccagaaagccagtgtaatggtggaccccaggcctagtgatgcctggccttcagagttccacactgggaagtgaattgggccactcagctatgtgggaaggggactgtcatctctatgggatgaaagcatgggtctgaaggtccagaagcagaatggcatgagagagtgtgtattgtgggacaagttgcctttggaatcctttggcagtgctatctgtctcagctgagccagatgtgaggaagagcctcagagaaggcctggtgccttgatgggtctgagttctgtactgggagctcctatgaggtctcggagtgtaaggcttgtgtctgtgctcatgcacaccagtgtacaagtctgtgtaaatgtcatgtgggttgaccgatggtcatcagactgctaggcactggagtcatctgatggctctgaattctgcattctgtgtcttcaagataagagacataggtatctagcccagaaaactagtctcaaggaggagagagggtcatggcaaaggtagacagacagaaattccagtgctttgacctgagatcctctccctgggcacaactgttcatcctggttgatctagagaagaaaatgacataagcctgacctccaatgggccatacctctgctgagcatcctctcatcagttttcctgtccatcttggtactgctgaccagatgggtcacacacaggtaatagcctggctcgtccagaagctgccaggcatgatcactgagctcctgaaggaagacagcttgaactataagacagatgtcgagtttcacataccagtgaacaaagctccagacttccaagacatgattgctggctcagggaagtagcccttgaccaaacaacccatgttgccatgggaaccaggaaagagatggacagggccatggctcttgctgcaaaggggggaagagatgtgaacatactgtccagcctggagaagtctttttctccatgcagccctgggtcttctaagatgggatctgctcctactcttcacgaacctagccagtttctgttttctctgaccccagcccctactcttagtctcaggaccttgcttttcacccccatccttacactgtaccccagccctgccagcatcgaatctggtcccaatgggttctttccttccaatctatagggttaactcccctgagcattcccactctcccctgttcctgtgaggccccaggatcagaattgtggaccacaaccccagaaataaaacccatggaatcccagcccccagagaccctccctgtgcacggcctccctcagtttagcaaagagttacttctggacccctgcctagcttctctctgcagccatatgacccactgcttataaacacagccagaagcgccagttccctttctcctctccacctggcttcactctgcactctgtactctcactccagacttcactttcctcctggagccacagacacttctgggctctagagagattgcatcagctggagagggaatggcagaggctgccaagtaggctggttagaggtcagacctgagagaaggtcttctccaaaaaggtggtcaggagaatggacataatcactcagccccaagcaatccaggaacactgggtgacagctagtctctacatcttcttctaagggtctcaagaggaccacttcacctacccctacaggaggtaacccagaccatgtctggactccccctggtctccccctaccccaaacactgaaaccaacagaagaaagaggaacctcaggaagtgtcccgtgtcacccagtttcgatcctgttcttagtctgtactgggttgggagaagtgtgatgttcacacctctggggcaaggactgtgaatcctggaaggatgagacagatctcagagctgggctgttagcagcccagcaccaatgcaaaaagagcagcagtcacaaggttccacacgtgaatgtagtcagcagagaagctggagaaagccacagcctagggagagcagtgagcttttccagacctaatagacggcagaacacaggaggatgaggagttgacagatcagccccaacagaggggcctgtctgttgcaaagaaaaggtgcctacctgcaacctggtgccaaccaggcagacaccagactttccacggacagaagccaagaccactaaagccgtgcccacctacagacaaccagagtaagcctcaaggagttaatgggatagacccggaaacctgagggtctagccaggcctagaggccggtggacccaggacagctgaaccaacagagaaaagaaaacccagtggagcaagggcagaggcatacagaattgagagagttggtaaagaggggatggggaacgttcacctgggaggactgatacacctattagaaagagctagagtcagagtggatgcccttgtgactcccggcattggatagcagatcccaagaacaaagctgaaagaaggtaaatttctcaagagaaagtcttccagaggaactatgggtaccaggcaataagtagtacatccgtaggagggaaccagacagtagtacatctgtaggaggggaccaggcagtacagctgcaggtagggaccaggcagtatatctgtaggagaggaccaggcagtatatctgtaggaggggaccaggcagtagtatacctgtaggaggggaccaggcagtatatctgtaggagaggaccaggcagtagtatatctgtaggagaggaccaggcagtatatctgtaggagaggaccaggcagtagtatatctgtaggaggggacaaggcagtacagctgcaggtaagctaaggacagtaagagtagtagagagccatgatgactccaaaagctcagaagacctggcagagcagctacagggaatccggggctggtggagttgggaggaccaagccaaagagctataggtaagccgaggctggtgaaggcacaaaaacaagctaaggagctacagagggggcaagggctgtggcaggtgtggctaagagaggtccagggcacccccaggaaccagaaagagctttacaggagttctagaggaggaaggagttggggagacaggctgggcatctgtaaagataaggtagcagttgtcacagtttgggtctcagagctgcccaggggattaggggaaaattctgagaagctgtgggagagtaggggatggtaggaatgtggaggaccagtcctagcagctgtggggaagctggggatggtaggaatgtgggggatcagtcctagcagttttggggggagctggggatggtaggaatgtgggggaccagacctagcaattttggggggagctggggatggtaggaatgttggggaccagtcctagcagctatgggaaagctggggatggtaggaatgtgggggaccagtcctagcagctatggggggagctgggatggtaggaatgtgggggaccagacctagcagtttttgagagctgggaatggtagcaatgtggggtccagtcctagcagctatggagtagctgtagatggtaggaatgtgggggaccagtcctagcagctgtggggaagctggggatggtaggaatgtgggggacaagacctagcagctatgggtgagctgtagatggtagaaatgtgggggaccagtcctagcagctgtggggaagctggggaatggtagaaatgtgtgggattgttcctagcagctatgggggagctggggatggtaggaatgtggaggaccagtcccagcagctatgtggggggctgtggatggtaggagtatgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggagtgtggaggaccagtcctctcagctgtggggaagctggggatggtaggaatgtggggggcctgttctagcagctatgggagagctgggaatggtaggaatgtgggggaccagtcctagcagctatgggagagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcccagctgtggggaagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcacagctgtggggaagctggggatggtaggaatgtggaggaccagtcctagcagctatgggtgagctggggatggtaggaatgtgggggaccagtcctagcagctatgggagagctagggatggtaggaatgtgggggaccagtcctaggagctatgggagagctggggatggtaggaatgtgggggaccagtcctagcagctatgggagagctggtaatggtaggaatgtgggggaccagtcctagcagctatgggagagctggggatgataggaatgtgggggacctgtcctagcagctatgggagagctggggatggtaggaatgtgggggaccagtcctagcagctatgggagagctggggatggtgggaatgtgggggaccagtcctagcagctgtgggggagctggggatgataggaatatgggggacctgtcctagcagctatgggagagctggggatggtaggaatgtggaagaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtgggaatgtgggggaccagtcctagcagctgtgggggagctggggatgataggaatatgggggacctgtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggaacgtggaggaccagtcctaggagctatgggagagctggggatggtaggaatgtgggggaccagtcctagcagctatgggagagctggtaatggtaggaatgtgggggaccagtcctagcagctatgggagagctggggatggtgggaatgtgggggaccagtcctagcagctgtgggggagctggggatgataggaatgtgggggacctgtcctagcagctaagggagagctggggatggtgggaatgtgggggaccagtcctcgcagctgtggggagctggggcaggtgggaatgtgagaaaacaatccttgagctatggaggagctggggatggcaaggatgaaaaggggcaaatcctagcagctagagggaagctggggcaggtgagggcgggtgtaaggaaccagacctagaaactatgggggaagtggagcaggtaaaaatgtgataaaccagttatgcagtccagaggctggtaggagtgtaagggagcagacatagtggctatggggaactgggatatatgggagtgtaagggaccagattcagtagctatggtggaacttgggagtgtagatgagcacgctgaaaagctatggtgcaactgcaacaggttgtcagggtgtaaagaaccagacccagcagccatgggaaacctggggaaagtagcgatgtgggggaccagatttggcacctataagggagctggggcatgtggacatatgaggggccagaagcagcagttatagggaaactttgaaatataggcaagtgtaccaagaagccgtagtggagctgaaacagatcctaggtcctatggaggagctgaagaaggtgggagtgtgagggaccaggccgagcatctgtggaagggctgaggcagggctctgggtcggatgggagtggcaccccagagaagccctagaagctctggcgatggagctgagcagttacagtggacttggggctggtgggatcgtaggagaccatgtagctgcagaagagctggagaaaacaggagtatgaaagacccagccaagtagccactgaagagctggggtgttattggggtgtgtggggacacagtcccagcaggtttatagaggttggagccttggcagtatgtgcagtaccaaacccagcagcttggttcaggggcttgagtagaggcaggctaatggggtccacggtaaccctaggcacttaggggactggattgcgaatcttcaggggagctggaacaggcaaagttaaaaggaatcaagcacctggaagaaagcaaggaaagataggattgatggggatccaagaaactcccaggaagtaaccccagcagggacatctgggagctcagttcagacactgaatcaaaagcacagaggaaggagaggtggtaggtttccaagctatcctgtccaggccaatggagcagccaggaaggagggaaggagaccaacaggaatggggcagctgtagccagcagggtgtgagagacagggatgaggctaggtggctagcaagaagggcaacttagtgggagaggggtgaattaaccaccctgacctcatgctgacaggggctgagcaacagacaaaagaataagaaagccaagagctcatggctggaactattctggctgtctgctctgactgtgttgaaggggctaagcacctgttagctaatgaggctaaaacagttaaatgagcaaagtagagcaaaaagctcccacagcggagagcatgggagaacgggagactgtgagatcctcggggggtctaggagtttatctcagagtgaagaacagtgaaaagctctgcttgggagttctttggggaatggcgatcatcctgggaactcccttatagacctcatggcatggaggagagcaggagctcaggcagacagagtagctgtgtgtgagctggataagaaagaaaagagacaacagggagagaagagaaaagggatgggaaaggactcagggctctactgaattcaggcagaagagcttggcttcaggatgctgggggccaaggaaggtgtctgattgagcaggaacatagtcaggaaaagaccctggtgctcacattcccagacaaatcttacaggttaaagttctagtatcagaacccctcgctcagatcctaggggcttatgggaacataaggcaggaagtgaaacctcttaggacagcacgaagtagcctgtgttggcccacagaagaagagcaaggtaactctcagagtttgagcaggggattgaggaaggtagtgtacaggagaggcagaaagaccagaaaggtccccagagtaagaatgaatcaagaatttatgtgtggtttggttcgatgaaggcaaaggcagggaagatagatgagaaactgatcctctttcacaaccaagaactcattgttcagtgtgagttttgatatatagaaggggggggaatgtgctattaaaagtaaaaaagaatgaaccagattcaaaagggaaaggggactaaatgtcttcctgaataatgcagcatacattcctatttcaagagctaccggcaagagaaagggacacttctgggatgtgcccagtaacattagcactgtcagagagaacccagggcagtgcgaagggtgaggtgggggaggaaggtgtctgcactcatcagcgtctcatcagggggcactgagctgtgtagaacaagagtggccagctaggtcaagacagaaaggatgcccacacacagaaggtgtagggtagagggttggtagtaatccccaggaagcagggagcaaggtccaaggagagctaaagtcacggatagagacctagggcacagatttaggagccagagtttgtgtaatgttagtagattcagtaggggcttctgaagggcctcatcactgaaagatcaaggctcctagggctggagagttggctcagtggttgctgctcttccagaggacccaagtccagttcccaacaaccacatggcatcttacaactatctgtaagaaactccagtttctcgagattcaataccctcttctaacagcacaggcatcaggcacacacatagtacacatagtcatacatctaaaataaaatacctaaaaaaaaattaaggtcagagtgcagggtctagaagtggaagctgctgacaccacttaccccagagcaacttgagaagacacagtctttttagagcaaagctaaggccagagcctctccaaatatctgaggccacgcatgttggaaaagctcacactccctcctctcttgcagcccaaacaacagccccatctgtctatccactggctcctggatgtggtgatacaaccagctccacggtgactctgggatgcctggtcaagggctatttccctgagccagtcaccgtgacctggaactctggagccctgtccagcgatgtgcacacctttccagctgtcctgcagtctgggctctacactctcaccagctcagtgacctccagcacctggcccagccagaccgtcacctgcaacgtagcccacccggccagcagcaccaaggtggacaagaaagttggtgagaggacaaccaggggacgaggggctcactagacgtgaggataaggcattagattgcctacaccaaccagggtgggcagacatcaccagggagggggcctcagcccgggagacactgtctctgcctccctcctggaggcctcctggaggcctctgcctatggccacccaccccctaagacatgatcctctggtatagatgtctgtgtcatgcataggatcataccagggacaaactttcctctctggtttggtgccttctctccttgaaaacccagtaacatccagtcttctctctacagagcgcagaaatggcggcattggacacaaatgccctacatgccctacatgtcacaaatgcccaggtaagtcactagacctggaccccagctccacaatgatggcaagagctgtaagcatcccagcactgcaggataagccacgtactgacccatttctatctctcctcatcagttcctgaactcttgggtggaccatctgtcttcatcttcccgccaaagcccaaggacatcctcttgatctcccagaacgccaaggtcacgtgtgtggtggtggatgtgagcgaggaggagccggacgtccagttcagctggtttgtgaacaacgtagaagtacacacagctcagacacaaccccgtgaggagcagtacaacagcaccttcagagtggtcagtgccctccccatccagcaccaggactggatgagcggcaaggagttcaaatgcaaggtcaacaacaaagccctcccaagccccatcgagaaaaccatctcaaaacccaaaggtgagagctgcaggccgactgcctggggactgggataggtataagaatgaatgcccgtgtggacggccatgacctctgtgtctgtttctatccccacagggctagtcagaaaaccacaggtatacgtcatgggtccaccgacagagcagttgactgagcaaacggtcagtttgacctgcttgacctcaggcttcctccctaacgacatcggtgtggagtggaccagcaacgggcatatagaaaagaactacaagaacaccgagccagtgatggactctgacggttctttcttcatgtacagcaagctcaatgtggaaaggagcaggtgggatagcagagcgcccttcgtctgctccgtggtccacgagggtctgcacaatcaccacgtggagaagagcatctcccggcctccgggtaaatgagcacggcacccagaaagctctcaggtcctaagggacactgacacccatctccacccttcccttgtgtaaataaagcacccagcactgccctgggaccctgcaaaactgtcctggttctttccggggtatagagcctaggtcacgggctttaaggtctggctggggtttaaggccagagttgtcttcaggaagagagtgaggtttccacactgccagactcagagctcatgagtcatcagggcctggagtgttggggcttagctttaggaagtgcctattccttgacttcaaactaaccagcagctgccagacggagagatacacctaggaaacctccaagggaagaaacacacaaactccaccaccctctgcctgttcctatccccatgtcccactcctctgcctatgggtttctctgagtctattgcacacatggccatgggcgtgccagagacccttgctatccctacactcaactaaacccaggcagcttttcatgggctaggtctgcacacccatacagactgcccactcatgcctgtgccacgtgagactgaggcagatggctcttgccgcccaaagggagggtctgttagccacatgcatactgaatcctgacccattcaaatcagcctgccgaacatcatccagtccgtatagcacatgtatccacgtgcacatgtgcacacacatttaacacaccaggactccgcctgtgtgccctgcacagcacctacacccagcagtgtatcaggatacccacaaccaccacttgagtgcccacgtttctgccatcacaaccagacacacctttccccttctaaggtcactgcattctaggctcagcacaagtcctctgaagccagatccgtctctggtacctcagggtcacgcttcaaccccacatgaattatacaacccagagccataatggtctgagtcacttcacactctggaattttctcaagttcaggcaagaccaggcacaggctccgctggtgattgagggacaggtaaagggtcagaccagctgtatagccactgtccactggggtcacaggccctgctgacccttcaccttctcctgtactgcaaacagagagggcccttgcacaatccaggccgccatgaggtccactgtgtctggcaaaccccaaggccttatccaactcagccggagggaacttagactgatgtcccagagggaaaagaaaggaaagtagggagtagaaagtctcccagggagactctgctggcccagcccaaatggagctttctcctctgccacatggggaattgctcccagccccccactttattgggacaaattctgactgccctctctgtccagggctagaagtggatgatgattgtgctgaggctcaggacggggagctggacgggctctggacgaccatcaccatcttcatcagcctcttcctgctcagtgtgtgctacagtgcctccatcacactcttcaaggtcagccacaccatcccccaccatctgctgtgatgcctgtgtcaaccctgcgatgtcctcacactcctctcctgacgtagtaggatgttcccttgctgtccccactctgccccacacaccattcccaccgttccctgagccgtcccacattgctctgtgtggctacccatggcgtccatactgtctgacattctatctctcttgctgtcctatgtgatctccatactgtcttacgaaacctccttgcatgccacactacccttcatgacgtccctgctatctaccatgctacccctctgggtgtccccatcagcctcaccatgtattctttgagctatcctcataccatctcaacctcaactcccacgatgtctccacaccggctcctagtctatgtcaccctgaccccttgccatccccagtctcctgcctgtatgaaaggaactgcaggagggacgggcctctgtcttgcccacagggctgaagggcctaagcatgggtgtgttctctgacttactcccacctccccacaggtaaagtggatcttctcctcagtggtggagctgaagcagacaatctcccctgactacagaaacatgattggtcaaggagcctaggccacttcctctgggatgagcttcctgggccccgcacaaccccatccatcctactgtgcagcctaatgtggaggccacactgccgtctgacagtgccaccctctagccctgtgactctgatccagaactctagactgtcttccttttggaggatcatgtggacaatgagctataccccagacccaaacagcacctccacagcagttgccaggaaactaactggttgggaccagaagaaccatctctaggatgtttgcctcagaggagctgggagtccacggtgcctgagtcgagctccatgggaatcagccgtgtctgaaatgggtcttcccagaaagagcaatgttttcagatccttgaaaggaaacatctgctaggaagaccatggtcgccacagccccaaagagtcacttcactctggtagcctttgaaccagttatatctggacaccttctttcccggtacttctgtgaaccctgggctgagtaaggggtttatgtttctcaaactgttgggatgagcctccccgagatgaagctccttgtgcagtcttctcttcccgaaacccactcaacatgctggactcttgggttcaggatccgatccgaagacaccattgacgacgcaacctcaagacaaggccactgtcacctccatagagactccatccacactctgcagggacaggaggactgctttgtgtaacctccgcaaagccctagcagggacaagtgcacagaccactgagtattggtgaggtgaccaggcaggaaaacctccaggagagggccctgatgagaagattcatattgggctcaaaaaatgggatggggggaggggggcgggtgggaaagaacagtgggcagggtgtgaacagatgattagaagacagtcacagtgccgcagatctgccctgcaggcctgctttccagactggaccacttacagcagaaaacaacagttacagtaagcatctaggagagtggacctggaataccagggctgctgtggccagtggagagtagccctgcatctacttctccattacctctcatggccaataagaagccagagcatccaggcagaaagaaagagtgtgcgtttctgtgactggtaggaaatgcttagagaacttggatctttaaaacagcttttttctagactgtgaatgtctttaagcactctctttcctctccattccctccctctctctttctctctctctctctctctctctctctctctctctctctctctctctctctgtgtgtgtgtgtgtgtgtgtgtgtgtgtgtgtgtgtgtgtgtgcactcacacacactgttgttttggcattttaaacaataaaacattcttttaacattttgtatctcatggtgtcccttcttaatggattagccctaacaccaaggaacagggcacagttaacagatcaattagccatgcacatccctcctgaccctgtcctcccagggttccctcagtgggtccctcatggctgggttccagccctaccagagccacaaaaagcttgggcatattcctccacacacacagcttttttccccagctggagactgctctgctgccatgggcaggctgtggagcagggctgatgcccagggtagaccctaggctagccagacaaaggtcccatgacagcagagaagcatgtgcctctcactggccttgggctgctacagagtcagcaaaggacatggatccagctacctccacagctggtgctcattgtctcaagccatgtccagagaagttccagatcaggcattgacagggtggagagctctctccttggttggtaggtgtcttctcctccatgtgacctcagagccccccccctttctgtgtgtgtgtgtgtatgtgtgtgtgtgcgcgcgcgcgcgcgcgcgtcctagcctcttctcataagtgcacagtcaggccggaagaggtgcatcctagccctaatcataacttaccagtttatgatcctgtctgcaaacataggcatagtctgaggtcctggtgatttaaatgtcaattggtgagtcttctggggcttcctacatacaatgccccttccccatgccaacatcccaaagtctcacccatccagcattcagctctatcccaagtcacctccaaaggcctgctagtcaagtaaggatcagatcgtgtggggttcgtcctgagataggattcagccatggtttccaggaggaaggggcaggagagaggcacaggggagagacgtataccgtgatgaactggacagactgataatgtgctgtccagaagaaagctgagggcaaacaggggcccctcccacttacactgaggtgacagttcctaagggagagtgagggatttgtagagagaagtggaggttccacagagttggagaagcaaaagattactagaggtagcctggtgtttgcaatgtctgttttctgttatggttgacatcaggattccatgctactctgtagatcaagggatacaggttccacatctttgtgtggcactgtggtggaggggcttgggcccagatactcccgggacatggaaaatacagacatcggcaggggaagaaatgggatgattcacaaccaaaggcctcctcatccgatgcttactgatctccgagagcaggagtcgggtgctggctgggcagttatcatctcccagtatttcccaggtggcatttagtagctgagacatcttcagattgtggccttggctgttagacactctatctgtttgggtctgtgtaggtgatggtggaggctgaatgaaggactggacaagggacaaaaggatcaggtcaacaaagctgcagcagagacaggagccaacctgaccaacaccactgtggcttccatgggacagttctgttttagccaggacagaagggaacagagctgcgtgaatggcattactcctatgggagtcacacagacaggctaatcacccagacaacaccaactggccagtgagaccagtgagatcctgcccacgcttcctcttaggtctggctctgtttctctagttgtcttccctggagcaaatgttgggaattgagcccatatcctctgcaagaccagtaaatgttaactactgaggcatttctccagccctgcctcaacctcttactggaagatggtcccaaaccaaaactgacggcatggtctcagaaagtacagattcgccacctccaaacccttctctcatgtctgtctgtctgtctgtctgtctgtatgtatgtatgtatgtatggccctgcaccatcacccaccacctcctggtgtcctgcagcaggggcttcccacagcaggacgtaccatagctcccaccccttacacctccatcagcactataaacatatagacacaagtgccataaccctggacacaccttctgaccccgcccccatctctgagaccaactgatctcaggctgtgttttactgaatgtgtccattcggtaaaagctatctgagtcctgccctcctgacctctatagtgtgacatccatggtgtgtgtcctgtgtcataacacgtaggtatgtcataccgtgtgttaccacatatgatatgtgtgtgaaacatccccacatgatgcctgtggtggacatgtatatatatatcttttatgacttctataggggacatcaattgcagaatacctgtgctagccagtagccatgactgaccagacagctactgacacttgacccacttgcattctgtcacagtctgggaatcataacatgacacaaacgccgattgtagcaccaggtcatgggcctgcatgagacttgacatgtgtacacacatgacatgtgtacacacaaaccacacgaaaaagtgtctcggaaaacacacacagacacatccacatgagcatcatagtgtggtcacagacatgtccacatgggcatcacagtgtggtatcatgtagtagccacagcatacatgacacagtcacacaagttcttacaagaacatacatgtctgccagttcccagaactcctggcctcaggctcagcactggccaccctggcccagcacacttcccatgcttcaagctttgcacacacagatccactgtattcccttcctgtgtttaccccattaccttcagcacaccacccacctctcttccatgactgcccccatcccacctagcacggcgccccactactgtgctagctttgttcactcagtgaccatgtgtgtccatcttccagtgaagcttgagctctggggacaagaacgtccctccagattcatgttcctgcagttctatccaactgttcagcatctgtgatgaagtcacaccaagtccctcaccccctaactagtcttctaatctggcatagttatgtgctgggaactaagtagatggtcaaagtaggatatgatgctggccaatggtgcagaccagtaggtccatgtgctgacccttcaactctaaagtcttccccacgcctaccatgtagccataagatctttcccccaaggcagggtacagacaccacatagaggaagaagaccaagtggatgggccccccatagcaggtatgggagagtcaggctgacatagcaagtgtgggagagtcaggctgccatagcaagtgtgggagagtcaggctgccatagcaagtgtgggagagtcaggctgacatagcaagtgtgggagagtcaggctgacatagcaagtgtgggagagtcaggctgccatagcaagtgtgggagagtcaggctgacatagcaagtgtgggagagtcaggctgacatagcaagtgtgggagagtcaggctgacatagcaagtgtgggagagtcaggctgccgggcacaaaggatatgctggacttagggaagccatcctccctgttttctgcccaagcacatatgtatcctactatcagctctctcattgttcactccatactcaagcatctgcccataggaggaagacctcagcctcaagtcaggatgtacatgagagcagccacagagtgagtccatatagttctgttcttttgccccaaaatgtcatgttccagaactacttgttcctttgacctagaccccagaaaagagaccagacactatagtagacacggaagtaagaacaacacagtgctgttgtttctctgctggcaaaggttgttgccacacttatccctggcaaagatataaaacagatgtcatcaaaatgccagtcctggttgtaaatacatatttagaaatgtctgtgtgtgtgtgtgtgtgtgtgtgtgtgtgtgtgtgtgtgtgtgtgtgtgtgtggagacaacaggtaaaaaaataaagacgatgttagagggaggaaattaaagttggaaatgatataatcatatttttattggataatttatatttacatttcaaatgttattccttttccaggtttctcgtccataagccccctgtcccatctccctcccccttcttctataagggtgttccccctctccaaccacaccccattcccgcctccctgccctgacatttccctgcattggggtgggggggatggggttccagccttggcaggaccaaggacttctcctcccattggtacccaacaaggccatcctctgctacacatgcagctggagccatgggtctgttcatatgtacactttgggtagtggtttagtccctgggagctctggttggttagtattgtttgttcttatggggttgcaaaacccttcagctccttcaatcctttctctaactcttccaacagggaccccatgctcagttcaatggtttgctgctaacatccgcctctgtatttgacacactctggctaagcctctcaggagacggctatatcaggctcctgtcaacatgcacttattagcttaatcaataatgtctagttatggtgggtgtatatatatggactggatccccaggtggggcaggctctgaatgtccattccttcagtctctactcagaaatttgtctcaatatctcctcctgtgcatatttttgttcccccttttaagaaggactgaagcatctgcaccttggtcgtcattcttcttgagcttcatgtggtctgtggattgtatcttgggtacttcaagcttctgggctaatttccacttatcaatgagtgcataccatgtgtgtgtttctgtgattgggttaccacactcaggatgatattttctacttccatccatttgcctacagatttcatgaagttattgtttttgatagctaagcattcattgtatagatgtaccacattttctgtatccattcctctgttgaagggcatctgggttctttccagcttctggctattataaataaggctgcaatgaacatagtggagcacgtgtccttgttatatgtcggggcatcttttgggtatatgcccaagagaagtatatctgggtcctcaggtagttcaatgtccaattttctgaggaacctccagactgatttccagagtgtttgtaccagcttgcaatcccaccaacaatggaggagtgttcctctttctccacatcctcgccagcatctgctgtcacctgagttttttttttttttttttagagagacatggaagaagattgtttgttggtctatatttatggcttgctcagcctgtggttttgttttttattaacttgagtatttcttatatacatttcgagtgttattccctttcccagtttccgggcaaacattcccctcccccctctccttccttatgggtgttcccctccccatcctccccccattgccgccctccccccaacagtctagttcactgggggttcaatcttagcaggacccagggcttccccttccactggtgctcttactaggatattcattgctacctatgaggtcagagtccagggtcagtccatgtatagtctttaggtagtggcttagtccctggaagctctggttgcttgacattgttgtacttttggggtctcgagccccttcaagctcttccagttctttctctgattccttcaacgggggtcctattctcagttcagtggtttgctgctggcattcgcctctgtatttgctctattctggctgtgtctctcaggagcgatctacatccagctcctgtcggcctgcacttctttgcttcatccatcttgtctaattggatggctgtatatgtatgggccatatgtggggcaggctctgaatgggtgttccttctgtgtctgttttaatctttgcctctctcttccctgccaagggtattcttgttccccttttaaagaaggagtgaagcattcacattttgatcatccgtcttgagtttcatttgttctaggcatctagggtaattcaagcatttgggctaatagccacttatcaatgagtgcataccatgtgtgcttttctgtgattgggttacctcactcagtcacctgagtttttgatcttagctattctgactggtgtgaggtggaatctctgggttgttttgatttgcatttccctgatgactaaggatgttgagcatttctttgggtacttctgagccattcgatattcctcagctgagaattctttgattacctttgtaccccattttaataggattatttgactctctggagtctaatttcttcagttctttgtatatattggaaattagccctctatcagatgtatgattgataaaaaatcttttccgatctgttggttgccattttgtcctaatgacagtgtcctttgtcttacagaagctttgcagttttatgaggtcccatttgtcgattcttgatcttacaacataagccattggtgttttgttcaggaaattttccccagttcccatgtgttcgagggttcttcccactttttcttctattagtttgaatatatatgattgcatgtggaggtccttgatccacttggacttaagctttgtacatggtgataaaaatggatcaatttgcattcttctacatgctgacctccagttaaaccagcgccatttgttgaaaatgctaatttttgtccattgaatgattttagatcctttgtcaaagatcaagtgaccatacttgtgtgggttcatttctgggtactcaattctattccattgatcttcctgcctatctctgtacgaatatcacacagtttttatcactattgctctgtagtactgcttgaggtcatggatggtgattcccccagaagttcttttatggttgaggatagttttcgccatcctggattttttgttattccaaatgaatttgcaaattgctctttctaactctatgaaaaattgagttggaattttgatggggattccattgaatctgtagattgctttaggcaaaatggccatttttactatattaatccagcctatccatgagcatgggtgatctttccatcttctgagatcttcctcaatttctttcttcagaaactcgaagttcttatcatacagatctttcacttgcttggttaaagtcacaccaaggtattttatggtatatgtgactattgtgtcataatttctttctcagtcttttatccttggagtagaggaaggttactgattggtttgagttaattttatacccagccactttgctgaagttgtttgtcaggttaagtagtctcttgtggaacttttcgggtcacttaactatatactatcttatcacctgcaaatagaggtattttgacttcttcctttccaatttgtatctatttgacctccttttgttgtctgatttctctgggtaggactttgaatgctatattgaataagtaggaaaagagtaggcagccttgtctagttcaattttagtgggattattcaagtttctctcgatttagtttaatgttggctactggcttgctgtatattacttttacattttatattactttttttatgtttaggtataggctttgaattattgatctgtccatgacttttatcatgaaggggtgttgaattttgacaaatgctttctctgcatctaatgaaatgatcatgtggtttctatctttgagtttgtttatatagtggatcacgttgatggttttctgtatattaaaccatccctgcaaccctgggatgaagcctacttgatcatgatggatgattgttttgatgtattcttagatttggtttgtgagaattttattgagtatttttacgtccatattcgtaagggaagttggtctgaagttctctttctttgtcgagtcttgatgtggattaggtataagcataattgtggcttaatacaaggaattgggtagtgctccttctgtttctattttctggaatagtttgggcatagtttagtatgaggtcttctataaaggtctgatagaattctgaactaaacccatcctctcctgggcttttttttttttttagttggagacttttaataactgctcctatttctttagaagttatggtactgtttagatggtttatctgaccctgatttaactttggtacctggtatccatctagaaaattgtacatttcctccagattttccagttttgttgaacttaagtttttgtaatagaatctgatgatttttttaatttcctcggattctgttatttctcccttttcagttctgactttgttaatttggatacgttatctgtgccctctgattagtctggctgaggatttatctatcttgttgcttttctcaaagaagcagctcctggttctttgtatagtcctttttgttactacctggttgatttcagccctgagtttgaagggctcttcaaactcctctactcctcttgggtgtatttgcttctttttgttctagagcttttaggtgtgctgtcaacctactaatgtatgctctcccctgtttctttttggaggcactcagagctatgagttttcctcttagcactgctttcatttgtgttccataagtttgggtatgttgggccttcattttcactaaattctaaaaagtctttaatttctttctttatttcttccttgaccaagttatcattgagtagagcgttgttcaacttccatgtatatgtgggctttctgttgtttttgttgttattgaagaccagccttagtccatggtgatctgataggatgcatgggattactgcaatcttcttgtatctgttgaggcctgttttgtgacagattatatggtcaattttggagaagctaccatgaggtgctgagaagaaggtatattcttttgttttaggataaaatgttctataaatatctgttaaatccatttggttcataacttgttagtttctctatgtctctgtttggtttctgtttccattatctgtccattgatgagagtgggatgttgaaatctcctactattattgtgtgaggcgcaatgtgtgctttgggttttagtaaggcttcttttatgaatgtaagtacctttgcatttggagcatagatattcaggattgagagttcatcttggtggatttttcctttgatggatgtgaagtgtcctttcttatcttttttgatcacttttggttgaaagtcgattttattcaatattagaatggttactccagcttgcttcttcagaccatttgaggtagtgtctgtctttgtctctgaggtgtgttttctgtatgcagcaaaatgctgggtcctctttacatgtccagtctgttactctatgtctttttattgggaaattgagttcattgatgttaagagatattaaggaatagtgattgttctttcctgtttatatttgttagaggtagaattgtatttgtggggctttcttcttttgggtttgttgcaagaagattactttcttgctttttctagggcataatttcctttattgtgttggagttttccatgtattatcctttttaggactgtgtttgtggaaagatattgtgtaaatttggttttctcacggaatatcttggtttctctatctatgttaattgagagttttgctggatatagtagcctggcctggcatttgtgttctcttagggtctgtatgatatctgcccaggatcttctggcttttcatagtctctggtaagaagtctgctataattatgataggtcttcctttgtatgttacttgaccttttttccttactgcttttaatattctttctttgttttgtgcatttggtgttttgacttttatgtgatggaaggaatttcttttctagttcaatctatttggagttctgtaggcttcttatatgtttatgggcatctctttctttaggttagggaaattttcttctataatttttgttgaagatatttactggccctttaagttgagagtcctcactctcttctatacctattatccttaggcttgatcttctcattgtgtcctagatttcctggatgttttaggttaggaactttctgcattttacattatctttgatggttgttttctatggtatcttctgccctgagattctctcttctatttattgtattctgttggggattctttgcatctatgactcctgatctcttccctaggttttctatctccagggttgtctccctttgtgatttctttattgtttctgtttccgtttttagatcctggatggttttgttcaattccttcacctgtttgattgtgttttcctgtaattctttaaggggtttttgtattttctctttacaggcttctacttgtgtttcctctttaagggcttctacttgtttatctatgttgtcctgtatttctttaaggaagttacttatgtccttcttaaagtcctctatcaccatcatgagatgtgatttttaaatccaaatcttgcttttcctgtgtgtttggatccagtatttgctttggtgtgagaactgggctctaatgatgccaagtgtccttagtttctctttcttaggtgctgcgcttgcctcttgccatcaggttgtctctggtgttagattgtcttgctgtctctgacactggcttgaccctcctgtaagcctgtgtgtcagcactcctgtagacctgttttctttcagctggatctgggaacagagagctgctcctgggtttgtgtgtcctgaggccaccaggcaggtcgcttggagcagaagtgttggtcttacctctgctctcaggtgtgtcagcacttctggcaactggctttcagctctggacacaggcagaaaccagaagatttctgcccctgactgctcctagcttcctatgtccagagggcacagagggcactaggtgggttcctcttggtccatgaatgtcagcagaagtagttgtctcctctgagctctcaggactgtccacacttttgagagtccatctctctcccccacaggatttgggaacagagagctgtgggagcggttcagctccgggtgcaggtagaaaccaaaagtatcctgtactagacttctactgcctttattgatataaccatattttaatcccaaaagcaaaaataaatgctttatttctggtcttgagctaagggtatagttcaattgttagagtacttgtctgtaatgcaggagccctggatctgatctccattacagaataaaccaaatgtggtaatgcatgcctgcaatcccaaatcccaaatctccaaaggcgtacacaggaggatgagactttcgaagtcattcttgtctacatagcaaattagagaccaaccttatctttaaaaatagtaataatcctgatcttccacttgaagtaaatgtatccagtaactgtacctgataccattctatgttagattttgtttcagggtttcgaagataagttctccagagaagcacaagtagtgggagatggcggagagagggctggtagatgaacccataaacaacaaacaacagagctggaggacaattaggatgatatgtagttagaaacagagggacagcatataagagacaacagggagataacacataagagacaacacagggataacacacaaaagacagaagagagataatacataagagacaacagagggacagcgcataagagacaacagggagataacacgtaagagacaacagagggataacacataaagacttagagttttatggttcgccttgactagattaaggaatgaatgcctgtggaggtgtctatgaaggactttccagaagtgttaggtcttagggggctctgacttagccctttggtggagtgagaatgtggtggcattatagaaaaatgctgaacagtaagaagtccaggtggaggaagcagattactgggggtgtgcatgggccattacatctgaccctggacactacattccctttatctctacttcccatcagtcaagaaataaatagcctcttccacacaaccccactgtcattatggccctaagcacataagccccccaccctttaagtttctttgaggtatctggtcatcctggctcccagctccaagtcacccaaagggttcatataggcaagcatttccacctctaccgtgttccatcacaaaccactggctatttgagaaatttcagacagctaaagaatggttctcttagcactgatggccttgcattcaagagacttgcctgctggtttgcaaacctagaggctatggcactgaacttggacacccggtggcgtgctgcttttggcatagagaaagctgacatccagcagctaagtgactgctcctgagctttggaactcgttctcctgtatcaccctctacatccaactcttctcagcttgtcttctcaatatttccactgtccctcatcaccttagattcttgtagacgctgccctcaatggcttactggctcctcaactacttcctgccactgtcgccctcagggctggaaacctggagccttgtctgctcttggcacagccacacagcttactctacccatgacaaataaggagacttggagaccatttggggaaagcctttatcagggcctaatgggtgcacacttggatcaggagtcatccattggagagaagcctcaaggaatagtggggaacatactgtatctagagacagtatagggtcatgatggcgtggattatactccccacaaagacagccctgcatgtgctctgcttccagtctcaccaatcacaaccctcccgtatgaacccatcacagcccttgcacagattgcaggtctcaaatatgttcacctttctttctgacataaccaggattttttttaatttgcttgcgtgtttattatttctatttattttattcattttttatttattattttacatcccactcactacccctctccccatcatcccctcccaagatccttcccccatcccctctccctttcacctctgagccagtggtgccccctccgtgtatctcccaaccctaataatcaggtggtttgagccaccagggaagatgctcttcttcctttctgaccttgagagctgctattccaaggtcctctggagctgtgtgtgtgaagtcacctggaggtcataggtggagtggagttttaaggccatggtagaggctggagccatagtagttggaacaaggctgtggtttcagcagcagccatgattgttgtatactttgcagctcaaatatggtctcctcagggctctgtgaggtattcaaagcacctagaatcccatgatgacacttccaccagtctctaaaagagacctaagactactagatatagaaaaaggccaacttaagtacatcaaaaggtcaagccttctggcccctaatggctcattttacatgaagaaaaggtgaccattacactatgcccaataaagacatgttacatttacactacggtccttggcatcccttagcagatgatcctagggagagctgagcaatctcgtccatctcacctccacccagtcaccaaaataacactgttctaaggcacacttctgagacttacagagctactagagagttgggggtagcagtaagacctttccctggccctcaagatacgttcacacccacatcacatatatgagttcgcatacactaacacacacagcacatcttggacatggcccattcaggaacagatctgtcatgatcgcttgagttaaggaaccactcaagggaatgactaaaggaggatcccactggagtcctggcccacaggaggaggtggaataaaggttaggtagggcaagacaagggcactaaagccactatgctgctggggccactgtggacactgatggccagaaatggaatgatcagcctgtaggcaggaggggggagggaggatgattcctgaaaaccagaagagtcaccgtggagtctgaaccaggaaggagagagagctcccagtgtaaccctaaggcttaagtagttgcaactgcctcctctccttccagaggaccacccactgccacctagcatagcactctgaggactcagaaccagcagcccagcataagctgagtgtcaaagaagaatcaggcccaagcaggctggacacaaagtttcttggtcctcaggctatgagggagatggagtccttcccactattcggggcacaccacagacagcagcacctgatccagttggagcaaaggctcctcacccctgtgttttccctcagaaccacaagtctttccaggaaactctgtatttacccctcagattcccacccaggtctgttaggctaaaggccaagcctgtcacctcagactatctgaaagagataaaaccaggcaagacccccaattccctcagatctcacaccccgtgttcccaaagtccctaactaactttcctggggccagcccggggcctacctggttcttccactgtcagttagctctctgatgtcttccaaatacaattaaacacccttctgtgggaagtcagacttggcaaagcctaagtcccccagtcccttgcatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagctgctgggcccacacaccatctttaccctctccccttccctcagtgcagacgtagaccacaggcctggaagagacgttagctgtttctatggtgttccatgagacccagttactccccagatgtgctctgtccttgccagagtagcaagtagaggaccccaagccgaagggcggccacttgtgagtgattaccagggaagcccactgtctctagcatgccagctccaaagctgagacaggaaccagggggcctctatcagaggccctgcgtgtcatatcgtgcccacaggctgttcctctttgtgtatcgttaataacttacaacgtgactgccacactgccccgaaggactgccaagggaacagaaaaggcaatggcttgagtccagtcccttttcagggcagtagcactccaaaggggcaggcatcgtgactgcaggaacatgcaagtttctaacgtgagagctgtgcagaacaccagacaacgaaaagtgccctgaccagagcgtgcaggtgtgtctcctagaaagaggcctcacctgagacgccactgtcccttagtcaacttcccaagaacagaataaaaaagggaacttccaaggctgctaaggccgggggttcccaccccacttttagctgagggcactgaggcagagcggcccctaggtactaccatctgggcacgaatgcaataatggttactaaagattcacaacgtctgggagcctgcacagggacaggagatggctgcagatgagaagagcctggctagccacagccacttaccagcggacctcaggtatcatagcctgtgggaccctgagccaaagggtttgcccaaggagaatgggcaaacaggttacagggtcctggatggggaagggggcacctgggctgccttctaacaaggacagagtctcttggtcattgcctgtccttcagctgtcactcctctgcattaaggcacacagttattagacactactaccgctatccacaaagacaggggactgtggatctcaaccagacatggctgaaccaagagaaactgaagatgtcgtgagaagctcagaaaacgccaggagaagctgaataggaatctgcctgcaaaccatcagggcaaggaggcaataacaagtgacagagccaacgagtgacagcaaggaattgccctgtgatgaactaacaacaaagctgggctgacctgggctaagctaggagtgggatctgtgctgcactgggctggaaggagccgggatgagccaagcaaagtgggttggactgagttgaattggcctggactagtttgtgttgggctgggctggcctggaataggtaggctaaaccagcttaaactagggtaggctgggcttaactgaatcagactaggctagactaagcagaactgggctgggttgaactgggctacactagcctggtctgatctaggataggctgggctaagctgagctggactggctggactgggctgagctaagttgcactggacagagctgggctggagtggactggactgggttggattgggctggactgggctgggctaggctgagctaaattgcactggacagagctgggctagagtggactggacagagctgggctagagtggactggactgggctgggctgggctgggctgggctgggctgggctgggctgggctgggctgagctgggctgggctgggctgggctggactgggctgggctggactgggctggactgggctggactgggctgggctgggctgggctgggctgggctgggctgggctgggctgggctgggctgggctgggctgggctcagcaggcctaagtaggcctagctgggtttagctaggtttggctaggtaaggctgagctagattggactggactgaaccaggtggggtatattcagctgacattgtttggtctggtctggactgaactggactgagccgggctagcctaagctagatggggggtatactcagctgagatgggctggtctggctagattgaactggactggactaggctgagccaggctgacctgagatgtcctgatctgggctgaactgggcagggctggtctcagctggactacactgagttaacctgggctgaaccagactgggctaaactaggttgtactggctggattagacttggctaaactgggcttggctaaactgagtcaggatggtctaggttgatttttagttgggctaaactaagctgaactacactgaactaggcaagactgggctggaaaggtctgagttaaattaggagggacttggctgggctgggctgggctgggccaggctgggctgagctgggccaggctgggctgagctgggctgagctgggctgagctggattgagccgggctgaactggactgagctgggatgagctggactgagctggactgggttgagctgaacaaaactaaactggaatgggctaaattggcctaaaattggctaggctaagctaagtaaggctgccctgagctgagaaggactggattggcctggactgagtttggatgagcatcattggactatgctaagctaacttgggtgaagtgggctaagcaggactaatctggcctgatctgagctagaccaagctaggccaagctcagctaagtttagcttagctgaattaggctgggctggactgtattgagctacactaaatttaacaggctgagctgagctgagctgagctgagctgagctgagctgagctgagctaagctgagctggttttgtctaaggtggattgacctgggctggactgaactcaattggactacactgaacttatctggacctcactgagctgtgctgcactgggccaaccctggatcactctagatctagcttagctggactgggctgagctagattgggtggactgatctaggctgaactagactattcttgcctgaggaaggctgggctatgctgagttgaactaaactgaactcagctaaggaaggctaagctagactgagctgagctacgttgggttgggctaaactgggctgagctatctcgggtagactaggctgagctagactaaattgggctgagctggagttggttggactggactgggttgggctaagctgagctgatttggtgtaatctgggatcaggtggcttgagctggactggactgtctgagctaaactgggttgagtggagctgagtgggtctgagtgaggctaggctggaatgagctaggctaaactgggctgaactggtttaggttgaatttagctgagatgagctgggctagacttctataagatggctgaactctgctagggtgaactgagctgtgctgagctgaacttggattaactataattagttgagctgggctgaactaggctgagtttagctggaataagagtcaactgggcccaactgagctaggctaagctaggctgaactgggatgagctagaattactgttctagtctgatctggactaaggtagactgggctggggttgagctctgttgggctaagcaaagttgagctatgagatgaactaggctgaattgggtacttctagatcattccaggctgttctgggttgacctgaactgggtgggattgagctaagtggggtaggctatgctgagctctgccaggctgcatgagtttattgatctgaactgggacaggctggaatggactggcctgagctacaccaactgggctaagctgggataggtcaggctaggaggagtcaagctggactaggccaaactattataggtcttttggtctagttgaactttctggtgcttaactgaactgtgtttaagatcgattgctcaaaccagagggaggagaagcccttggccctgccaaggctggaccccacacacacaccagtgtaggggaatgtcaggacagagaggtggaaaggggtgggtggttgggtgggggaaaagtgataacatttgaaatgtaagtttaaaaaaaatccaaaaaataaattaatttaaaaaaaaatagattgctcgaaattttttatggatgtttttaactgttctccaagaagattgtcctgatatagtagccagactatatcagggtaggtagagacaatcaggtttatcagaaatatcctatgctttctgggggcctggcacagagctgaactgggccccaggctcaggagaatgtcacgggcatgcgggcactccagaataatttaggcagccatcaaggtggcttctgaagtggttgtattctctaactgtgtgctgtctaggatctgcagaggtcactaggaggcagaacactttgcaggttagcctgtggtaaagccaagagccccatgaatctgaaaggctgagaccaatagccctaggaaacaagggtctcacagttctgtcattaatgtgtcccaaaacagatttaatgtgtctcgccaaggaactggtgctcctgggaaagctctgaatccccaggtcccaaaagtggggacggaagatacaaaagtaattcactggatctctgggttcccaagccctttggggtacctgtgtcttggatttaaagtatagcctggtccctctggcaatatcatacagcctaccttaaagctactccattcaccctgagaacctaatggcttccagtctgccacccagttctcctgcttcatttatgggcatatcagagataataccactgtcaccctgcttaaaggacagacaggaaataactaacacacacatccccaaaagttctcagtcaagaaagagagcaaagttgcctcttcctccaaagctcatacccagccctcctggaagcccctgtgctaagccagctaggggcagtgagcaaagcttggcagagcatcaataatcaggggcctccctgggtttgtgcttgggtttagagaatgaagacaagacccagaaggagactgtctcctagactggaagagaatccccagaaccctgctcctgtcacagctgccctaatcagtcccctatgctgcaggcatgcagtgatctaaacaaatctaacctaggtccttcctgtcccacagtttctgtcaaggccccttcactctatcccttgaagccctgtagcagcgaaaacacggcttcggtgacattgggctgcctggtaaaggactacttccctgatccggtgactgtgacctggtattcagactccctgaacacgagcaccatgaacttcccgtctatcggttctgatcttaagaccaccaccagccaaatgaccagctggggcaagtcagccaagaacttcacttgccacgtgacacatgccccatccacattcgtcagtgacttgactatccggggtaagcagggttgagctggttacagttaccacaagagggaacatggtcagagcagaaaggaccgctcatatatacctataacagggggccaggggacccaacatactcaggggcctggtttgaggcttgaggggacataaggttagggagatactcacagctcactgcctctgccctagctcgacctgtcaacatcaccaagcccactgtagatctactccattcatcctgcgaccccaacgcattccactccaccatccagctgtactgctttgtttacggccacatccaaaatgatgtctctatccactggctaatggacgatcggaagatatatgaaacacatgcacaaaatgtcctaatcaaggaggaaggcaaactagcctctacctacagtagactcaacatcacccagcagcaatggatgtctgaaagcaccttcacctgcaaggtcacctcccaaggcgagaactattgggcccacactcggagatgctcaggtaggcccacactcgcctgatgctgagacctcagagttctgaagggaaggcaggctcttacgcagcccttcctctcttacagatgatgagccccggggtgtgattacctacctgatcccacccagtcccctcgacctgtatgaaaatgggactcccaaacttacctgtctggttttggacctggaaagtgaggagaatatcaccgtgacgtgggtccgagagcgtaagaagtctataggttcggcatcccagaggagtaccaagcaccataatgccacaaccagtatcacctccatcttgccagtggatgccaaggactggatcgaaggtgaaggctaccagtgcagagtggaccaccctcactttcccaagcccattgtgcgttccatcaccaaggccccaggtgagcacaggagatggagagtgggccggcccttctctgtgttcagatggcacggttaactggttaactcgtgtctgcccacaggcaagcgctcagccccagaggtatatgtgttcctgccaccggaggaggaggagaaggacaaacgaacactcacctgcttgatccagaatttcttccccgaggatatctctgtgcagtggctgcaggatagcaagctgatccccaaaagccaacatagtaccacgacacctctgaaatacaatggctccaaccaacgcttcttcatctttagccgcctggaggtcaccaaggcactctggacacagacaaaacagttcacctgccgagtgatccatgaggcacttcgggaacccaggaagctggagagaacaatatccaagagccttggtaacacttccctccgtccctcccaggcctccatgtagctgtgatggggaaggtgaatggcagacatctgcccactgttgtaacactgggaagccaccccaataaacactcagtgcctgattagagccctgggtgcccttcttcggggaaggtgggttgtgggcagaagtatcttggcctgaaagaagggaaaccccaagagagggacaggagtgaagcatggctcacccatctgtctatgtgttgggtatttgacaaataggacatcacagggcttcagcatagataaccctggtccttcctgcccttcactgtatcatgcacctgaaagggatccaaagagccagagaggtggtctctagagatgtaggtaaaatgaaccaacctgagaggcctcggcacccacccctcagtcttgcaagctcctgctcccaggtattcctggatgctggaactccttaaggtagagaaacagccaaagtcaacatctggaaaggcagaagtcagcatggccctgctccttccctctgtactcagcagccattgaggctgagcctacggccctgacctcctgtgtgccatgtgatcataccagacccggatcagaacctggtgctcctcatctttcaacccaaagtcatcccaaggcccagaatgggaagccagcttcacacagttgggttctcccatctatgccatgttctcacacacacacacacacacacacacacacacagagccacaaacactcaggccaccaagtcttaaagagactccaccaacagcacacacttgcagccacctgacacaacaacacacctcacccatgttcacatgtggcctgcgctaggcttcagtctgtttccagtcctttaccttttacacttgagtccaaaataaaaacagaagacttacgccctgagggagagaccagtgtcttcttcctgtggcctcagctcccagaacactcttccctaccttctacaacactaagacagtaagatacacccacacgaacataaatacatacacacacacacacacacacacacacacacacacacacacaccccaagtaggcttcatcatgctctttggtttagcaatagcccaaagcaagctatgcatccatctcaggcccagagggatgaggagaccagaatcaagacatacccacgcccatcccacgcccaaccaccaaccaccagcacatacggttcacacacctgagaccagtggctcccatcacacacacacacacacacacacacacacacacacacacacacacacacaagcccgtacacatccaccatatccagagacaagtgtctgagtctgagatacctctgaggatcaccaatggcagagtcggccagcacctcagcctccaggccaatccttatactttggcccactgcaggccatgagagatggaggaggtggaggcctgagctgtggaaaaccagagacaggaagatggtctgtatggagagagtagtaaaccagattatagggagactgaggcaggagtagagctcctacaaggccagtagtctaccttagagtcctataagtctgggctgggagtccatgtgtcctgacttgctcctcagatatcacaaccaagattcctggagccagagtgtgcatgcaggccttagaaatggagcttagagcccttcctggagggccctgggcactctgaacaaaaggcaattctgtaggctgtatagaggcatcctgtcagatacacacacacatgcacacacatacacacacagagacacagacacacacacatgcccacacacatgcatacacacatgcacacacatacacacacagagacacagacacacacacatgcccacacacatgcatacacacatgcatgcacacacacacacatacacacacacacacacacacacacacacacacacacacacacacaccccgcaggtagccttcatcatgctgtctagcgatagcccttttgagggtgggagatactgggtcatggtgggcactggagtagaaagagggaatgagcagtcagggtcaggggaaaaggacatctgcctccagggctgaacagagacttggagcagtcccagagcaagtgggatggggagctctgccactccagtttcaccaggactgcctgagaccagtgagggatccaccctgccacactgtcacttggagtctggggacgctaactggctggtccccccatcccagagctagacatccaggacctatgtaccgaagaggtggagggcgaggagctggaagagctgtggaccagcacttatatcttcatcagcctgttcctgctcagtgtgagctatggggccactgtcactgttctcaaggtgggatcctgcacctcggtgggtgggtcagggaggtctaggccaagctgcagcgccatcctcacatacacctttcccccaggtgaagtgggtcttctccacactgatgcacgatacaccccagaccttccaagactatgccaacatcctccagaccagggcatagatgcgatgccagcacccgtgcaggcctgcagccatgtgtgtctgagcctcctgaggtgcctgtttgccttggatggtaggtgggagcagagacccctaaaggcaccagagttggtgagatgtcaacatgtagaaggtgcggcttggggcagcaatgtgggctgtcccgcatggatactttgagacaggactttgaagagcctcaatttgacctatcaaatgctggtcacccaggtctttcagcatcagggtcactccatattgactgaataaccacaaaagcacaagaacccagagcctagagtccccactaggccccacctagagcacagagtcaaagctgggacactcagaatcaacccaaagtccagacccttgctcctcagaaggaatcctgccccactgcttccagacagacctctggcctaggcagatcgtcctactgccagataaggagcctcccacagggcagcagcagactcaagctctgaggccccatcaaccccagccccagcctggcagtcctactttgtctctggtctctttagtaaagttcttttccataactcctgagagtgctttgagaaggtatttaaggctaccattatggtgatgacaggtcccaagaacatggacaaggaccagatggtaagagcctggggattaaacatccacctctatgccatcctcctcaaaccacagagttctgccccagtctccatccggtccatcattcctgctgaccagactcacctcccaggggaattgaggtggaatcagggctgggcccccgggaacctggctgcaggtcactcttcaagaccacaatctgcccacccagtaagtgcagactgacaggccagtcccctgacccaagctgggacactagagggactaggtaacagcacgcaagtgtacaagaaccatccaaaatgggttgtgccatcctcaagacatgatctcacatgacaaaagacaggcttctctcatatataatgattgctcagggactaagaagaaagacctcttcatgggacggaaaaaccagcagtcactgtttttttcctgaagaaaatgcttcaatggtgagaacacttctagaaagaaggatgttagggtgagtgtggccctgctgggccctgggtaaagaaaggcatgagaactacttagaccattttgagggtcagttggccaaacactcttgtcatcacaagtgacagtctcacaaagaggtccacactggggtgtcaagctcagcaccaggggactttgggggaactaagatagggataaaccagccgggatcaggccatagtccacaggcatctgagccctctgctgctgagtccggcttctacgggccttggagtagggcccagatggcaaagacacagaaagctacccctcctgggtgcagaagacccaggactgggagaatgactgttctgatgagaaaagaggctctgtttaggatgtgtcccaagccattagtgtggccagcttactaatgtgcattcatgctgcaaaccattgctcacaatcaaatgtataccacgcacacagtcacgtagtttgcgcagacccactcatgtggcacatgcctgtgggcacatgggaccacacatacacgtgatgctttaaaacacagatctgcacggtcttgtacttagacacacattgtctcaggaagcccaggtgtggaccaccctgtcctcctgccacattctcctaagccatatcccctgccaagctgaggcctaggtgcctcttcctcaaccagctcctagaccaacatccctgaggcatagctcagtgtcttcttctaatcactatccctccaagccacgagaccccatagacactggacacgggcagcaagggttcagctcaaagaacacggtgtggcaggaactcctaccaaatcccaactagaaggaaggaaagtcccacagagagctagactcactctagacaacccagacagtgaccctggcttctacataccatgaatgaatgaccttctgagactaagaggtcgctttcttctctattcctacattatcagtccaccatggagggctacatggaaaaccccaaaagacataatcacattttggaacccataaatgtagcctcttgggaatagttcttcatcaatgtgaccaaggtaactatctcaagacgaggtcatcaaggactagctagtggactttaacctggtgacaagagtcataagagacagaagcaggacctagggggtaaacagggcctgcattctccaaaatcaaagtgtcaaaacagaaatatggcagcaaaacagaagtaccgtgcccaacactggtcaagaccaatgggggaggctcatgaggggttgcctaacaagagcaggcacaagtgcttagataaaaccacaacctacactcggccaccgtaaccctacatagaaaatgtacctatgggacgtcagctcaacgtcagtcccacctcgttgctgtgcgcagacagctgcagcctgaataacctgtccaagtgtgcatgtcacatccttgatgacacactgtaaccagtgatgccatgttagcacgatgtcctgtgagggtgtcttctgactcgggatggcaaaccctaagaccaaaaggaggtgcttggttcacgagagcggcctcgtggctggacacatggcgttaaatgagcctctgtggactaggaagcagctttaaccagaaagactataccagcaccctgcttcacgtttccacctttgagcctctactgactaagccactggcagccactcagcctgtggtattctctaacggcaacagaaatgactaagacaggcaaccacaatgtcccccactgctgatggctccagggcattcttggcctgatgacaggacctccagagcctccttgagacaggcagatctctggagggcaggaccaagctttctcctctctacctccccaacatctttgactagcttcacagataaaaggctagggggacatcagtttattccacactttctaagtctgatgcaggagcccttcctctgcgaagtatctatccaagaacccagaaaaggctaacttccccaactcaacacttagcaccactgacacacctgaccatacccactgatttacaacctttctcccagacagggccattcctgggcaaagactgtggtgtgagggcccagagtcctattgttgtataaatgaggcacagtggcagaggcaagctacaaagagtgacattgtggagagaggacactggggacagtcggatgtgtagaggatcatatgaagggtggagccctaccctgacaatctacaaagagtgacattgtggagagaggacactggggacagtcggatgtgtagaggatcatatgaagggtggagccctaccctgacaatcttcaagaggctccataggtcaaaggcccatcctgagaaagctgtgataggaaattgactcagggcagatgggatccaaatgagggtagcacctaactgtgacctacagacctccatgttggtcctcaagttggggcacccactttctcatggacgtagccatggaggtagccacagctcgtgacaagccattccagacacttgcctcaccccgttgtcaaccctgtgacctcaaagctcttctctgaggcccccctcagcttagggacccctctggagtagccctgttactttggctccttgacaacaagctctcaggtctcccttctacccctaattgtcctctccctctccatctctgccttggagtctctgagaaactagatgttcatttcattccctcctgcatctcctgcccaacctacccctgtggccatgcatgtggagtcctggccccatccaggcccgtgtggtcagacacacctgtctccaccacagccagaccacaggccagacatgacgtggaggtaagcggccacaatgtggaggtggaacaggaagtgggtgagggaccccatccaggggccagacacacagtcgtgcagccccctcaccgctcagtctgacccatccacaggcaaccacacacagagaaaaccagtttccagccaaggcttcacccagtcctaagctctctccggtagggcagacggcctttagccatgagaatggaccttcagggtgggaccacctggccatgggaggcctggctgttcccctatgaatgacactcaacaaccttgagcaggtgggtcccggtaccatctggactgctctgctccttggtgcactggggaatctcaaccaggccagacctgagaacataaggcagagaagcattagcaaggagaaggtgattcggagagcaagaaccagaggaatacaggacatgaacacaggcacgaggcggggtcatggtctgagctgcagagaagagagaaaaatggatgaaactcagcttcctggaaagcagcaacaagagactcccaggctagactgaggcaaggataaggaggcatcaacaaagaatgggggtgactcgggctgccatggctcagctgagctggatttagccaggctgagctgaactaagcttagctgaggtgaatgagactgagctgagctgagctgggacaaggtaggccaagttgggctgactgagctagtctagactggtctgggctagtctgatctggactggtctgagctgaactgagctaagttgagctgggataaactgggctgaggtgggataagatggcctgacttgggtaactaagccagtctagaattggataaactgaactagactggtccaaactggactagactgagctggactgagttagaatgaggtggactgggctaaactgggctgagctaggttaagctagggtggactagaatgctgatttaagatggcctggggtgggaacgctagctaagccagaccaagctgggctaggctgggttaagttgagttgagctacagtaaactagcctgggctgtgctgaccttactacaccaggctgggtttggttggcatgaatggagctgatttgagctgggctagaccaggttagtatgagctatgctgtcctggtctaagtagactgggtgaggctgagaaaattcgagatggaaactggactgagatggaaaaagataggcttagtgttggcttactgaaccagtctagaatgagctgaactggacttggaatggcctgaactgggcttagcttatctagcctgggcttggctaggctggcctaacctaggctgagttgatctgaactggtgtaggctgggataggcttgctgaaatggactaggtcaagctgggctggagtggggttagctaaaataggtggactaggctgagatgagttaggatgacctgagctatatttaggggatggatgggatgggatgggctatcccaagctaagctgggctagaatgggctagtgtaagctaaactggctgggttggaatgtgctgggctgtgctaagctagaataaactagagtggactggccaaaatcggctgggacggtctgtactgaaccaggctgggctgggctaactgagctagaccggtctgaggtgagctaatctgggatggggcggactgagctgggataggctagattaagctgggatgagctaggctaggctcactgagctaggctggaatagaccggtctaagataggctgcctgagctaaactagactgagatgaactgtaatgagctgggatgagctaagctaatctgggatgatctgggctaggctggaatggactgagccgagctggtctcagctgggctgggttgtgctgaatgggggtaaaccagactaggctacccagactaagctgggctgtgctgggccaagctgggctgagctagggtgggttgggctcgatggctgggctaatccaagctaggctgagctgagctggactgagctgggctggacggagctaggatgggattgactgagctgagctggactgaaatgggctgagctgagctaggctgagattcgctgagctgggctgagctggactgagctggactgagctggactgagctggactgagctgggctgagctgagctaggctgagattcgctgagctgggctgagctgggctgagctgggctgagctgggctgagctggactgaaatgggctgagcagacctggacaatgcaaggctgcactgaactgtccggctaggctatactgggatgagctgagctgggctggtctcagctaggcttggctgtgctgcatggaggtaaaccagactaggctacccaagctaaactgggctggaccaggctgggctggactgagctgtgctgagctggactgagctgggctgggctgggctgagctgagccaggcttggtttggctgagctgagctgagctgagctggactgagctagactgagctgggctgagctgagctaggctggactgagctggactgagctgggctgagctgagctaggctgggtttggctgagctgagctgagctggactgagctgggtgagctaaggtagactggaattggctgagctaagctgagctggactaaactggactaagctggactgagctgggctgagctgagctaggttaggattggctgagctgagctggactgagctgggctgagctggactgagctggactgaaatgggctgagaagccctggacaaagcaaggctgcactgaactgtctggctaggctatactgggatgagctgagctgggctgggctaagttgacttgggctaggataaactaaactgggatgagccggggtgagctgcatgaggtaggctggaatggctgagctagactaggccaggctgagctggaatgagccgagttgagctgagctgagctgagataaacttagtaaggctagaatgaattgagctgagctaggctgggccgacctaaagttgctctgaggtaggttagacatggttgtctgagctgggctgagttaggctagctataccgtctgggctgacctaatatgcccatattagttgtaatgacgtgacctaggttgaaacgggcttgctgatctgggctggactgggccaaactggagttagtctagcctgggctgacttagtgtagcctgggcagagttagactggaatgggctacactgagctgaactaggatgggatgggaagggataggctgaactgactgagctgggttcagttggccttgctgggctgagctgggctggatagtctagctgggctggccagaatgaggcagagctaggctggaattaggctaaacttggtttggctggttaagatgagctaacataaattaggctggctgaactacactggactgtaagctagcctgggtgagttcgcatggctggacgtcttcacagctctagtctgagttttactggtttgttctcctcagtgctgaggtaatagaaagactttggagtaaatgtgaaccaactcttgtttcatgggtccagactgtggcctcagtttgtcttatatgaacggagccacgccactcagtgtccaattctcatgccctcttctccttccctgattacctggtggaaactcacatgtacctgtagatagtgcctacatggacagaaccactgctcagatttagtcctctggccttttggtccactgcttgctgggtggatgggcaggtggctggagtggtgggtctgaagccaggacaaggcaagtataaagtaaaaacacaacaaaatggcccccaccccccagtgtaacctccaagccagctgttccccaaccattcctgccctgtgctggctgaggttggccgtccctgctcaggcccaccagttctggacctcctaacctgggactgagaacacggctctacccactgcccaagcaggagtggggctcagaaatctggggcgctagactgctcaggagcatagccatgtttacaaagacactcacagtgcgtacaagccctgctggaggcatctagccagatccttgaaaaagacaacctgcaggtcacgttcaaaatctatgcagccagtcggtcagctccaactgcgggtacatgatgcaacccctatgtgatactgggcctaggttctccggtataaagaagaaaaaggcatggtcctttctccagagattgtctcaagatgggcagtgtgaggactactatctcactcatgttttatgttccagagtccgcgaaagatcccaccatctacccactgagacccccaccatctccgtcaagcgacccagtgacaatcggctgcctaattcagaattacttcccatccggaactatgaatgtgacctggggcaagagtggaaaggatataagcgtcataaacttcccacctgccccagcctctgggccatacaccatgtgcagccagttgacattgccagctgcagagtgcccaaaaggaacatctgtgaaatactatgttcaatataacacaagccccgtcagagaattgagtgtggaatgccctggtaaagaaggttgggggggtctggggtgggctaagtcctaccttaacctggtatctggacccatatacccctctgaagcacacatcccactcagaaacctcccatgggggatggggggagggggtgtgaacaggcagagggagcagaggcctcagaacatccagaaaaggggacagcaaaggagaaaaggagactattctgatttgctaaaacttctatgttacaggtccaaaaccctccttagtctgccgccctcgcctgtcactgcaacggccagcccttgaggacctgctcctgggttcagaggccagcctcacatgtactctgagaggcctgaaagagcctacgggagccgtcttcacctggcagcccaccactgggaaggatgcagtgcagaaggaagctgtgcaggactcctgtggctgctacactgtgtccagcgtcctgcctggctgtgccgagcgctggaacaatggagagaccttcacatgcacagctacccaccctgaatttgagacccccttaaccggcgaaattgccaaagtcacaggtgggcccagatgcatacctgggacattgtatgatgttccctgcttgcgtacctgctttcttcctctaatacagatgctcagctgctcaggcccttgtgtcacagagggaaactggagctatccaaagaactgcccagaagggaagggcagagaggtctctgctctccttgtctgagccataactcttctttctaccttccagaaaacaccttcccaccccaggtccacctgctaccgccgccgtcggaggagctggccctgaatgagctcgtgtccctgacatgcctggtgcgaggattcaaccctaaagatgtgctggtgcgttggctacaagggaatgaggagctgccctctgaaagctacctagtgtttgagcccctgagggagccaggcgaaggagccatcacctacctggtgacaagcgtgctgcgtgtgtcagctgaaacctggaagcagggtgcccagtactcctgcatggtgggccacgaggccttgcccatgagcttcacccagaagaccatcgaccgtctgtcgggtaaacccaccaacgtcaacgtgtctgtgatcatgtcagagggagatggcatttgctactgagccaccttgcctgcccctactccttaaataaactctgtgctcatccaaagtatccctgcacttccatccagtgcctgtccatcatccttagggtctacaaaacactgggaggggtcagggcccagggaaggaggaacccccaccacctgagcttgtaaggcctcagagactctgaaggacctacatgcctagagtatatgtgtatgcatgtatacgtattagtgagtgcctttgcgtgtgtacctgtgtgtaacaagagaggagtgagtttgtgcgtgcctacgggtttatataggtatgtatatgggcataagtgcatacgcctttaagtgtgagcatatctgtgtccccgtgagcacatgtgtgtctgtgtatgcctatgagtgtgcacgtatctgtgtatgctcatgttggtggaaacatgtgtgcctatagtgtgtgtacctgccaggtggatgtgcaatgaaagggaggtgagaatgggggtgaagtccgagatgagcagattcagccaagacaggcaaacctcaggggagagtcccaagagcagtgggttgctgcagaggtactctgaatggtacttctgaatggtggtgtggctgtctgagtataagattacagcttttgtcccaaacaagaaagggatagatggagcaagagagtagcaagaccaaggctggtactgcctgggagtcacaataggaacggtagaggagtgaggagatgaatccaaggggcactgggaagaagatgccacccaccctcagtgggccagccctgaatggagacgtgcatagccactcagggtgaccactgactcatgagaaagagacataacatggcacagacagccctcagcagcaccctgctctgcatatatgcacatgggcatacaccctggtctgcatacaggtacatgggcatacacgcacatacatttgcacactcacacagacccgaaccctggaggaggacgaagttcacagcccacacgcagcttctggaaagcaatgggagtcccctcccaagcccaaccatgacaactcatggacaagtctataagctcctccaggtggcccctttctaacctaagtctcccttcccatcctgagcccaagtataacaaaccagaaacagggtatgtggcaagctgggaaaagacaggagcaggccatagagaccactctcacacaggccttggcctcctccatgggcacccctagaacacaaagttctacaaccaggtacacttggcacccagatgcccacaagagggcagtggggcccctgctcctgtctcacgggccttcagaacctctccaggggcctggtttctagcaacttccctctgctgtcagagcaaggcccatgcacaccctggataccctccagcttgaaagtccacttccccgaggatagcaaaagcgacaggccagctttggaaacctgacccagaaaagcacgatagccacccatggaacccaaggcctggtccaaaacagaattctagtaaggaggagccaataggtgaaagactgaacacacacagggagagaagacagaggagcacgatagtcgagagaggggggctggtgggtgaggcgatgagtgagtgactggaacaaggttgggtggatatgcagatgaatgatgggaatggtggatggactgatggatggctgcagtgacagaaatatgagtgactgagtatcggcacacagtccctacctccacttaaaatcaaagttctatgcgcggagactctgagggcagtggggttgtctctaccgggagactttagtgttggttaacccccccccaagttctttataatgcaacagaatcctctgaccacatgtccaccccttggtattccaacctcggcccagaaatcaccttggcctgtatctgtttgagagtgtccgatcttaccgaaccctagtacccaggccaagttcaacctaagaactggggcttttgtgaggtgttgctaaatgtctagagaggtctgagacaagtggccttgggctcaaactcttctcagagcctcaaagacagaaacaactctcttaccatgatagttctctaattaagatcccctgagggaaagagagagagtcaggtcttggggggcatctcaagaacttcaaggattccagccccttacctgggaccctgccttctcattatcccagaacaagtcccttctcagagataaggaacccctgccaccaccgtccccaaagcccaagggggcatagaaacagaggccttaagcctgagcccccatccccatgggtttggatctagaaggtcatctatgtcttacagaatgccaagagccaccttcctacgtgatactggaccagtcacaagacatcctggaggaagagaccccgggtgccagtctgtggcccaccgctgtgaccttcctcaccctcttcctactgagcttgttctacagcacagcactcaccgtcacaactgtacgaggcccatttggcagcaaagaggtcccccagtactgaccaggagccagccacaggtggctgtcatggagacggtggggtacagggtgggggcaggggccttgaggatttactcagcccctccacatgtggccttgcaacccttcacagacatcaaggaagtggaaggaagtagaaggaaattatggcagcacttcctgggtttaacccagtcttccagaagccaggctgagacctcagcaaaagcaaagacataacccaactccaggatcctcccctctggctgaccacttgtgtctttgcacggatgaagcttggagaaagtcctctatgtttcagagactgatgtgacagcttcccacccgactcccatactttgctgagcaataaactggtgcaaaagcacagtttcttactctcaaaaacaaaagttaacaaaggattgggtgagggggtcagagatagtgtggtggtgccatgctaaactgttgcttacggtatagaatgtggcagcattgggcagggcagacacagggtgaccactgtctagtatccgagacaaccgtgtgtagctgtagccaagatgaacactgactgacttcaacaagtatttgtggcctcttcagacccaataccaggccattagcttgatctctggacctgacttctaaacatttggcctctgtgaacacccttgccaaacactggtcctggttgtgaaccttggtcctgaatactgagccttatcttggtaactgaaccataatcctgatccctgacctcagtcacgatcatgaaaccctggtcctggccactcgttccaataactggtccctagtcctgagccctgagtcctggtccaggtcactgaatcctggtcatgatcaatgggtttggtcctcattcctgagcctagtcttgatcactgatcactggttctgatcattaacaactaacctgatcactagtccccattcctaatcactgggccgcgatactgatcactgaaccctgtttctaaacaatgtgtagtgaaatgtatggtaaaacctttgcatctggctttgagtgaaatgtttcggcagacctttgctatgttttgggttagtcaggaaaggctgagaaatggttttgaggctgtttgaaccttgaagaaatgttgtctccctggacaatctgcacttggtactacattaaggtttgcagttgcacacaccttggtcctaaacactcctggcagacttagaactcttacgtttgattatggctagccatagttgaaaagggctgagagttgtatgggtggtctgctctctctcgcagcaagggcaagatgactttggtagttgaaaactttcccagccccaactaactctgtataatgtttgaataaagtaacggcagtaggctagttgtggttaatttttattccaagaagaatgaacccctctgctccttcagaaaaggaaggcttagcattttggtgagcttctctctactgaggcacctatgaccaactcagtgttctttgattcctgtcaccacatccagtcttgatcactaagtgccagtcctcatcactaaaccctggtctccaccagtctgcttgggttctgataatcagactcacattctgataactgggccctgattctggtcactagctctttgccctggtcatggacatttgaccctagtccacggcactgagttctgggcatggaccctgggccctagtcctaggtactgggttctggttctaacaactaggtcctgtactgatcaatgggccctgacctagacattgggccctggtcctcaacatcaacttctaagcctgaactctagccccaaattctgcttatcaacactggtcctggaccttggtcctcatcacacatccattctctgagacccaaggaatcagtggtattttgcaagaagtccctttgatattccaagcctcattctcattaggaagatctcttcaggggattcctgcagaaggttccagaatccccaccacactgttcacatactgggctgcaactgggacagtgaccccttttgctcatggaaacaaagcaggcccaggccctgtgagctggagcctctggcctggggtctacagatgtggggtcagcattgtggagaaggtttgcagggcaggtgtgggggtagggcagggatggtcacattagcatcttgtttttctttcttctgaagtctctgttttctatcacctgctgaaacattcaaagtagctccaagctgaggccagctgagtcatcctgagcctatctcagcccaggtgcctcaaaacagagctactgttctgagaatcacaccaccctggaccaggccaggtgggtctggggctggatgaggggtcagagccaggggagccctgacagggactgagaaggccccaacccccatcactcaaggttctccacaaccatccacagtcatgccttagtgaggccatgttctgtcccaatgagaacaagtccaattaagattaagtctggtcttcccagggtcattcagtgtcaaggagtgtcaaccaaggccagccaaggccagcctgaggtcagccagcatcacccaaggacacacaactattctagtagacaactagaatagtcagctcaacagggccctggtgatgcaaaatggagagtgtattcctgccagacagggctccacagataggctccctcactgcatatgacctccctgaatgtttcccacactgcagttggttctagactacttcttgataagcatgcagaaagataacaggataagaaattttatgcagagaacagaagtatctacggaatagaatagaagatagatagtagaagtctgctacaggccccagtggagtctctttgtagagtcaagagatcaaacctaaactgagtctcaggattgagtccagtacagaagcaaccttcaggatgctaaagaccatacaggcaatggacagaatggagtccagacagaccaatgagtggacagtccaatctcacataatgaaccatgtcaagagcagatagtgagccaaagaaggctctgggacactcggagattctcggcctctggatctcctgatgtatataccaggtgatcaagtgacagtctagtggagccattgccatcacagtgtcaggtgtcctccccttcatgggttccggtgaggatgtggcacctccctttagttggacgtgtacaataaattctcaggcctggtatgatttttaatgatccatgtgtttctatagtcttaattatctttaataaaattatagggtgacaccaaatttagggataagttatttatcaggctgtgcctttggaaggtgacgttatttacatagccaccaaggtgcccagtcatcggcccatcttccaaacggagtcaagggccatttgaaacagtgaaatccctcagggcaagggacacaacatggaggaatttaaaacagagtacagcttgatcttaacacacacacacacacaaacgtaagagatggaaaaggggatcaagggacacagaagtacagagaaaacaagacagtaagggatgtagagatgagaggtaaccacagggaaaggtgagacacaaagacgagaggagaaagacacagggacagaaagacccatgcaagcaagagagacagacataaggaagaaaaggcgagaagagacagacaaaggtgcagcaatgtggcccacctggtactcacaagaaggccctggcacacactccgatgagagccatgcacctacaaacacgtagacacagctccacacagacacacacggcatctgcacaactgtctgaacctcaaacaggtctgcccactccctctcctccaggcctttgtccttaggaaggcacgctgagggtaactcagtcgggatacttctgattggggctcactgaacagcctgaggctgggtccacagttgctctcactgtctggccctgtaccccaggtcatgcttcagagggaattaactgaatgcagtaaacaccgtctgtggtcagcatgtactaagggatagaaccctatcaggatttgtccaactaaggtccaaatacagagtgaagaagacgatgggggagatcagatggcagatgggagcactctggatagagctcagggatatggtggctgaggaacattacagctgccaggcttggcctttcatctcagctctaggtcaaggggaactacccaggtctctgctttgttgctggtaactatacctaagtctaagaacctcagtaagacacagaaccagtaagacgacagcctccatcgataagaaagaaaggagaaaggcagaatggataagtctctggacagatgagagcctacacccaaaaacagttcgttcagccagttaatagggtgtagccctagcacacgagagaaaacagttccacaggtgtaagggagtaaatctgtgcgaaggggtactgcttgagctcctcatggcctggtccagaagcagaagctgggcaggggcaaaggacagggtaaggcagggagacaggggcatgaaggagcctttgggactgtgtggtgagaactaggctgtgcttttactgagcctgagtttgtggcagttgcctcatggggaaggcacccagaggtaaggcagaggaaaggagtaactagggctgagggcaccacagggtctgaggaattagaggcagctatgacccatttgtcatggtatttggacatgtacttcatggacacagatctgagaaccaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgtgggtggggacaagctgtagagtgtccccatgaggggacaggctgagatagggactgaagtccatctacaggcttaccacactccatgctctggatgagagcactgagctctgccaccctacaacagcaggcagagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctgggaataacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctagggaaagcttttatttccccttgaattttaatcattgtctgggtgtaataccctgggttgagagctgtgttctttcagaacttggactacgtctatccaggcatctggctttaaagtttctactgtggggctgcagagatggctcagtggttaaccacacatttcttcttgcagaggacttgggcttgattcctagtacctccgtggcagctaagaaccatctgtgactccaactgcacaggattcgatgcccttttctggaggtcatctggagtagtcagctcaacagggccccgggatgcagcatggagagtccatgctgacaggcagggctccacagagagagaaagacagaaacacaggccactgaaagagacagtaatggactgaggggacagagagaaacacacggacagacagacagagataacaaaacaccgacactcatagacacagagaagagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcgattcccagcaggctcatggcagctcatactgcaatcccagttccagagtgccctgaaggatccttcatgcatgtggagcacagaagcgctctctctctctctctctctctctctctctctctctctctctctctctctcagatgaaagccatgaaccagaagacagagacatgagtgaacactcctcagagacatagccacagcactcacacccagttccacacagacacatacagcacctgcctgcctgatccaaaccccaaacccattgacccactccctctcctccaggtctttgttctcagagtagcacactgagggtagctcagcctggatacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtcttcctggcacagtctatccctggtgcaggcttcaggtcaggcccaagtgtgaagagtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcctatagcagggcatgcctctgggcatcagggagtcacacagaggcaggtaagactctagacctggggactgagaggggaaggcatgtacaagagggcctcatccttaggacacagggattcgaggcctctggatagccagtgagcaacatatgcagagtgatgaggccccaggagtctaatggacgccaggaggtcacagagctagaggcctggagggctagagtctgtgggaagggggactgcttaggttcttcccacccatgtccaggagcagaggctgggcagggccacaggacagggtaaggcagggagacaggggcatgaaggagcctttgggactgtgtggtgagaactaggctgtgcttttactgagcctgagtttgtggcagctgcctcatggggaaggcacccagaggtaaggcagaggaaaggagtaactagggctgagggcaccacagggtctgaggaattagaggcagctatgacccatttgtcatggtatttggacatgtacttcatggacacagatctgagaactaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgcgggtgggaacaagctgtagagtgtccccatgaggggacaggctgaggtagggactgaagtccacccaaggctcaccacactccatgctctggatgagagcactgagctctgccaccctacaacagcaggcagagcggcctccatgctaggaaagccaggcagcagggacagagttcctggatgggacaggtggaattgtctctgctctgcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctaggggaagcttttatttccccttgaattttaatcattgtctggctgtaataccctgggttgagagctgtggtctttcagaacttggactttgtctatccaggcatctggccttaaagtttctactgtggggctgcagagatggctcagtggttaaccacacatttcttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagagatagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctctctctctctctctctctctctctctctctctctctacactgtccccatgaagggacacgctgacgtacggactgaagtccacccaaagctcaccacactccatgctctggatgagagcactgagctctgccaccctacaacagcaggcacagcggcctccatgctaggaaagccaggcagcacggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaagcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacnnnnnnnnnnnnnnnnnnnnnnnnnnnnnnnnnnnnnnnnnnnnnnnnnncagtggcacacacacatacacacacacacacacacacacacacacacacacacacacatacactctaatgaaggcagtggcgcacacacacactctcagatgaaagccatgaaccagaagacagagacatgtgtgaacactcctcagagacatagccacagcactcacacccagctccacacagacacatacagcacctgcctgcctgatccaaaccccaaacccattgacccactccctctcctccaggtctttgttctcagagtagcacactgagggtagctcagcctggacacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctgggacagtgtccctggtacagtctccctggtacagtctccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtctccctggtaaagtctgtccctggttcaggcttcaggtcaggcccaagtgtgaagggtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcgtatagcagggcatgcctctggacatcaggaagtcacacagaggcaggtaagactctagacctggggactgagaggggaaggcatgtacaagagggcctcatccttaggacacagggatttgaggcctctggagagccagtgagcaacatatgcagagtgatgaggccccaggagactgatgggcaccaggaggtcacagagctagaggccgggagggctagagtctgtgggaagggggactgcttaggttcttcccacccatgtccaggagcagaggctgagcagggccacaggacagggtaaggcagggagacaggggcatgaaggagcctttgggactgtgtgatgagaactaggctgtgcttttactgagcctgagtttgtggcagctgcctcatggggaaggcacccagaggtaaggcagaggaaaggagtaactagggctgagggcaccacaggatctgaggatttagaggcagctatgacccatttgtcattgtatttggacatgtacttcatggacacagatctgagaaccaggcctggctctcactaaccggcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagggtgcgggtggggacaagctgtacagtgtccccatgaggggacaggctgaggtagggactgaagtccacccaaggctcaccacactccatgctctggatgagagcactgagctctgccaccctacaacagcaggcacagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccatgtcctctggagagctgcctactgtcacagatacctttcttctgtttctgctaggggaagcttttatttccccttgaattttaatcattgtctgggtgtaataccctgggttgagagatgtggtctttcagaacttggactttgtctatccaggcatctggccttaaagtttctactgtggggctgcagagatggctcagtggttaaccacacacgttgttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagacagacagacagacagacagacagagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctcgctctctctctctctctctctctctctctctctctctctctctctctctctcagacacacacacacacacatacacacacacacatacactctcaaatgaaagccatgaaccagaagacagagacatgtgtgaacattcctcagagacatagccacaacactcacacccagttccccgcagacacacaaatcacctgcctccctgttccaaatcccaaacccattaactcactccctctccttcaggcctttgatttcagagtagcacaccgagggtagctcagcctagacacttcccatgggacctggttacatagcgtgcacagggccacctcttgttggccctataacccatgtgatgattcaggaaaagatgttgtctgagagcagggcctggtacagtccccctggtacagtccccctggtacagtctctctggtacagtctccttggtacaggcttcctgatacagtctctctggtacagtctctctggtacaatctgcctcgtacagtctccctgatacagtctgcctggtacagtctctctggtacagtctgcctggtacagtctccctggtacagtctccctgatacagtctgcctggtacagtctctctggtacagcctctctggtacagtcggcctggtacagtctccctggtacagtctccttggtacagtctccctgatacagtctgcctggtacagtctgcctggtacagtctctctagtacagtctgcctggtacagtctgcctgatacagtctgcctgatacagtctgcctggtacagtctccttggtacagtctgcctggtacagtctgcctgatacagtctgcctggtacagtctctctggtacagtctccttggtacagtctccctgatacagtctccttggtgcagtctccctgatacagtctctctggtacagtctgcctggtacagtctccctggtacagtctccttggtacagtctccctgatacagtctgcctggtacagtctccctggtacagtctccctggtacagtctgcctggcacattctatccctggtgcaggcttcaggtcaggcccaagtgtgaagggtgcagaagacagtgggcagagctgagagagcgctagtcagttttgttcagagaacagtgatggctgctccaggctactggacatcccaggtgtgcttcttacacttctcaaagctgtgggaacacaaccaaccctctacccaattcattgtaattgtctatagcagggcatgcctctgggcatcagggagtcacacagaggcaggtaagactctagtcctggggactgtagaaggtatgtaagtacaacagggcctcatccttggaacactggtgtctcaggcttcaatacagccagtgagaaacacatgcagagtgatgtggccccaggagactgatgggcaccaggaggtcacagagctagaggcctggagggctagggtctgtgggaagggggactgcattcactcttcctatgcttgcccaggaacaactgtctatgcagggccacaggacagggtaaggcagggagacaggggcatgaaggagcctttgggactgtatgatgagagtctaggctgtgctctgactgagcctgagtttgtgacagctgtctcatgaggaagacacccagaggccagacagaggaaaagagtaatcagggctgagcggaccacagggtctggggacgtggaggtggctggcctggctcccacaggccctcagatggagctgcacatcatcccatagcatatcactctggagggcttatcaaaatggttgtgctgtgggactgggtttcaggactgaggcctgagatactgggtagcagaacatgttcagtatacagggtgctcagagtacgggggggggggggacaagctctgcagtgttcctccatgttgggacaagcagaaagaggtcttgaagctgtttgtccatccataggcctaacccatactggccctgctcatggccctagcttgggccacatatctagtgcccactgaatcatcaccatgaagactgttggaaaaccagagcctctgatgtcttcctgccttgcttgctctccctgactctcatagctcacacaggctctgccctggtccaccactgtcctcaactgtaaaccatgccaggcacagagagcaaggaatgtggtggtctcagactgtcacacacaacaatcttgtgcctttcacatccacacgcacaagcatgctcatacccctctgtcaggggtcagtggggtcttccttgggctcactcccatttctagctgctccttggtattggtgactgcggctgctgtgtcggtggctgccagagatgcttgatcggcatgacctcagatataggaatggcctggggtcaacagagtgcacacacttagggcactggccagagttctatgtagaccaaggcctctcttcctagtgtgttatttcacaaaaccttatgcaacaacatcttctattccttttattcctctttgtctgctaatggggaattttctagaaagagtgtcccctctctgtcttcctgctgtgtagacagatcttgtaggtgtgatcacagagtggtgtttcccttcttggccattttcaggccaggaactcagggccagagacagaaagtcaggaaggtaggaaagacagggagacataataaaggtgagatggagacagagaaagacaaagggagaaaagcacaggattgcagggagagacaaggagacgcccgacggaaacagacatcagggaaaagacatgattgttcctttagtaaattgctttccggagaaaagagacagcagagagacatggataggcacacaaagatacaaggagagagacaggaaacagagaaagagagaaacagagatggagaaacaacgagggagagagaagagtagagagaaagacacggagaaaaaaaatcaagaaacagaaaagacaaaagataggaagacagagaaataggccagaaatacagacagacagagagatgcctgaagatgttctctctcacctagagaaagaaagcacaggcagagataatacagagagagagagagagagagagagagagagagagagagagagagagagagagagagagaggagagaaagaggagagacacggtgttagaggagaaagcattatgttttgatagagacagagatacagcaactgaggaacagactgagcagaaagaatcccactcagagagagacagaggctaagctgggagaggcaggggtggccagagagggagacagaggagagcctgtgggacaggtcagacaccatcttggaagacccagtgacaagccagggaggtgacaggttagtgcagtttctaccccacagtccacaggctggagccacaggcctgtgtccatgtggccacaggctagctcccagcctgccaagcctgtctgtggagggattgcggagtggggctgggctgaggcaggccaggatttttccagtggagcagccagtgactgggctgagggtcactgcccaccatccccgtgattctgggtagacccaggacctggagcacacacagccttcctgtctctcccacttccctggggtgtttggaccttgcctatctcctgtcattccctcctagggtcagattccagcagtgtcgataaatgggaaaacactgaattcaatgtcaccgttaggggtcatggaacccccagccccatccccaaagctggtcaacctggccagggtggggtgaacctgcagctgcaggtgggggaatcattgatgctatttttggctcagagaatgagaaacatgtttttctgcatggaacaaacatccatttgcatgtgccccgagggccaaccctgcacagagtgagtcactcggcaggtgtgtgtgtgtgtgtgtgtgtgtgtgtgagagagagagagagagagagagagagagagagagagacagagacagagacagagacagacagagagacagagagacagagagagagacagagagagacacacacagagacagagagacagagagagacagagacagagagagacacacacacagagacagagagacagagagagagatgttgtgagcaagccctgtttcaggtactgatatctgtgcccccgtgccccagcccatgtggaaaaactacccttaggggcccattaactcatcacagtccaggccatcatggtgagccctagctgacctaagcaggttccaccctaaacatgaaggaaaataataaaggccatctgttacccagaatcctagggatggtgggcagtgaccctcagcccactcctggccgctccactggaagaatcctggcctgcctcagcccagccccactccgcaatccctccacagacaggcttggcaggctgggagctagcctgtggccacatggacacaggcctgtggctccagcctgtggactgtggggtagaaactgcactaacctgtcacctccctggcttgtcactgggtcttccaagatggtgtctgacctgtcccacaggctctcctctgtctccctctctggccacccctgcctctcccagcttagcctctgtctctctctgagtgggattctctctgctcagtctgtcagccatagttggagagagtccatctatgtttgcctctgtctctgccaattccatcagaggtctctctactaacacttgcctctgcatgtgtctcttggtccttctcctgtcttcccatctctctatctcctcatctctctgtctttctgttactccctgtctctgtctctctgtcttttctctcactgtctttatctctctgcctgtttcatggacttttctctgtctctctgtctctgtctctctgtctctctctctgtctctctctgtctctgtctctctctgcccctatctcttggtctctatctctatcttcaactccctatctttgttcctcatactcacatttacctctttcccaagcccccagtctccaggtctgcctgtttctgtctctcccttgccatgtttccctgttttattctctctcctcctgaatgctctggcttgaaactggccaagaagggaaacaccactctgtgatcacacctacaggatctgtctacacagcaggaagacagagaggcgaccctctttcaccctacagtgtctggacttggttgattccaggttactcctatactcaagtccgggactatggtggtcaagcatctctggcagccactgggacagcagctatagccaccaacatcgagccctgttagctaccaacattagctcctcaaagaggttgggtctataggcctctggtgtgaggagatgttgacagtgagaattagttcccaaggaggacaccactgtttcctgttagatggagaactacagtgggtacgaacatgcttgaacacatgagtgtcaaatgcacaagactgttgggtgtgtcacccttcccctctctgttcatggcatgactgcacactgaacacaatggtggattgggacagagtctgtgtgagttgagaatcatgaagagtgtagacacttcaaggatagtgtagacccttctagttcgtggtgatggctcacttggcactgagtttctgaccccacagggaccatggacaagggcagtatgggctgtgcctatggatacaaaagagacttcgaagcctgtattagcctgtcccctcatggaggaacacagcacagcttgtctctacccacactctgagtactctacgtcctggacacctctgtcacccagtgtcctaggtcccatccttggctcccacatcacatctgcctttcagacagatcttccagtgtgacagacccatttcatggtgctgaacaacataaacccatttcctgagggttggtgagagccggcctggttctcagatctgtgtccatgaagtacatgaccaaataccatgacaaatgggtcatagctgcctctaattcctcagaccctatgggccctcagccctggttactcctttcctcggcctggcctctgggtgccttccccatgaggcagctgccacaaacccaggctcagtcagaacatagcctagttcctaccatacagtcccaaaggttgcttcatgcccctgtctccctgccttagcctgtctgtgctcctgcacagacaagagttcctgggcaagcataggaagagtgaatgcagtccctcttccaacagaccctagccctccaggcctctagctctgtgacctcctggtgtccattagactcctggggcctcatcactctgcatgtgttgctcttgtacatgccttcccctctcagtccccaggtctagagtcttacctgcctctgtgtgacttcctgatgtccagaggcatgccctgctatagacaattacactgaagtgagtagagggtcggttgtgttcccacagctttgagaagtgtaggaagcacacctgggatgtccagtaacctggagcggccatcactgttctctgaacaaaactgactagcattctctcatctctgcccactatcttctgcacccttcacacttgggcctgacctgaagcctgcaccagggacagactttaccaggcagactgtaccaggaagactgtaccagggagattgtaccaggcagagtgtgccaggcagactgtacaaggcacactatatcagagagactttaccatgcagactgcaccagggagactgtaccagggagactgtaccagggagactgcaccagggagactgtaccaggccctgatctcagacaacatcttttactgagacatcacatggattacagggccagcaagaggtgggggctgtggaccagaggctcatactgtgttaccaggtcccatgggaagtgtccaggctgagctaccctcagtgtgctactctgagaacaaaggcctggaggagagggagtgggtcaatgggtttggggtttggatcaggcaggcaggtgctgcgtgtgtctgtgtggaggctgggtgtgagtgctttggctatgtctctgaggagcgttcactcatgtctctgtctctggttcatggctttcatctgagagagagagagagagagaaagagagagagagagagagagagagagagagagagagagagagagcgcttctgtgctccacatgcatgaaggatccttcagggcaccctggaactgggatttcagtatgaactgccatgaacctgctgggaattgaatctggattctctgtgaaagcatccagtgctctcaacccttttggggtctctgtctcttgcagtgtctcctctcagactctgtcttctggagtcactctctgtatgtattgcctctgtgtctctctcacctcctacccattgctctcaaaacttccctgtcccctctgttctctgtgtctatgagtgtcggtgttttgttatctctgtctgtctgtctgtctgtctgtccgtgtgtttctctctgtcccctcagtccattactgtctctttcagtggcctgtgtttctgtctttctctctctgtggagccctgcctgtcagcatggactctccatgctgcatcccggggccctgctgagctgactactccagatgacctccagaaaagggcatcgaatcctgtgcagctggagttacagatggttcttagctgccacggaggtactaggaatcaagcccaagtcctctgcaagaacaacgtgtgtggttaaccactgagtcatctctgcagccccacagtagaaactttaaggtcagatgcctggatagacaaagtccaagttctgaaagaccacatctctcaacccagggtattacacccagacaatgattaaaattcaaggggaaataaaagcttcccctagcagaaacagaagaaaggtatctgtgacagtaggcagctcttcagaggacacggggagtaatgcctcagactgaagagaaacacccattcacatgaggggacaggggctaaatcaagcgtgaggaggtgtggggatggaaagtaatgggtggcaggaggcttagccccagtgaagggttcctgcattcaaatctgcaaacctccacacaagaaaaaaataatatgaggggacgtagaacacaggcagcttgaaaatggaggatgcttttagcattaaagatttacagtgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattcctctttttttggcggccgatggcggttatattccttgcgtctcccgtatccagaaataataatcattcaaaacggtgttctcctcagccagtgtatgccttttggattttgcttccagcagcaccgagtggagaggagaggagaggagaggagaggagaggagaggagagatgttcagttatccaaaactaaggatccatgaagaagccttatggaaatccactattttgtaaatgaactaacatttattaaggaattttaactcagtgtatggctgggtgaacagtgttgttcccagaagaaatgggttagattgtgtgtggtggcacaggctttactcccagcatttattagaaggcagagacaggaggatgtcccaagtttgaagccagcctggtctacacagggtgttctaggatacccaggactacacagaaagcccgtgttatacatagagagatgtaagttgtcacatgaaacatggaggcctacaagttattgatcaggaagtctccagaggaatccaaacaaagcaggctgttcattgactatgttcctggctgtccaccatgactagacagtaagaccttactgctgaaggtccacttagtttgatgccgagcagagacaattccacctgccccatccaggaactctgtccctgctgcctggctttcctagcatggaggccgctgtgcctgctgttgtagggtggcagagctcagtgctctcatccagagcatggagtgtggtgggcctgtggatggacttcagtccctatctcagcctgtcccctcatggggacactgtacagcttgtccccacccgcaccctgagcactctacattctggacacctctgtcacccagtgtcccagaccccaggcctgggctcccacctcccaacatcagcctttcagacagatcgtccagtgtgagaggcccatggcatggtgtgctgaaagacctacagccacaagtgggacacctcctgccggttagtgagagccaggcctggttctcagatctgtgtccatgaagtacatgtccaaataccatgacaaatgggtcatagctgcctctaaatcctcagatcctgtggtgccctcagccctggttactcctttcctctgccttacctctgggtgccttccccatgaggcagctgccacaaactcaggctcagtaaaagcacagcctagttctcatcacacagtcccaaaggctccttcatgcccctgtctccctgccttaccctgtcctgtggccctgcccagcctctgctcctggacatgggtgggaagaacctaagcagtcccccttcccacagactctagccctcccggcctctagctctgtgacctcctggtgcccatcagtctcctggggccacatcactctgcatatgttgctcactggctatccagaggcctcgaatccctgtgtcctaaggatgaggccctcttgtacatgccttcccctctcagtccccaggtctatagtcttacctgcctctgtgtgactccctgatgcccagaggcatgccctgctataggcaattacactgaagtgagtagagggtcggttgtgttcccacagctttgagaagtgtaagaagcacacctgggatgtccagtagcctggagcggccatcactgttctctgaacaaaactgactagcgctctctcagctctgcccactgtcttctgcactcttcatacttgggcctgacctgaagcctgcaccagggatagactgtgccaggcagactgtaccagagagactgtaccaggcagactgtatcagggagactgtaccaggcagactgtatcagggagactgtaccaggcagactgtatcagggagactgtaccaggcagactgtaccacacagactatactaggcatcttgtaccagagagactttaccaggcagactgcaccagggacactctaccagggacactgtaccagggacactgtaccagggacactgtaccaggccctgctctcagacaacatcttctcctgagacatcacatggattacagggccaacaagggatgggggctgtggaccagagatgcttgctgtgtctccaggccccttgggaagtgtccaggctgagctaccctcagtgtgctactctgagaacaaagacctggaggagagggagtgggttcatgggtttggggtttggatcaggcaggcaggtgctgtgtgtgtctgtgtggagctgggtgtgagtgctgtggctatgtctctgaggagtgttcacacatgtctctttcttctggtgcatggctttcatctgagagagagagaaagagagagagagagagagagagagagagagagagagagagtgtgttgctgccttcatttgagtgcttggtgggctccatgctgtacctctgccttccctgtgtgtctgtccttttgcctctcccttcctttggcctgtctctcttgtctgcatctgtctctcttgtctctccctctctgtgtctcttttctctcctgtctctgtgtctcttctttcctgtggtctctcctcatccccatgtctgcatcagtgtctatcagtctttaactctgtgtcctcttgttcccatttctgtccctctggatatttctgtctttctgtgtgtctgtcctcatctctcccagcgtccatgtctttgtgtccctttgtccccacacagtatcttctcaaatactctgtgtgcctggtcccctgtctctcattccttttctcactgctcccatcagtgtttctctgtgtctctgcttctgtgtctctgtgtgtctgtctcatgctatctctttctctctcattatctctgtctccctcagacttctctgtctttcttggtctctgtctccctctgtgtctctgtctttctgcatgtctaatgtctctgtgtctcccttagctcatctctgtctctctcaatattcccacaatcccctttattctttgtgtctctgtctctgtggtgtctctttctcagtctctctgtatttcgctctgtctctcagaatctctgtgtccctcatattatttttcgaagtgtctccctatctctttcagtaacactatttctgtttttctcagtctctctctctctctctctctctctctctctnnnnnnnnctctctctctcagaaagtctatggcacctcttctatgtgtgtcccactctggacctggatcaatcttccttcttggacctcagtttcatcagttgtgagacgataccttgccagaagtccagaggactgtctgtcctccatagtctagaccacctgtgatctgagagatattgggacaacggatgtgcagtgagggacctgcctttctgtggagccctgtctggctggaatacactctccattctgcatcaccagagccttgttgagctggctattctagttgtctactagaatagttgtgtgaccttgggtgatgctggctgacctcaggctggccttggctggccttggttgacactgaatgaccctgggaagaccagacttaatcttaattggacttgttctcattgggacagaacatggcctcactaaggcatgactgtggatggttgtggagaaccttgagtgatgggggttggggccttctcagtccctgtcagggctcccctggctctgacccctcatccagccccagacccacctggcctggtccagggtggtgtgattctcagaacagtagctctgttttggggcacctgggctgagataggctcaggatgactcagctggcctcagagtggagttattttgaatgtttcagcaggtgatagaaaacagagacttcagaagaaagaaaaacaagatgctaatgtgaccatccctgccctacccccacacctgccccgcaaaccttccccacaatgctgaccccacatctgtagaccccaggccagaggctccagctcacagggcctgggcctgctttgtttccattcagtgcctctgggaaaggcagatgagtaaaggggtcactctcccagttgcagcccagtgtgtgaacagtgtggtggggattctggaatcttctgcaggaatcccctgaagagatcttcctaatgagaatgaggcttggaatatcaaaggtacttcttgtaaaataccactgattccttgggcctcagagaatggatgtgtgatgaggaccaaggtccaggaccagtgttgataagcagaatttggggctagagttcaggcttagaagttgatgttgaggacctgggcccattgatcagtacagaacctagttgttagaatcagaacccagtgtctatgaccagagctcagtgatagggaccaagtcccaaggccaaatgatcaagaccaggacccagttgccaggaccaagatccaggtttcacaaccaaacctagttacgcagaccagaaaccattcgttggaatctggatctgaatcagagcccaatcacactactctaaaccagagttcagtgttgaggaccagggtacgtgatgagcccaagattcagagatcaagaggtggattcagtaattaagaccaggattcagagatcaggatcagggctcagttagcaggatcagggctcagtcatgtggtcatgggctcacggtccaatgtccatgcccaaaacacaactaaggacccagtggtcagaaccaaggcctgatgatcagagacaatacacactgctcagagctgaatttcagtggcaaggatgaagacataatgataaagactagggatcagtgagcagaaccagcgatgaggacccagacgcatctctgaagactagagtcagtgaccatgaccagttcaacgatcatgagtaggacttaattctgatcatacgagttcagtgatcacgaacaaggctcagtgatcatgacaagggctcagggaacaagagtgaggctcagcgatgaaaactggacctcagttatgagcccagtgatgagtaaccaggtctcggtcattagggccaggattcagtgataagaaccaagggtctctgcagggctcagtgcatcctctccccctgagactggacaaagccgcccagccacagggatggattctccagacaggcaacagcttcagggacagcccccccgtgatgcgccagagtaggggatacccaggggacttccacactctcaaagaagaaggggagaatggaacatgaagaagggactgtgaggggggaccgggaagtgggggacacagtgactgggatataaagtgaataaataaattaatggaaaatatcacatgggtgtagggaattttgaaagaataaataaaatgttaaaaatgaaaagaaaaaaagaccaagggtcaatgatcagggtgataataaataaataaataaataaataaataaataaataaataaataaataagaaaggaaagagagaaagaaaggaaggaagaaagaaagaaagaaagaaagaaagaaagaaagaaagaaagaacaaacgaactgaatgtcagaatttagggtaagatctcagtgatgaggatcagggatcagtggtttgaacgcagacacactgcccagggccattgttcaatgacgagagtcagggatcagctatcagaaccagggccagtaacgaaagccagggcccagtgaccccaaccaaaaaccagtgactaaaaccaaataaaatagaaactaggcagccacgatggtgcacacctttaatcccagaactcaggagtcaggggcagggggagttcaagacaaccctggtctacacagtgagttccaagacagccagggctacccagagaaaccctgtctagataacaaagactagaaaccatgagctcagtgatcagtggcagttcttgatgactaagaccatggtcaagaggactgatcagcaggactcagtggttagactcaggacatggtgatgatagcctctgttccagggatcagaaccaaggccaagggccaaggccatgactgagtcatcagaacagggcctctccatgagcactagtcaggcgcagccaggcctagcatgtcaatcaggcaaaattgggtatgtgtgtggtggtatgactgactatacatcgtcttagtatctgtctgaccccaccaccatcttccctgcctccgtccactcacagatctctgacgcgtcaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgaaccccttgcggcc

SEQ ID NO: 3 - DNA, 149681 bp, Artificial Sequence
  Description of Artificial Sequence: Synthetic polynucleotide
  RP11-115D9
  modified_base (2)..(2): a, c, g, or t
  modified_base (11)..(11): a, c, g, or t
  modified_base (13)..(13): a, c, g, or t
  modified_base (17)..(17): a, c, g, or t
  modified_base (19)..(19): a, c, g, or t
  modified_base (23)..(23): a, c, g, or t
  modified_base (31)..(31): a, c, g, or t
  modified_base (35)..(35): a, c, g, or t
  modified_base (38)..(38): a, c, g, or t
  modified_base (41)..(41): a, c, g, or t
  modified_base (45)..(45): a, c, g, or t
  modified_base (47)..(47): a, c, g, or t
  modified_base (49)..(49): a, c, g, or t
  modified_base (51)..(51): a, c, g, or t
  modified_base (56)..(56): a, c, g, or t
  modified_base (58)..(58): a, c, g, or t
  modified_base (63)..(63): a, c, g, or t
  modified_base (65)..(65): a, c, g, or t
  modified_base (67)..(67): a, c, g, or t
  modified_base (69)..(69): a, c, g, or t
  modified_base (71)..(71): a, c, g, or t
  modified_base (73)..(73): a, c, g, or t
  modified_base (76)..(76): a, c, g, or t
  modified_base (78)..(78): a, c, g, or t
  modified_base (82)..(82): a, c, g, or t
  modified_base (87)..(87): a, c, g, or t
  modified_base (89)..(89): a, c, g, or t
  modified_base (93)..(93): a, c, g, or t
  modified_base (95)..(97): a, c, g, or t
  modified_base (99)..(99): a, c, g, or t
  modified_base (101)..(101): a, c, g, or t
  modified_base (106)..(106): a, c, g, or t
  modified_base (108)..(108): a, c, g, or t
  modified_base (121)..(121): a, c, g, or t
  modified_base (124)..(124): a, c, g, or t
  modified_base (132)..(132): a, c, g, or t
  modified_base (138)..(138): a, c, g, or t
  modified_base (145)..(145): a, c, g, or t
  modified_base (151)..(151): a, c, g, or t
  modified_base (157)..(157): a, c, g, or t
  modified_base (162)..(162): a, c, g, or t
  modified_base (168)..(168): a, c, g, or t
  modified_base (171)..(171): a, c, g, or t
  modified_base (179)..(179): a, c, g, or t
  modified_base (181)..(181): a, c, g, or t
  modified_base (185)..(185): a, c, g, or t
  modified_base (189)..(189): a, c, g, or t
  modified_base (196)..(196): a, c, g, or t
  modified_base (203)..(203): a, c, g, or t
  modified_base (209)..(209): a, c, g, or t
  modified_base (215)..(215): a, c, g, or t
  modified_base (219)..(219): a, c, g, or t
  modified_base (222)..(222): a, c, g, or t
  modified_base (226)..(226): a, c, g, or t
  modified_base (233)..(233): a, c, g, or t
cnaccaacgancntttnancccnttcatctntttntgnccntggnancntntatcntntatcntncntntnanccntntatnaatcntntatnannncntnttacntnttcactaatcatnacntaaccatntacatntaccatntacatntacatntattntaacgntcntaccatcntntacncatntatcatntatcatntacatntaatgncatntantacntacgtgngatccgcggaattcagagaaggaggtgggagaaagcatctgacatgcttcaggcagtgatggccacaagatacattagagatgttcatagaagaggtggcaagtgggtttgagatgaaaagggaatgtgaattcagaggtgtcccccagcctgttcccctgagaagatttcagacccttagcaacccctgggcccccaggtagagctgttgctagggaagatttgtacatgataggggacaggaagagggatcacctacctctgaaggcatcttggttggtagtggccagagtgacatctgttcaggcccattattatccctgacccaggcagggatcatgtccaggagggcagtaggagccagcaggagctcagagccatgccccagttctgctggtgccaggctaggatgttcttcatactctggccagccctgcaggtgacagtgaccctctaacctgagagacaaggaagaggatgaagatggcatccacataacatgctcactgtcatccaagtgggggaacaagcatgcagattcccaaatattaataccaagcttttatttcatccaacttgatgaaattctgatcagaaggagaaacagtctaacaaattcatcatcaaggaaagttcatgtttaatacaaactatctgaggctgaaacctgacttccccttcctcaccaggcagtcaggacagcaggagcaaaaggagaaaagctgggtcccaaagtccacaaggtgactcctggggctgatcctgctcagagaacgtggcaacagtggataagtctgccgagaatgccacaccatcatactctgagctggagggcttcaaccacagacatttattgctaatttattagacatttattgcgaatatattagaaccatggaaggttcaagatcaaagtccagaaggatttgctttctggtgagaaccctgtttgtttccagatgtcctctctggatacatcctcatgtgtgttcagcaatgtgccaggcatgtgtaagagaagcaagtgcatgctttactcagtacacgcttggaggctggtgaggggttcagtaacagctcaatgatatttctttttattaggacacaaatcctattaaatcagaaccccgatgttttcacctcatttcaccctaattacctcttcataacctctatgtctaaatgcagtaatattggaggttggagattcaaaatatgaatttgtgaaacaccattcagttcatagcaggtgcactttgaggatatggccaaggcagtaggaagggcaaggcaaggcttccagtctcagagcacagagggcattttcccaccactcagcacactggcagctcctcccaggtgatccaggtcacacatgagaccccattcctgccttgggggctgcctgctgataatgaaacaacatcacccttaatttcactatttctaagatcaggcttctattttgtgtttattatggggtttgtccaatggccaggtttgtgacataccacccaatggcaggtttgtgacataacatcttatagaattttagatgctggtttccagtgagacttgatggagttttttcatgggttttcatggagttgatcttattacatccatcaataggctgcattctgtagggaatacaaaacgattcctctcctcaataaaccagtcacctagttgaagataaagagttgagaaaagatggtcacaaaacaatcaggtgttaaattctgtgatccatgtgagatgccaacaatgtggttctgggaaagagagagtgaggttgtgaggggccctgcagagcacaatgtccagggctagggtcgggagtagagggcccctggtctggatctgtctactcagcttcattcctcccattgttgaaacagtggctgcaccagccagcaagcatctgagaccacctgattctctggactaacagctgctgaggtttgtgctctgagctataacactgtgagggtctaactgtaaccatttagatcagcactaatgaaaataattttttaatatggtgaaaatgtctgcaaatttctaacagaaaaattgatgaaaagatggtttttcttaggcccccacagcagtctctgcctgggacctgactttgtctttgagccagtggaatctatgctgagattgtaagctgggcagggaaatcacagcagggcaggctgtgctctgggtgctgaggaggacaggaggacactccttcagggttagtgatgctgggagttcgaggggagagactgcatggagctgcctgtgaatcgccctagcaatgccctctggacactgctcatctcacaagtgtactcggatgccagtggatggcccaaacatgggctcaggttggacaaggacaaagatttagggatgaatatatggggctcatttgatactctgaagtttcagcacaagcataacgaattatatggggagagaaagaagtcacaaggttgtgatttttcatttggtattaaaatatatcccctctgctcatttttccctgcagaatgtaactactgatacatatttaagcaaagtcactgtttttaattgttttagtaactgacagcctgtgtgcacagttcctaagtaactgggtagccagaccatcattcctatggtaaagccaggaagtgactgtggatgtgaacaaatgtgagtttaatgtacatgtctccaaagccacgggccactgatctagggagaacctgcagtcagtttgctttcccatgcccagatgagaggacaccttgatctgtgttcttctgatgaactctaaaaactctaaaaactgatgaactctaaaaactaatattctgaaggtctagttcatacttcttttctttgctagagggactctctcactcacatgtattgtactctctgcatagaacagtatgtgatacatacaacttgttttctgctaaatacccatcaatcatgtcattcatgagtcttccatagatgttacctgccctatgaatctgggctcttccaaaagaatgggccagaggtggagctgtgctttcacattctcttgtgcttccctcgtggacaacctttgctagttgtcacccttcccacccagcaaaagtaactgtctttctgacatctacacaatcatttaggttttcctgtcttaaacttcatataaatagcattatgtgtatttttatctttttagtcttggtattattccttactacttttgaggccttcatttcttccagtggactcaaggtcctgtctgatgtcatttcctgtgattctgaaggattttctctcaaatgttttataagacatagctgctatgaatgaatgtattttgtttaccaaaatttttttttttgcctttttgttagatttgaaggatattttcactggatagatttcctggctgccttcttttttttccttttcagcatttaaatatgtcattttactgcttctagcctctattggtcccgatgaaaacttagccaatggctacgttgttgtgtctctgtatatagtgtctgcttttattctgatgcaatgaagattttttctttgtctttcaacattttaatatagtgtgttcacttattaatttctattgactatctaaaagggttttattgaattatttcatctaagaatattttttattacttttgaaaagtttttgtcattgtatctccaaatattttttcagccactttctctgtctctccttctttgtgactctcattatacatttgttggtatccttcactctgagctataaatctctgacatttcttcctttttttctaaacattttctttaggctcaaacatttccattcctctattttcaagttaactgattgttctgtcatctcaatttgctattagacctagctaataaatatttaaattgtattatggtacttttcatttctagagttcccatttggtcattttttatactttccatttcttttcttgaggtcctacttgctgaatcttctttttaaaaatattttcgtttttatgtcaatgatcatagttttaaaaataattatttgaacatctgcatattaactgctttgtagtctttgctaaagccaataatgaggacaagttagaatcagctttcattggctattttctgttgtcattattgtagttgctttactttgttccttcaatataaatcatactcctctgtttttttttcaggattttttaaaactgaaagctgcacacttttgataatatattatagtacctctctttagattgtggggtttttattttaattttaatttttttagaaacagggtctcactctgtcacccaggctggagtgtggtggtgtgatcatagctcgctgcagcgtcaacctcttgggctccagtgatcctccagcttcatcctcctgagtagctgggactataggtgcatgccaccactctctgctatttaaaaaaaaaaatttgtagagataagggtgtcactattttggccagcctggtcttgaactcctggcttcatgtaatccttctgcatcaggctctaaagtagtgggattacaggcttgagctaccatgtcaggcctggaactggtttcatttttctgagcattttaaaatttttttcttagttacttgtcagaacttacttctggtacctgacttatgatagttggagttatcattttttgactttcagatggtgtgaaagtgatatgcattcaagtagaaatagtacttctagtatttatacaactattctatcttctctttcaatagagtattcaataaattgcatgagatattcaacactttgttgtaagataaggtttgtgttagataatgttgccctactgtaaactaatgtaagtgtactgagcacatttaggatagaataggctgagctagtggattacatatattaaatgtattttcaatgcatgatattgaaaaatctatatctcatatggtgtttgaccactgatatctctgctttttattcttaatatttagtttgaatttatagaaactgcacatgtatctgcacagcttagtggtcaccaatgatttgagaagaagttttgctcaaatatctggaggttataaatctatcttctgtcaatccatctgtgtgtagtttaaaaagctcctgcaaaatgcagctagttcttacctccctctggttttactttgcaccgggcacttctgggtctcatcactcatatctatagcttctaagtcaccaggaatgtgtgtagagattgtttcagcaatatggctctatcttacccaggaatctgctatttactgttagcaggtgtactacttgccccaaacagggcatcatctttgactaacaaagctgtgggctttttctgttcattccctatggagttctgcatgtttagctggaaacactgaagaattttacttcattccttggctttactcaagttcacccgctttggcagcaagctgctagctttatttgctatcctcatattggtaaaactccagttctgtatttcatgctgactgagctgggggtagaagggtgctgtcacaggcaaaaggctacagactttttctgtccttactcaaagcactagtacttttttttctataaagaatatacatctttaattattttatgcttcaccaattttcagagtgctgaaatagttttgatattttagctttatatgtgtgtttgttatttatttttgcacagaagatttattaaactctttgtgatgccataaacagagatgccttctaaaatgcatttaaatgaacataatagccatgctgaaatggaatgaggttatttactaacataagtaattttggacttgagaacttgaactcttcaccctcagtttaaagagaaaccaaggacttaaaaaatagagaatcctggtccctggatttcacattcatgaagaaatgcacagtcaatttttaagatgccttctttgtattctagaactgagcaaattagtgattacactctacataatgggagctatgattgtctttaatagagataagaattagaaataggaaaaggtagctgggtgcggtggctcatgcctataatcccagcactttgggaggctgagacgggtggatcacgaggtcaggagatcgagaccatcctggctaacatggtgaaaccccgtctctactaaaaaaatacaaaaaaattagtcaggcgtggtggcgggtgcctgtagtcccagccacttgggaggctgaggcaggagaatggcgtgaacctgggaggcagaggttgcagtgagccgagatcatcataccactgcactccagcctgggtgatagagcaagattccatctgaaaaaaaaaaaaaaaagaaagaaagaaataggaaagtgcaaaataggaggaaacttgtggaattgtttaaaaactacctttttcttattttttagttacttgtgtgtgtgttttaagtttatgtggaaatacttttagacctaaaatttgaaaaatatggtaaaaatgattcccatatgcgcctctttcagcttgctctaatgtcagcatcataaataaccacagtataagtatcacaaccatgaaatgaacatagatataatgttatttgttaactcatttaaaataccatatggatttcactgatttttcctgttgatgactttttttatgttacaagataaaattcaggtttctgtattttatttggttatcctgtcctcaatatctttaaatctgtgatagtttttcacttttgtttctctttcatggccttcaaacatttgaagtttactgtccaggtatgttgaagaatgtcctcctagttgggtttgtatatggtgtttactactgattcaattcacaccattaatttttggcaagaataatacagacaggatgtatcctcagtgcttcacatcagatgttacataatgtcaacatgtcttataggtggtaataaacgaatatgatcaatgaaatcccatttggaaggaagttttggacaaaaataatgaaaacaactgcttctatcactctttctactaggtcattgcagacgtcattaggaataatctatttcttccttatcgaatatgtactttattttaacaaactttaatctttttacagtctactgcatcacagagaaaattgaagaaataatttagttaacttttaaatggcaaatgtttccataataaccatttgccactgaaatgttgatagcctgaagaaagaaaaagaatgggatttattcagccatggtagtatcttcacatgaacagcttttaccgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaacagagtccaagaatcaaagtccaaattgttcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgctagtggccctggtggatgcaccatagatgaggagcctgggcgcctggccaggtttctgctgataccaggttaagtagctgctgctaacactctgactggccctgcaggagagggtgactctttcccctggagacaaagacagggtgggtggagactgtgtcattacaatttctctggtggtatccaagattggaaataaaacagaaatgcactcatgtaatctagatcaaaccagctgtctttgagtagagccaaaattgttgatctacattgaattttaattatatttcttgctgagcagaggtggcaggagttttcactgatgtgcaaaaccacctcatgttcccctcacctgggagccagagtagcaggaggaagagaagctgagctggggcttccatggttccgtctgggtcctaactgagcagttccttcccagggctctgacccaggcattgatatgggctctggaaggtagggcagctgggagggacatgcaaagcagctgggtgggagctgagcttccagctgcagagaccacctgcttcttcctctctgcactgagcgtcctgtgcctccctggttgtcaggccagaaaagtctgttggctcagtctgagtgtagaactcctcccttgtgctcacataatttcactcctgtgcctttcttctcttcaatcacctaaatacacccgtatgatatttggcacaagtctgttaagaacaatataaaaggctgtgttttcatttctctcttcctgtcctcagtatgcccagtcatctccctaagtgcattattggatctatggaaatgaagagtctgttagaacttaatcttccagatagacattttttttttttttttctgagacggagtctcgctctgtcttccaggctagagggcagtggtgcgatctccactcactgcaagctctgcctcccgggttcatgccattctcctgcctcagcctcccaagtgcctgggattacaagcgcctgccaccacgcccagctaattttttgtatttttagtagagacggggtttcaccatgttagccaggatggtctcgatctcctgacctggtgatccacccgccttggcctcccaaagtgctgggattacaggcatgagccaccgcgcccggcccagatacacctttcatttgcttattagtaatgttttctgagggtcctgaagctttccattaacccagacacataccctctttgagttaaaaacttctgtttacagtcacatgtcctggcagccctgacatagatgctccatggcttgccgattgcttgaaattaatcaagtaacttaacttccctgtgtctcggtttccatatctgtgtaactgtgacaatagtggtacctgccttacagtgctgtagacagtttaaagaaaataagataaaacatttacaatagtattcaggacattatgtatgtggcaattaattttgttttcattgtttaaatattcagcactacagtcatcatcattataaatatacttagcatggaaaatagtcttaaatctaatccaagaatgttttatccacagtcaaattaaattctaaggcattttcttcagtaactgtacacaactcttaaaatcctaatgatttgatcttaatctgtgctaaagtactcagaccttccatcattcccatccatccctgtctaacgcattacttctcatcatccattatttaaatgttaccctataaacggtccccatgtcctgttgctgtccttctttcttatgtaatctttattctaccttgttatcttttatgttattcttgccccaggactgacaataaggaaaagctaccatcatttcttgtagacttgctccagtataattttttcaggcttgttgtcttggaaatgaggattgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacgcttgcttcatggatttttacatgtatattagacatatgctgggtatatgtgcgcaacgacaatctaaaaactgaatgataactagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggctgtggttgccgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgttgtaggaacagggaaattgaatttttcatagatttatgtgacacttgtatcatgttggggagagaggcatcaaaccaggctcattactgaaagaattattacgttatttaagagagaaagaactgtgaatttcttgtcaaatagatgtttaaaattcaaaactactattttttttttggagatagaatctcactctgtcacccaggctggagtgcagtggcacaatcttggctcgctgcaacctccctctctccatttaaagcaattctcctgcctcagactcccaagtagctgggattacaggtgtgtgccaacatacccagctaattttcatatttttagtagagacgggattttgccatgttggcccggctggtctcaaactcctgacctcaggtgatctgcctgcctcggcctcccaaagtgctggaattgtaggattgagccactgtgcctggccctactgatgtattaatattattcatcttcttgaatacaccaagtggtaaagtgcaaatccacactttaaacttgagatttctcctcctatgtgaattatactagtgaggaacaaaaaaattctctgttggtggggagatgatgtttgacagcggtcagtttgtgaagcagaggcttatgtcacaggactttttacagtattacatataaacatggtgaatggcctcaaacacagaagaatcagcttttttcatgagccatactaccaccaagaaagaactgaattgaaacctgtgactacttgatgaagggtgtataaagaagagggaaagatttgggaggccaaggcgggtggaccacgaggtcaggagatcaaaaccatcctggctaacatggtgaaaccccatctctattaaaaatacaaaaaaattagctgggcgtggtggagtcccagctactcgggaggctgaggcaggagaatggcatgaactggggagtcggaggttgcagtgagccaagattgcaccactgcactccagcctgggtgacagaacaagaatctgtctcaaaaaaaaagaagagggaaagaaaaatgacacaaaacacaatgtcataaatggaaaggaagaagtcattacacagcctacaggagtaaaaaaataaagagaggatattatgagtaattttatgtcaactaacttgacaaaagtggtgcagggcaggttcttggctacactcaggaaggaatgcagcgtaagctggtggtagaagaaaacagctttactgaggtggcagtgttacagctttgtgtctgttcttgtgaaacagagctaccacataggcattgtgccaagagcagtagcgtaggggcagttttgcagtcatatttatccccacttttaatgacatgctaataaaggagtgggttattcaggaatagctagaaaatgggcagtaactttcaggttttgccatggcaatggtaaactgatatggcactggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacggaaccatgttattaatccatgtgtttgcaaaacaacaaccttaagttttctgttttataaatggaggttgtggtgtcccccttttgtggctgtaggaccttgtaagaaacaggtttaatcctgggcagctgtacccaactagtggcttcctgaagcctaacagtaattaagagtaataaagaatatctgataatggctccttattctggttattattgattcttgggggatcattttgttgttgttgttgttgttgttgttgttttttgagatggagtctcgctctgttgcccaggctagagtgcagtggcacaatcttggctgggctcactggaacctctgcctccagttttcaagctattttcatgcctcagcctcctgagtggctgggattacaggcatgtaccaccatgcccagctaattttgtaatattagtaaagatatggttttgctatgttggcaaggctgatttcgaactcctggcctaagtgatccgcccatctcagcctcccaaagtgttgagatgaaaacgtcacaggagctgatgaaaaaggaaaaggagacagcaatgatcccaggcctttttaaagggagaacaagctgaaagcagcaaaatacaacagttaaatctctaagacactaatctcagaagttttaaaagaaactcattatcgtatcacaggcaaaattttttgttttacttgttttttttttttttttttttttttcttttttttgagatagagtctcgctttgtcacccaggctggagtgcaatagcgtgatcttggttcactgcaacctccacctcccaggtttcagccattctcctgcctcagcctcctgagttgctagggttacaggtacatgccactgtgcctggctaatttttgtatttttagtagagacaaggttttactatgtttgccaggctggtcttgaactcctgacctcaaatgatcctcccaccttgggattacaggcatgtaatcccaaagtgctgggattacaggcatgggccaccatgctcagccttaaagctgtatttttattaagtaaagtgtagaagaaaaagtgtaaataaagtgacagaaggaaaacacaaggctgttatggaaaatgataaccttagggcagaaaacaagaaaaggcaaaccaagatttccatagggtgaggctccaatccacaatcctcggatgaatgtcaatgctaaaaaccctggagcctccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattcttacatccaagtgtcctgccttaaacaattgcacaaacataattagtagggacccaaagaaaaaactgcaaagcaaacacatatatcaggacagaaaataagataaaatggctgatggataaataaaatgtcattagaggagaaatgactaagagaaagatcaatgaggatgtagtcaggtgtgctatgggggacttcaaatggactatttagccaaaggccttatttcctggaccatctgacatagggcaggtgggtagatgggacacttacaggtgtgcaggagccaaaatggtgccaagcagtctctaacatgaggcctgcgtgaagatctctccaggctccccagcttgggtgggttgaactcccacgggtgaactggtgcatggagcggctggcctgcatgaagcagtggctctgtggccacttacctaactgctcagctccaccgcctgtcaggaaagatgatggctcttaaaacagcctttggccagtgttaacagctctgcaatgttagcaactatgtagctttaatcgctgtagcgccgatctcgccctctctcactgatcgctgacttgccacttctccaatagctgtctcgcccattgctgatcgctatgtccatcttctcacaaaatgccatctcttgctgtctcttgctgtcttgcttctccactgtttctgctgtctcaccaccacatcaaacactgcctctcaccatgtcccatttatcctccctccttattaaacatccatctgcatgtccaggcctggcatccccaggctgatgtctctgtcctgggccaggtactggagagtattgttcctccaacttcaccaataagccatggttctctcaaatcaaattatctcactgcaccaattttgccaaggtttgcagtgtactggtcaccaacttacccaaatctactgggacacaattcccatgcacaacgagtaacatgaagtggattactacctacagagagtcagtcagagagagcacaaagctgccggggcctgattgacactagactgtgcctaccccacaaggactgcagctgagggaccctggaatgcagcctaccctgggttttatgtcttagaatcacatgacacactgggctggagtgttgaaggaattcctgtttctagtagggacagaaacagaacccaggctgttctggccaatcatgccctatctcagaatgttacagttccagaacattctacagttattcctgaaaactacaatcaagaaaaggaaggagactgggttgattcatgactaaatggaaactgttctgcaaataccacagtgaaatcaaaactcagtatttttgagactgggttatttcacttagtgtaatgtcctctagttccatccatgttgtagcatgtgtcagaatttccctttttaaaactaaataatatggaatagtatgtatataccacatttggattaccagttccctcctttgtgaacatttgagttgcttctacatttagctactgtgaataatttgcttctgtatgtggatatacaaatatctcctcaatttaatgtcttccattacttgggtatatgtccaaaagtggaattgctgaattatatagtatttctatttttaatcctttgaggaattgccatcttgtttcccacagcaggtgggccatttacatcaccacgacagtgtccacaggagttccagttccctaaattctcaccaagactggtcatcctctgttggaaaaaaacattctaacaggcatcaggtgggttttgtttttatttttctaaggattaataatattgagcatcgtttcctatgctagttatctaaatatctctaaagtatcttctttagggaaatgtctattcatatacttttctcatttttaaccagttattttatttttactgttcacatgtagaacttatttttgtatagtagatattattaaccccttatcagatatgattttcaaatattttcttctattccacatgttgcattttcactgtgtaggttttatctcttgatgcccattttaaatttttatgtagtccaatttaattttttcttcttttgcctgtattttggtgttaaaggtgttagtatttaaatgtctgtaaatattcacttactacgctgagaatgtcacacttcaccttctctctctgatggtggagctaagagtgttacactctcccattttgtcctaggggacagtgaagctaggtgagaacccagtggcttttctgagcttatttgtcttgcatttttggtgacatggattgttgttcacatcagcttcctctggcaagtccacctggaaagcattatatttagcaagaaaaaaggaggctctgaatgatgtcactgtaagctgtttatattccctgttacaaatgtcaaatccgtgaagcataaagggatttactagaggatattaaattccttagaaattgttgaaaagccttaagcaacaggctccaggcaaagcctctggaacaattccaagaatggcactgctggcgcaggttggggaggagctcctgctgcctgagactccacattcaagctgtctcctgcaggaaagagagcagctcttctcactactgccccccgaaggacagctgctccgctatcaactactagagacctgacccctttctctgcagacctgcctgtgttgattacatcttcatttcagtctcatgtagattcatctgttttcatggattcaggggctatttctgcccaagtccaccctgtggctttctatcataaatacacatctttctacactcgaatttctagtcattactagtatcaacagcaacatgctagaacctcacataaagatttcctttacaaagaacatcatgctccccacgtagcattgtgctccccagaatgtggggaaagtccaatctgttcagcccaacaccatgtaggaaaaaaggctcttctctcatgagccgttaatctgtctacttattattaatttgtgggctaaactataaagactggtaaaaatagcacttcgaattcttttaacaaaagggtgtaaagaaaagattaaattatttaacatgcatatatgcatgactcatttcgttattgtcaccagcttctttcatatttattttattctctagtttctggcaatactttctctatggtagagtctggaaaggctactcctcatgtccttggcttcctaagtcccagatgtggtgaagaatgcccatcagctgtgttactacggagtgcttttggattgagatgagggaggggaaatggctgaactcactcaaatgtgatcattttcttggtctaggtcacagccaggcaacacagtcctctgggcacaatatcatcacttgccatgtttctatcaaaatgaaagtatctttcttgactgtggaaaacataggggtgggggcggggagggtcaagtaatagcaaaaggagtacttggagttgcctgagctgccactctggtttccccaaatgttttcaatccatttcattcatgataataaacacctttctgcctaaccagtcataatgacttttctcagatccaactgattcagtgataaacctatagagaaaaaataactacacttctccatgtttaagctgaccaggatgctgtccctggtgtttacacctccatatcccactatgcgtttcatcttctctttgcctcactggtgatccaagtacagggaatgcttcacatgactgtgatccctagaacttcgtcctgatgacggttgaaatcttctctgagttttaccagtggaaatggcaataaatagaaacattccagaaggtcccctaggttccatattttctgtacttcctctctaaaatatgtaaaatcaattatgtttgctcttgcttttatggactctatctatggccccagcacacacgctaatgccctgtcttgacaatttatccagtattttaataaatgtaaatggtcacatgcttatcatatcatttcttccaatttcatggaataatttcacatcaactctttggattaagagccgtcaaccaaaaaaccacagccctgaataaatagaaatagagtatttcaagctgttcatttggcataacaatgatgagtctacagctcattttcaagatataaatattctgtttatgggagtgacagcaccattcatacagttactgtttcagagcctccaccatatctgacaggacagcaattcaatagcacaagggtttgtgtgccagctttgcttgactaataatgggtttttctctgtctatagggaaagcacatgacaagagcatgagctacacttcacttcactttttttgaggttaataagttgcttgatccaaagctatattacagaagaacttcctgactctgatgaaagctcttggaaaatcctcaaataatattttatgcagaaatataaccaaaaaggaaggcaaattcatatataggaaaataaccagtgccctcctcacgttacatgaggtctactagtatcacccgacaccagctgttagtctgagccctgatgtgtggcgcaatgttaggggttcaagagacgtcattcttcttgacaaattaggtgttcagaagagccagtagccctgtatgtctcagttagttgaaactcatattattgagtccccacagggacctccataaccttggttcaggagacaccttggaaacctgggaaaggtgattgactgaagtccatctgttgaatcatcctcattattaaaagcctcctactcattaacggcatttcgattaatattcgcttggaaagcatgtttttattttggctcatttttgaaacgtctagtcatagttcttcctgaaccactttgtctgcaatcatcctgttgcatttcttttaagggctgatgatctgtcaaaagcaacagccaatattattacattgctgttctctttgcaatgttatcatcagatgtaacccttgcagattaaccactgttacgatttttacatttccagggatttcttgacaatggcaatgatgtgacgccatccagcatctatttgtgagaactctatttgacaaatcatcactgtgggtgtgaacataatggagactttcataggatgcaatggttaatattcaacattagtcaaaatttactctagtcctacccttggagctctactgggttggaaaaatattttagataaggacaatcatttcatagagttttaaaaataaaggctaaaataaattttctgtagcaagagtatgaactatatgtagccagcatacccttttttagtggcatataacaaaaattatttaaatgtatttaatttaaataattgtataaatatgcatatataataaacatacttaaatataaatactatacatgtatatttgtagccaacattttatcagataaatatatgtaacttttatgtatcttatatacatatatgcacattttccataaataaggtaaattttaattttttattgaatactagttttaattttgtctttaattttctcttaataacttcataatttaatactaaatgttcacatttataccaccaacttaagaaaaaatcgtgtgtgtaggtagaggtgtaaatactgtatcaggaagcttttatgcattactgattggtaactggttaaatccacaactcagtggctgataacagtaaacatttgttttcgtgttcatggatgctcatgttcacaatcatctggctgatcaagaaagggctcagctgagtggtttctctgcagggcactgagctcatcttcagcctacagatatgaattgtctgaggacgaggctgaacagcagtgactacacatgacacaatattcttatggcaggtcacaggagtgaacaacatcccaaaacaaactgcacagttgaatttaagtccaataacttctaacatagcttcacatattttaaatatattcctttatttcaatgagtacaaattttgaagaaaatgtttactccatttaattatagaggtatttgatcattccatggacaaataattatgctttcaacttttacaattctgaaaatacttgcaaatgtaaatttgcattaataagaaaataaagctggatgtgttttcaacatgtagctttaagtatatatatattttaatggcctcagtgggggaaaatcattttaacttatgtaaatatccctttttgcctctcttgtgtcctataaagttgcccaacaagaggtcctcccataagatttggaaatcagaaaaggatgactcaatattctccattggtacctaaggcagacacaggaacagaggtgagggctggagaaacacctggaaggatgctgcaggaagctgagaacatcaacactcccacccctaagcttccagacaggactgaggaccacatggttagatagcccatacttcaagggcagatgcattctgttttctgagtgagcgccattcaatcctgcttctaatatcaactttcctgactactatatccttggctttgaaaggttgtagtctgaacgttaatcataggcatcggttcattcttgttatacccaaaagagccaagacacccagtggggaaaggcactcagggtgtaaaatattgtttctagaatgcaattgaaataggccctgttatcccatggaactaaggtttatggttttttgaataaacagaaattgactcccccagtcttaaaactcaagatagttacatttgtcttatctgagttcttttttcagtaaaccaaccatcaggcctcgtagatactatcaaggagctgaaacatacatatcactgaatccggacactgagacatcagaaccttcacccattatgattgcataactgacctcttgcttcctgttgaccaaattatcttccttacccctcccaaattcctgttttcccacattttgtccctgttatataaagtcttaattttagttggtcagggagatacattcgcaaatggtgtcccatctcctcggctgcagtacctgattaaagcctgtttcttggcaatacttgttttagagattggctttctgcgtggtgagcagcagggtgtacaatgaatccttggcattttagtaagaaaattctctgcaaccttcactgctttggcttcttgtaacctgaattcacatttaactgcaacttctgagacaacttgatataattgatataattagtgaatcctaattcactttgtccaccactgcttaccagtctgagcttgccagctcccaacccttactagtgccagtgaactttctgaaaatgcaaaaggtaatattttccctttttcataaaacactaaccttctcttcgtacttccaatatattgaagaccactgagttttcctgtgtgtccaatttggcaaacatttctttgcaaataaaacatgaaatttagagattccgctctacattttatttagacttcagtagtttagactctaattttctgtattaagacaattcctgcttagaatatctatagtggtttcttctctgttatttgaattccaaccaaagccctaaactagactccttaggtgtcaagatctctgcctttattaaatcaggagaggcattgttatgtctgtgcagctggggcttacaaagaaaaaggaattgggttgcagaggtgatttcaggtccccctctaccaacaccatcagagtgtggttgcatctgaggaacactctcaggcgatggaggcatcaggaggagcagctggggcagcccagcctcacacatttgcttccctgggggtttttgtttgggtgtgtaacactgtgggagggtaactataatactgttgacagtaataagttgcaaaatcttcagactgcaggcagctgatggtgagagtgaaatctgtcccagatccactgccgctgaaccttgatgggaccccactttgcaaagtggatgcagcatagatcaggagcttaggggctttccctggtttttgctgataccaggctaaataactgctaataccctgactcgcccgacaagtgatggtgactctgtctcctgtagatgcagagaatgaggatggagactgggtcatccggatggcacatctggcacctgagattggaaacataaaaacaaatgtccatacaattaatcatgttgtaagagaacttccctgaagggccaggctgtaccaagcacactgggctgagtaaattcctagtgttctccttccttacctgggagccagagcagcaggagccccaggagctgagcggggaccctcatgtctatgctgtgtcctgacagggtctgactcctgcatgaagtgtgtccagcctattaataagtcttcagggcaggaggttgagcaggggatggggctgactgggcacagctgcagggctggctcatctcagtaactcagcaccagctcagtatccccaggtgtcccaggaaagaccagggtagcacaaatttgtctgtggtgaatgtgtttctactggagagtagtttgttatgagaaacattttttatgtatttttttgaaaatttgaaatattcctcaggagtcgacggagtaatgtatttcattggcacatggggattatttggaatatcttgtttgtaggaaatacatagtaaaatgttaaacagtatgattctcaggacttcaaaagactctcatatgattcgggttagggaaggaggtactttgtcctatacttcaacatttctgtgagttttaacattgttcctttctaaaaatattaaaaataaaatttattgacatgatgctatacatatttgtaagtattaggtaatggtgttatgccattgttcttaccactataagatcaagcaatttactacagatacagagagatgataccgagtttcctcaatgcatgcagcactcacacatccaccattatcaagagctacaggtctctttaatacccagagactaaattcacttcaccttattcttgttttgggcaccttcattgtctaccttcttttctgtcattgagtattactttccaaagttcttctctcttattgagggtgaccactgcatggagcatgtccctgtcatgcaccaacaatgccactttcttcttttacgttttatcagggacatcatcctgacccagacaccatcctccctgttaacatctttaggaaagagacaatcccttatcaagcaattgccaacttacatggagaaatcagctggatccagatgaaactggacatggatttgcagtcattatatctcacatctctactgtgccaaaaatgtcccagcctggcttagtagcaggggacgtggatccaactacatcagcatcagtgggctgcagcctaggactccacaaaattttactgatgcctgactaggggagacaaatcacagtgctgtagcccatgcacaaaccttcctgctgctttgtaagccacctgaattttaagggaacttgcttatattgggagaagggaagaaagctccatttgtcctctaaatgtttgctgaaaatgaactgacaaaagaaagactaataagagaaaaggcaagcaaaattcacttaaagtgcagtgggatatcatagcggtgtgattactcagataactcaatgagatccagttgttcatacttcctttctagcgaagaggtaattgggaagtgtaggcaacctggagagaatagatgaggatagaagtgcatcctcaaaagaacaggtaatagcctgtctggataaagcatcaacttctaatctcttctatttttgattcctattttgtgttaatcttccctgatataaaatttcccaggaagaattttcttgacaatcagtttccttctggagaagctgcttttaagcagataaaggagtgagataaaggagtggagtgagcataccccaacagctaaaactcacaagttagaggatttataagtcagactctaagtctcagattttgtaccgccctcttgcttcataaaaatgctttgttattttttaaattttactttaaagaaggacaattttggagaatatattaatttttggtggaatgaataatgtccccaccccaaaagatatccaggtccttgtctctggaacccaagttttataggagttattaagaaattattttaggcagatagagaggaaaaggcatccttggtaagattttgtttcttttaaagcaactccagacatgtttcttgtctaataggaaagctccggctcttagagccaggctggcaagatttgatatgcaaatgaaggccattagaaactgggtccaccctaacatggctattcctaccttcttcttccttgcccctacatgtgcctggcaacatggctgcccccacatatccccatgtgtgtagaacattatgatgccctacatgtgcatattgaaaggctagggtgggagggccagtttttgctcaggctatgtgaataacatgcctggtcaaaccaatcccttgagccctttgcaaatcagacaccacctccttcattctcctcatataagcagccacttttccaccacagatggagttttctctttgttggaatcccctgtccctctgtctttgtacagggtagctgtttagctgttttattcttccttccttcttacatattaaacttttctctccttaaaaccactccacatctttctgtggcattttatccaaagcagtgtgaaacagcaagaaccctggtgttcctccagtcattggagccatatcataaggattctaccttatgatagatagcaaaaaatgaccttgatagatgtaagttaaggactttgagaataagcttcctggttatccagatgaaatcaatacaatcacaaaggtccttaaaatagaggaggaggattgcagtcagagaggagctgggacaatggggacggatgttgtttgaggaaggaaggggccatggaaccagaaatatgggagcacattgaagataagaagcagagaatccagttctctcctctggagcctccagaaggattacagccccactgacaccttagcattagctcagtgagacttctgacctccagaactacagggtaatacatttatgttgtgtgaagccaataagactgtggcaatttaaacagcagcgttggaaactaatgcaaggggaagagatgtctttcagctcactgagagcatgcttgtcctctgttcttggaaatatttccaccttgttatctggtgtcagacaagagacagagaaaattttttctgagagaagagctcgtacaaaaattctttttagctagaaattctctttggaaaatcccatgattatctcttatacgatctgggtatcacagagtttaggggtcagaactcacagcacatgataggaggaagagggttttgttagtttgttttcatattaggagggaaaattagattttcaggacacaatctgagagggacagactgggacagggatattgtaagagaaagaggagatgtggaaggtgtcagagcaatgaaacatgtgtccctgcttccaaatctaaaataaagtcattgattttagaaggtgaagcaaagctcttcaccttccatcttcttatgaaggatcaaattctacccagagttcctgtccctcctttactcccctgacattgtattgtggagctaatcacatgtgccttaatccctgctcctgtcccgggctgggagaggctcactgtcctcaccatgcccagcaggctagagctcatgccctagacaccaaaggagaagaggatggtttctgtacaggaggtaagagctttaccacatgttacatttcactataattctaagtaaagttgtgtggagagaagagaacatatgggcaactctgtctggtagagttggaagagggcagtttctgagagtgacaatgaattcacatttctaaattttcagatggcaaatgctagctttagcaattgtggaaatgtggactttgagtttaagaacaagacagactttcagatactgcaataaatgaggagacatttggaatagggtccttagcccagggctaaggtcaggctggcagtgcctgagagatgccaggcactggccctgggctgtggaggaagcagctgctctcctgagccacagggctgagaatctgggaggaaccacaggccctggccacagggctgcctggcagggcttcagggaaggaaactgctcacaaattcaggggagctgcattaagcatatatcccccagcctggcaagagtaaaagtctcagagacccagaccttagggctggtgctgggatcctgggctggctgctgtcagctctgccctccctggtgctgaatgactgggaccctgctggagccaaaaacggacagtcagcaaatgtccttaaagtctttactcagccagactctattctgcttggtcagaaaagaaacacacgctacacaaataagcataaaattatatgtatctgtaatatgaatttctattgtgaactttacatattgaatacatatttaagaaataagttgtatttatatatttgtatatactatgtatttatgaataaatatgtgatgcatgtttatatataaagagatataactttggttgctagtataaggtatagttttaaacttaaataaatttaacatgaacattgaaaatgagcactgggtgcaccacctcatggccctcctcactccaggacctgagggtcataaagctcagtaccctcttccatgttccccctgggctgagagaagtgaactgcccgttgctgaggatcatgagtgacctgaggggggtctacggaatcacagaacagcagatgcccaggaaatggatagtgggtctgggccctgaatggagggacgttttgtttccagagctcagcatagacaagtcctcctctggtcatttctgtcaaacaaagcagcatatatggctcagaggctgcattgtcacaggatgaagcccctccatggctcattccagcttcccctctgactggggtgatgtgggatctctgcccagctttcatggctcaccagctgctgggactctgttgacaatggcctatgtctgccccatgcacaagcttctcaatagttgccattttactttctggtctccaataaccacaacttgccaaccatgacccttccacaaagattcatagagtggggtcagaactatgggttcagcaacgtgccggggcatgcaggtaagagacacaaggcgtggccagcccgtgtctgaagtgaggatgaatttgcatcatgaattcagagtaggagatgggagaaaacatcctgacatgctccaggcagtgatgcccacaagatacactagaggtgcccatagaggaggtgggaaggggatttcaggcagaggggatgcgaatttagagatgtcccccagcctgttcccctgagaagatttcagacacttagtagcccctgggcactttgagagaccgaggagaaaggaccatgtaaggccaagaatttgatgccagcctgggcaacacagggagaccccatgtctacaaaacacacacacacacacacacacacacacacaatttgttaaaatgtgtgaaaaatagcatcacaaagtgattatgtatgaacatttgctcagaaaattagaaaacaaagcaatgtcttctgagctaacaatactataataaagatgtcaattttttagctatagtaatacagagaacatgatattgtctatcttaaccatttctaagagtgtagtgcaatgccattaaatatattcacattgctctgctattattactgatactaaatccagaaccattttcatctgaataaaattaatatctatatcctttaaacaatactcccccccatttcctctatccctaccgccagcaacctccattccagttctgtctctatgtcattgacatatttgaagcaggttcactctgcactggttaccaacatacttgagtgtggggaacacaacacccccacacagcaagttacatgaaatgggtttattatttacagataagcagcaagggaacaccacaaaagtcttggacttattatgggtcagtccctcaaggcacaggaaagccatgtggagctgatggagttgactatgtgtaccccacatgcaccacagctcaggaatccaggaaagcagccactcagggttttatatcctgagctaagaagacacacagggctaaagtgctaacggacatcctattctatgggaaactggtatagagcacaggtaggttgttctgctcagttcctctccatctcaggatgttacgattccagcaaattctacaattattcttgagaactcataaaataagcaagaaagtggagagaactaagtcagtccagggtcattggagaactgttttgcaattaccccaccacctagacatcccccttagcaaagctagcatatttcatatgcccaccaacttcccttgaactggaggcagaagtttatcttttcagattgatgaagcaccttgactaacacaacttcaatgcagattatgaagccatagtgagagtacatttcactgggccacgaaaagctagtaccactggtgtagggtccagccctgtggggcttagtgggggttctccccatgtgcagagatgagagattgtaataaagaaagacacaagacaaagagataaagagaaagcagcttggcctgggggaccactaccatcaagacgtggagactggtagtggctctggacggctgggcacactaatatttattacatacaagacaaggggggcagggtaaggagggtggatcttccaagtgattgataaggtgaagcaagtcacgtgatcataggacagggggcccttcccttttaggtagccgaagcagagagagagaagacagcatacgtcagcattttcttctacgcacttataagaaagatcaaagactttaagactttcagtatttcttctaccgctacctactacgaacgtcaaagaggaacccggagtatgggaggaacatgaatgtggacaaagagtgtgaccattgaggcacagcaccacagggaatggtttaggcttccggatgactgtgggcaggcctggataatatccagccttccacaagaagctgggggagcagagtgttccctgactcctccaaggaaaggagactccctttcgcggtctgctaagtaaagggtgtcttcctagacactggcattactgcttgaccaaggagccctcaagtggcctttatgcaggtgtgacagagggctcacctcttgccttctaggtcacttctagcaatgtcccttcagtacctgacactatactcttaggttattcctaggttatattagtaatgcgacaaagagtaatattaaaagctaatgattaataatgtttataatagtgattgataattgtccatgatcatctctatatctaatttgtgttatgactattcttattctaactattttctttattctactgaaacagttttgcctgcagtcttttcctcggcacctacgtaatctttcacacacacactggcaggagggtaagactccccaaagcagtgactaagatgttaagaagtgaaagggggatctttcagatgccctattctctgcagccagtgggcctgctttaggatcacctctacttgtatttctagaatacccgaggtgtttatccaggcacagcaggtagtattgggtgttggtaattgcgtggaaagtctccgttgggttcctcaagaatgtgcccattgtcatgcggattgggcggttgtttcttggtcagagtgaagtctcatggggtatccaaaaacatgacataaattcctttcaaaggtcaccatggtagccccagcatctaactgagtgacatacatttagctgtccaggaagcaagctatggccatagtccttttccctacacaggggatcctttaatagttctgccactcagttgctattttcctgaccagatggctgggttgttggcaatggcccatgatttagtggaaatggagcaaaatatagtgttgggggcagcctgcatggctactatcattgcatgaagtttggcccactgggcagaatgtccatgttcagtgtcagtcaaaagatgccatcccctggctggatggtggcctcacccagtggacccactggcatgtattttgtacaatcatcagggccccatgccatactgacataggcatgtctctgaatcgttggctcattgtggccaaaggaaaaacaaaattgtcccctatgggtcatttgttcccttctaggaagcttgctatttgtttatgggcattcatccatttgcacatggatcctgtgggaactgggttagggcgaattctgactgtaccagttccatttaataatttggatctgttgggcctgtccagttttattgattgtgtttgtaggcaccaaagtgagaatgggtagttaaggtagcagcgtcatccctgatgctctagctatgagataatcagcccctatcagtttcctacagcaagaagttgccattcaaaagaggcacaactggtggcttctgttgccacaggctccagtcagcatatatagaaatagtggacacctggatttccattgagcaagcagcctctgaaggtcttaaagaagtgcctcagtcatgccttgttgaacagattccaagggtgattttgactaacatgaccaaaagaacacccaggtaaggtttctactgtccccagtaccccaaaatacctactagcttctgggtctccatcttattagtggacgccaccaggaccagcaatgattaaatatacctgggatacctcctaggtttctttttcaggtggccttggcattcagccttcaacaatccatcattggtctgccaaactgggttgttccattgtgacaccaggctttgtgacattttaatctttttgtagcaactattaaatttactaggtagtgttccgatcttcactgaatatgcagtcctgctttgtgaacaacactctgggacacgggaagcttaggtggcaggcaggagtggatatgccccactgtcgtgtcttgaatacttagctatgagtgcggatagcccctcaggcagcagtgatgttttgtggcacagcagcaaaatgtcagtacctctattgcactctgcagtgagaaccatggtcaccagcacccaacatagcccaaagggtgtggtccacatgcagatcagcacacaagcacatactcaccatggggtcctcatttgtcttgacaccttctgatgtcttcagtttatttttttccagggaggacctggtaatattgtcaggtggattgcagcatacaaaaatcccagaatagtctgaattcttttttttttttttcaccttttatcttgagaggaatatagggctggtagcctctggtggagaccttggccctgttcctacctgtgccattcagacagacatttgggtctgcaatgtggcttaaccaaacaaacacaccgaccaggctgcataagacttccctcgtgtttttccatgtctcttttatagagagtgagcctccttttctgtgatggccattgttgttcattttggttccttatcagatgcttcagggaccattgagattatctttcttgtgtcatcttgggtgactcagggtccatctgattacccatgtcttgagctctcttgcctcaggaatgagcaatcatgcaactgtctaacaactagaaaattgtgtaccccattcctatttccacattcttttttctatgtctcaattcagtcagccagctgatccatattaatgggaggaggacaaatgtcctgtttatcctccctcctcattaaacatccatctgcatgtccagcccttgcatctccaggctgatatctctgtcctgggccaggtactggagagtattgttcctccaacttcaccataagccatagttctctcaaatcaaaccttctcactgcaccaattttgccaagaaggtttgctgtgcactggttgccaacttacccaaatctagtgagacagaacacccatgcacaaccagttacatgaagtggattactacttacagagagtcagcatgagagagcacaaagctgtcagggcctgattgactctagaccatacatacccaacaaggactgcagctgagggaccctggaatgcagtccaccctgggttttatgtcttagaatcacatgacacactgggctagagtgttgagggaattcctctttgtagtagggacagaaacagagcccaggatattttggccaatcttgttctagctcagaatgctacatttccagaacattctacagttattcctgaaaactactagcaagaaagggaaggagactgggttgattcatgactaaatggaaacttttctgcaaataccaaagtgaaatcataactcggtatttttgagactgggttatttcacttagtgtagtgtcctctagttttatccatgttgtagcgtgtgtcagaatttccctcagtaatgtgcttttgtatgtatataccacatatggattaccaattccttcctttgtgaacatttgagttgcttctaccttttggctactatgaacaattcggttctgaatgtgggtatacaaatacgtcctcaagttaatatcttcaattacttgggtatgtgtccaaaagtgtaattgctgagttatatagtatttctatttttatttctttgaggaattgccatcttgtttcccacagcaggtgggccatttacatcaccaagacagtgtccacaggagttccagttccctaaattctcaccaagactggtcattttctgttggaaaaaaatcctaatatgtgcaaagtggggtttgtttttatttttctaaggattaataacattgagcatcttttcttattctagttatctaattatctctaaagaatcttctttagggaaatgtctattcatgtacttttctcacttttaatcagttattttatttttactgttgacatgtagaaattatttttgtatagtagatattattaaccccttatcagatatgatttaaaaatatttttttctgttccacatgttgcattttcactgtgttgattatgtcttttgatgcccattttaaatttttatgaagtccaatttatcttcttttctacctttgcctgtattttggtgttaaaggtgttagtatttaaatgtctatacatactgacttactatactgagaaggtcacactccaccatctctctgatggtggagctaagagttttacactctcccattttgtaccaggggacagtgcagctatgtgagaacccagtgactttcccgagcttatttgtcttgcatttttggtgacatggattgttgttcacattggcttcctctggcaggtccacctgaaaagcattatatttagcaagaaaaacaggaggcagtgaatgatgtcactgtggattgtgtatattccctgttgcaaatgtcaaattcgtgaagcataaagggatttactagggatattaaattccttgcaaattgttgaaaagtcttaaggaacatgctcctggcaaagcctctagaacaattccaagaatggcactgctggtgcaggctggggaggagctcctgctgccttagactccacattcaagctgtctcctgcagaaaagagagcagctcttctcactactgcccccagaaggacagccgctctgctatcaactactagaaaactgacccctttctctgcatacctgcctgtgttgattacatcttcatgtcagtctcacatagattcatctgttttcaaggctgcagggtttatttctgcccaagtccatcctgtggctttctatcataagtacacatctttctacacttgaatttccaggcattactagtatcaaccacaacaggctacaatctaacataaatattttctttacaaagaacatcatgctaccaatgtagcactgtgctccccaaaatgtgaggaatctccaatctgttcagcccaacaccatccaggaaaaaatgatcttctctcatgagccattaatctgtgtacatattatttaatatgtggtctatattataaaggtggctaaaaatagcactttgatttttttaaagaaagggtgtattgaaaagactaaattatttaacatacatatatgaatggctcatttcgttattgtcaccagcttcttccgtatttattttattctctagtttctggcaataatttctctatggtagagtctggaaaggctattcctcatgtccttggcttcctaagtcccataggtggtgaagaatgcccatcagatgtgttactacagagtgcttttggattgagatgagggaggggaagtgcctgatctcactcaaatgtactcaatttcctggtctgggtcacagccaggcagcacagtcttgtgggcacagtatcttcacttgccatgtttctatcaaaatgagagtatcttccttcactgtggaaaacacggggtgggcagggtgagggaatagcaaagggagtacttggagatccctaagctgccactggtttctccaaatgttttcaatccatttaattcatgataataaacacctttctacctaaccagtcataatcgcttttctcagatccaactgattcagtgataaatctaaagagaaaaaataaatacacttttccacgtttaagctgaccatgaatgtttccacctccatatcccactatgcgtttcatcttccctttgcctcactggcgatccaagtgcaagtaatgcttcacatgactgtgatccctagaacttctacctgatgactgttgacgtcttctctgagttttaccagtggaaatggcaataaatagaaacattccagaaggtcccctagggtgcatattttctgtacttcctctctaagatatgtaaaatcaattccatttgctcttgctttatatgaactagacctatggccccagcaaacaaactaacaccctgtgttgacaacttatccagtattgtctttaagtctaaatggtcacatgcttatatcatttcttccaatttcttgggataattgtcatgtcaactctttggattaagaatcatcaaccaggccaggcgtggtggctcatgcctgtaatcccagcactttgggaggcagaggcaggcagatcacgaggtcaagagatcaagaccattcctggcccacatgttgaaaccccgtttgtagtaaaaatacaaaaattagctgggctacaggtggtgtaccccctgtagtcccagctactcgggaggctgaggcaggagaatagcttaaacctgggaggcagaggttacagtgaagccgagatggcgccattgcactccagcctggcagcagagtgagagaccgtcttaaaaaaaaaaaagaaccatcaaccagaaaaccacagccctgagaaaacagaaatagagtatttcaagctgttcagttggcgttaacaatggtaagtctacagctcattttcaagatatatatattctgtttaagggagtaaaagcacccatcacggttaatgtttcagagcctccaccacttctgatcgtatagtaattcaacagcacaagggtttgtgtgacagctttgcttgactaataataggtttttccctgtctatagggaaagttgcacctgtgcacaagacaagatcataagctacacttcgctcttcttttttgaggtaaataacttgcttgatccaaagccattttatggaagaatttcctgattctgatgaaagcacttggaaaatcctcaaataatattttatgcagaaacataaccgataagaatggcaaattcatatataggaaaataaccagtgctttccttatgttacatgaggtccactagtatcacctaataccagctgttagtctgagccctgatgtatcatacaatgttaggggttcttcttgacaaattagatgttcagaaaagccggtagccctgtaggtctcagttagttgaaagtcatattattgagccccccagagacctccataacattggttcatgatactccctgggaaagctgggaaaggtgactgactgaagtccatgtgttgaatcatcctcattattaaaagccccctgctcattaatggcattttgattaatactcacttggaaagcatttttttggattgtggctcatttttgaaacatctcatcatagctcttccagaatggctttgtctgcaatcatcctgttgtgtttcttttaagacctgatgatctgttaaaaccaaaggccaatattataaaaatcctcttctctttgcaatgggatcatcagatgtaaccttacagtttacccacggttaggatttttacatttccagggcttccttgacaatggcactgatgtgactccatccagcatctattgttgtgaggactctatctggcatatcatcattgtgggcatgaacataatggagattttcacaggatgcaatggttaatattcaacgttagtcaaaatttcttctagtcctacccttggagctctactgggttggaaaaatattttcatgtaaggacaaccatttggtagagttttaaaaataaaggctaccaataaattttctgtagcaagagtatgaactatttgtggtccagaatacaattttttatggaatgtaacaaaaattatttaaatgtattcaatgtagataataattttacaaataggcttatattgcatatataatagaagaaacacaattaaacataaatactatatatatgtagccattttaacaaataagtatatatttatttatacatatcttacatacatttatgcatatttttccacaaataaggtaaattttaattttttattgaaatattagttttaattttgtcattaattttcttttaataactttataatttgattactaaatattcacatttataccaccaatttaagaaaaaatacatgtgtgtatatataggtagaggtgtaaataatgtatcagggagcttttatgcataatgattggtaactggctaaatacacaactcagtgactgataacagtaaatatttgttttcatgttcatggatgctcatgttcacaatcatctggctgatcaaggaagggctcaggtaagtggtttctctgcatggcactgagcttgtcttcagcctatacatattaattgtcttaggacaaggctgaacagcagtgactacccatgactcaagattcttctggcaggtcacaagagtgaacaacatcccaaaccaaactgcacagctgagtttaagtccaataatttctaacatagcttcacacattttaaatatattcctttatttcagtgagtacaaatttttaagaaaatgttcactccatttaattatagaggtgtttgatcattccatggacaaataactatgatttcaacttacagtattgaaaatatttgcaaatgtaaatttgcattaataagaaactgaagctggatgtgttttcaacacgtggctttaaatataatatacttaaatggcctcatgggagaaaattcattttaacttacataaatatccctttttgcctctcttttgtcctatagagttgcccaataagaggtccttccatgagatttggaaatcagaaaaggatgactcaatattctccattggtacctaagacagacacagggacagggatgaggacaggagaaacacctgaaaagatgctgtaggaagctgagagcatcagcacccccacccctaagcttccagacaggactgaggaccacatggttagatagcccatactttaggggcagatggattctgttttctgagggagcaccagagaatcctgcttctaatgtcagctttcatgactactatatccttggccttgaaaggttgcagtgtgaacgttaatgtaggaattgggtcattcttgacatacccaacagagccaagaaaccaggagggaaagacactcagggtgtaaaatattgtctgaagaatgcaattgaaataggccctattatcccatggaagtaatgtttatggttttttgaataaacatagaaattgacttccccagtcttaaaactcaagttagttacatttgtcttatctgagttcctttttcaggaaacccaccaagaggcctccagatactatcagagagctgaaacttacatatcactgaatcaggacagtgagacgtcagacccttcacacattgtgattgcctcactgaccttctgcttcctgttgacaaaattaacttcattacccctccctaattcctgtttgcccacatttcttccctgctatataaccccctaattttagtttgtcagggagatacatttgagaatggggtcccatttccacagctgcagcacctgattaaagcctgtttcttggcaatacttgttgtcttagtgattggttttatatgtggtgagcagcaggatctacaccaaatccctggcatttcagtaacaagattctctgcaagcttcactgctttggcctcttgtaaccggaaatcaaattcaaccccaacttctgaataatttaacataattctaggattcagtttgtccatcagtgcttaccattctgagcttgccagctcccaaaattttctggagccaataaactttctcaaagagcaataggtaacattttccttttttcatgaaactctaagcttctctttgttctttcaacatattgaagaccattgagtttttctgtatgccccatttagcaaatatttcttagcaaataaaacatgaaatttgagattcatctctatatttttatttagacttccatagtttatactctatttctctgtatcaagacaattcctgcttagaatatctatagtggcttcttctctgttacttgaattccaactgaagccataaactagactcctcaggtgtcatgatccctgccttttttaaatcaggagaggaactgttatgtctgtgcacctggtgctgagaaagaaaaagaaattgggatgcagaggtgacttcacatccccctctaccaacaccatcagagtgtgcctgcatctgaggaacactctcagctgatggaggaatcaggaggagcagctggggcagcccggcctcacatgtctgcttccctgggggtttatgttcaggtttgtaacactgtgggagggtaactattaagctgttgacagtaataagttgcaaaatcttcaggctgcaggctgctgattgtgagagtgaattctgtcccagatccactgccgctgaaccttgatgggaccccactttgcaaagtggatgcagcatagatcaggagcttaggggctttccctggtttttgctgataccaggctaaataactgctaatgccctgactggcccggcaagtgatggtgactctgtctcctacagatgcagacaggaaggatggagactgggtcaactggatgtcacatctggcacctgagattggaaatataaacacaaatgtccatagaattaatcatgttgtaagagaacttccctcaagagccaggctgtacggaacacactgggctgagtaaattcctagtgttctccttccttacctgggagccagagcagcaggagccccaggagctgagcggggaccctcatgtccatgctgtgtcctgactgggactgactcctgcacaggtgtgaccagcctattaagaagtctttagggcagggggtggtgctctgggaacaagcaaatcggcagggggtggggcaggctggatacagctgcgtggctggcttatctcagtaactcagcacaggggcagtgtccccagtgtcccaggtcagaccagggcacctagatttgcctgcagagaatgtttcttcctaaaggatattttgttaccaagtacatttttgagcatttattggcaaatctcgaagtggttgtgagaactagatggaataatatatttcaatgccgtattgggcataagtaggagaatatccttgtttgtagagaattcttaataaagtcttagagagtggggctatcaggtcttcaacacactgtgaaattgttccagttgggagcgatactttgtgacatacatactacatttttgtaagcatgaaattgatctttttttaagtaaaaaagaacacttagtcatgagcaagtaaaatgttctcaaaagcattttgtaatggccctaaaccaatgttattaccagtctaagctgaagaggtttactgcagattgacaaagaagatgatattgggattccttaaagcatatgacatccacagttcctgcattgtccagagctataagtctctttaatgctcgagttttaatgggattcattttattctctgcttggggacccccatattctacccccttttctgtcattgtgaattatttcccatggtccatcagcataaaagtctgactagcaatgctaaatctgattactttaaaacaattttttttcttcttctactacaggagccttgattagcataaacttgaatctttgtgttagtttgcttaggataatggcctccagcaccatccacagtgttgcaaaagacatgatctcatttttcatagctgtatattaagtattccatgttgcatatgtaccacattttctttatccaatctacaactgatgggcatttaggttgcttccacgtctttgctattaggaatagtgcagtgatgaacatacacatgcatgtgtctttatggtaaaatgatttatattccttagagtatatatccaataaagagattgctgggtcaaatgatatttctgttttaagttctttgcaaaattgccaaactgctttttataatggctgaactgatttatattcccaccagcagtgtataagcattctcttttctccataaactcactagcatctgtcatttttaagtttttaataatggccattttaactggtgtaagatggtatctcactgtggttttgatttgcatttttttaataattagtgattttgagcactttttcatacgctttttggccgttaatatgcttttttgaaaagtgtttggtcatatactttgtccactttttaaaatagtttttttttgcttgttaatttgcttaagttagttggaggttttttaaggaaaaaaccagaataagagaaaaagaggaaaatataataccacagaaaacacagactgtggtaagtattgcctcatggatatatatgtgtgtgtgtgtgtgtgtgtgtgtgtgcatatatatatatatatttatgatacatgctgtgtttatgtgtataatgatgatccagaaactaaagggtgactggtttaaggactgcctatgttgcactgaggcttccttcttttcaaattatgaactaaagggtacagcagtacttgcatgactctcaaaaattctagcagcatgagatagaggtagaggagatttactgagatagatgcattggaagctgtagaagctcgtcctgtgctgttgtggatgttgtgattgtagtagttgttgttagtacagtgggagtaaaagcagcttgaagatttacaagctcttctcttcctcatacttacaactccctctagagatgcatcagtgattgtacaggcatctctgacacctctggagaaatcttgttagctcaatccagaatcttacctgataaatgttttgagtctcaaattatgtgaaactagggtgtagaaaaaggactagagcaagggaaaataatgttcatgcctgcacagtggttgtagacaggtaaatggggggctttataagtgtgatgatgtgccaaacctctgtcaccacggggagagaagcatcaaaccaggatcacttctggaagaatcattaggttattttagatggaaggaactgtgaattccttgccaaatagatttttaaaattcaaagctactcattacgtgttaatattatttaacttctttaaatataccatgtggtagagggcacatccactatttcaattcagggtttgtatgcctatgtgaattacaccattaaaaacacagcaaattccatattggttggggaagaatgtttgaacagtaatcaatttcgtgaagaagaggtttatgtcacagcactttccacagtattacatacaaaaacagtgaatgatctcatatccacaagaaccagcatttctcatgtgccacatatgccctcccagaaagaattgaagcctgtgacaagttgatgaaaggggtagaaaaaagaataaaaccccaaaacacagcactataaatggaaaggggaaaatcattgcagagcctatgattataaaaatacaaaaggtggatattctgagtatttttatggcaactagcttgacagaagtaacaataactttgtattataaatttacccagaacgaaatttccaattttatatctgcctgactggtgtcttgataccttatcaaaattacacaaattttcaagagattcaaaaagaataaatactcccaaacttatcatatgagatcaccatatactccagtccaaaaacaaacaaggacgtaacaaacggagaaattaaatgctggtatctcttgtgaacataaacacaaatattctgaaaaatagggaaagaaggaaaatataatcatttttatacctatatgtttgtgaacacacatggttaagtgtattacagtttttatgctaagaacacttgatatgtaattacaagttctaaaaaattgatatgaaacggaagatgtgacagttccattttcctaacttttaaaagaatatttcatcttatttaaatattatttttatttttgtatgactttttgttttgcttagacttttagttgaaatgaataatgaatgtgtattaaaagcctaccattttgatttaatctatgaagggtatttaaattctcattctatagaagaaaaatccaaactccttagaaaagagagatcttgccaagagctacacagttcttgtttcggagctgagattttctctcagatattctggctcatacaattttcagtacactacagatagaagatgcaaagacaacattacccaattggtcttgcacttactttgttcactgttaactaagtttactgaaaaaaaattacaataaaatacactgtcaaagaactgtcacaaataaatacatctgcagaaccacctccaaaatccagacatagaacatttctataactcccaaaagttttgacctactcttttggaatccacttgctttccaccacacagatcagggaattcttgatctgcttattgtcagtgcagattccaatttctttttaagggtttcatataaatgaaatatagcatgtgctcttttgcatctggtgaattttgtgcagcataactgcttctcagattcattgagatgtcatgtgttccagttatgtgctcctttttatttttgagtgttatttaactgtttggtaattttataatggatcctttcacctgttgattgccatgtaagttgtttccactttgggctattacggataaagctgctatgaatgttcttgaacaagactttgtatgaacatatctctttatttcttttgggctaattcctaggcgtgtagttgctgggtcttacagtaagtgtttaatactctgttcaactttttccaaagtggctgaaacattttacatgtccaccaataacttattatagctccacaccctccaactgctgttttgattttttttttaagatttcacctaattgtcactcaacagtaaccagaatagctagtgattattaagctatgtttttctgactattttcttgtcaattttggtggttgatgtgtttcaggatattgagaatagaatcaatgccatccaagctccttttcaaataattttatcaagccataatatttaagatggtaacaaggtatatacaaggtgtgttgggagtagtaataagtgttttcaacatttattattatcgtactccataaggcaatatgtcttcaatgaaatagtgtttaactagacttaggatagaaaggttctcatctcaaccctagtattcaatattaggaaaagtttaaggaaaaaaaaaaacatccaggaaaataagtcagagagtgttttgctagtcaagaaaaactgcaacactgatgctcttttaatgccagaccttcacaataatttccactcagatcatttggtggcctccttgccttgttctccttatgggacttcattctgagggcatgtgacatcacagagggagcagtgcacttgggtacagaaatatggcttaggggattgtctggccttagaggtggctgcaatggaatatacattttcaaggaagttccctgttaaagctgataaattgttagttaaggcaaggtgcaggggcttatgcccgttatcctagatgtttgcaaagtcaaggatggaggacagctgaaagccaggagtccaagaccagcctcgaaaaaataaggagatccccctgtctgtagaaaaaaaagaatgtttggtaagatgtggtgtgaacaatgacatctataagagattatttattaacatttgctcagaaaactagaaaatagaatgatgtcttataatccatcaatatcataataaaaatgctaagtttttcaactatggtaaatatagagaacataacattgcccatcttagccatttttaagtgtacagggcaatggcattaagtaagtcacattgttgtgctatcatcaataatagcaatctccagaactctttccatcttctaaaactgaaactctatttcaattaaatgacaaccctctccccatttcccctgcttcaagttcctggcaacctccattcaagttctgtctctatgacagtgactactctgaagcaggttcactgtgccctggttaccaacttatcagagtccagggagacagaacaatcatacacaacaagttacaagaatctggtgtagtatttataggtggccaacaagggactgcagaagcctaggatgtattgtgggtctgtcccctgaggcacaggcatgtgggtctgatggaatcttgactgtgtgtaccccagttggaccacaactcagcaaccccagaaagaagatgctctgggtttttaatcctggtgtcacaggacacatggagctaaagtactggaggactaaagtactggaggacagtactaggagaagctggaacaggggcaggctcttctgaccagtctctccctatttcagaatgttacatttccagcacattctacagttgttcttgagaagtgtaagaaagagagtggggagaactaactgagtcgagaaccattagaggactgtactggagtcacccccaacccaaacacccccgttagaaagccattccattttatatgcctactaataaccctgaactggtggcagaggtgtgtcttgtttgactgatgaagcccctcgacgaacacaatgtcaaagcaacatcatagagccagagccagaatagatttcactgggccaatgaaaactactaccagaggcaggatgatcaggcccacctgaagcagttatgtagcccaggatccaatgatccacagaagaagttgctaaaggggtgaaagaagaatccttcaggtgggaccattttcttcaattacgagcctgtttccagatctcctctcttgaatttctaggatacctgaggtgtttgtccaggtacaacagaaagtgttggaaattgtatacaatcctcccagttgggattttaaaaaagtctagagcaacactgttatctaaaacatccatcccgatggagttaagggatgtctgctgggctaccaaggcagtggctatggaggaggagccatatctgccatggtcagggacacatttcttatcatttctcttttttacatgagcactgactcctatacatagtaccaaaaatatcacaaaagacataaacccatagtctgttataccttctggcaggtccctagtaagtctgaggtacagctttgggctgcaggctcaatggttcacctaattccaaggagtaatatccagagacaagcccagcatgcccaacatgcagaatctcaccatcccacagttatccagagatggcatcacacatcctgcattttgttcactcccagaccattcacagagaaatatgtagcccttgggtgcatacagccccctttctcccattttattgtttaatcacccagtcatggttatgcaggtattggtgtgttcattagccaagtctcactgatggcagagttgaaggagcaaagttttgctcagacaatattgttcatagacagagggtagcattagtcctctccttgtttttgtctttgccattggggcatttcttatctatgcaatcaaagaaatatggtacatcaaaatatcagtccaccaatgttttttttagttgtggtcatgacatttgccacagagtcaatttagttaaatggggggcctccagttttctcccatgtggtaggtatcacatcctcagttggtaggccagtgcccgggtcctgttgatgtacaccatgatatcagtaatgttggtgtcatttgccttcagtagaatgaaaggaaacctctagttagtgacagaacgaggtcaagaatggcagattcagtattttgaaagattacactcggtgacttgcaagaagctaacaaagatgttatgcttctaggcctttgctgcctcattcttgccaaaatgcagtgtgacaggttagtgcatcatctctcacccatcccagggtctcaggtgtctcctacccatctacaagggttaggctgtgttggtgtaagaatgcggcctggctgtccttgctctgtgaaaaatccattgcctttgtcacttgacccagacatttcagtcctgattgtccactgcaggaagggagattatgccctgtaaaaacttgacatatttcataatatcaccaatactaaaggaaggataagatggccctggcaccagaagagggcccctagctccctgatatttcttagtcttgtcatccatcctgtgggatcttgtagaaaagaggcatttagaggaaacataatccccatattagagttagggggcctgtctggggtaagatgatggcctgaattgaaaatcaccccagggcatgcattctaaaggaaaaaaagaaaaagaatggttaggaacactgaaatagctttcacaggtccagactaataaagggtctgcctggtctaccttcgtttccactcagcattatgttccttaacattcattatttcccttgttctggagtgcgatatttaatgcccatattgctctagtaagatggggtaccaccccattagcagactttctagatgtcctttctagatgttgctgtgtgagtccattgttctagcattcactagattcattggcctgtggatgcagggtgcatggaaagttcatcgtgttccatgagagtgtgcctattgtcatgttgcttgggcagtgaaagatgctccttggtcagtgtgaagtgtcattgggtatccaaaaatatgatgtaagttcctttcaagggtgaccttggtagtcccggcatccaattgagcatcgtatctctttttcctgcaggtggaaagctgtggccatagtcctttcctccacaccagggattctttaaaagtccagtctctcagttgccattttcctgaacagatgttgaggctgttggcaatggcccatgatttagtgggaatgtggcatggtacgatgttggaacagcctgcatggccattaccactgaatgtagtttgacccactgggttgaaatcccatgctaagtttcagttaaaaaagtggccatccattggctgaatggtggccacacctggtggacctgtcagtttgcgttttcctcagccatcagtgactcctgccatatggaaatctctgaatcttgggctcgacatgggtaaatgaaaatccaaattatcacctacaagtcatttggtcccttcaacaacctctccatttgttcatggagccacagatcctgtggggtcctgactaagcctgatcaagaatgtgccatttccatttgataacctgactctgttgagattgttactgccttgaaagccaggcaggcgcttctcaactctgtgattcttcccaggaaatacgtgagaacttccatctgggttcatatctcaaacacaacccaccagtctctcacttgctgccctctgctcaaaatcttcacattgtaatttttcatggggtaaaaagttagcttatatattatcttgtattcattcaaattctgtttaaataacatacatatgttcctttattctttcgaactttgtccttatttttgaaacccagctttggagttcagaaagctacttttgtacttcaatatgctgtgagtgagactgtgcaaacactttagcaactaggtctttatttttgcatacatttgccacaacatatctagtaattaaaaaatctagactgtgaagagttttatttggcttctccctgaaaaaagtaggataaaatacagtgcttgctgctgttctggtcaagggtcggccttacaaaaagtggaggggggaggtggaggaggggagggaaactgatttaatatcaccagatcttatcaatgtacatgtactctggtaactgctaaaccaaatcaaaagaatgtgttagttttgtgttgccagtaatcagtctcaattaggtgcctgttatgcagaatgaatttagttgatgaatgaacatagggaaggaagagaggattagaatgagctctcattgagccttctcttctcttgtgtctcattgctcagagggcacgtggacctcctccatactgcagactctgtcatgcaaaggctgctgcagctgacgggaccttaaaatgtggtgcctgaggtgtagccaagaaatttatggtcatgagccctcagctgcaccaagtcctctgagttctccaacatcttggtctttaggcatctaagagaatccacagtgcctgctctccacagaaacagcacatctgggcagctaggccacagcaagtgggggggtttgtgttcaagactataccattgtgggaggataatgtgtactttgctggcagcaataaaccccaacatcctcagcatccatcctcctgatttcagcatgaaatctgtccccaacccactgccactgaacctgtctgggactccagggtcgtgattggaaaccaaatagattgggagccaaggaggctggcctgtcttctgtaggtaccagttgaaatagatgtatccattactgtgaagggggctgtgactagacctgcaggagatggaggctggctctccaggggtgatgggcagggagagtggaggttgggtcatcacagcatctccattggatcatgaaataatgagagagaagtgcaaggttatgtgcaaacattgtgagtcattttaatcattttctgtctgttatttatgttttgctcaattatttttgtgtgtgtgattttgattaatcctcccaaaacatacagatttaaaaagaaccaatatttacatatccttgctccttctggaatcttcctcactctcacagatctagacatcacatgccccatcctggaggacaagacacatctaacacgaggacaggacacacatgggaggtggcggggtccacagagttcaccctcccaccccatcatcctccctcatttcccttctgcccttaccagggacccagagcattagcagccccaggagctgagcagggagcctcactgtgagaaggtgaactgaggagtcctgatcagtcaaggcaaggttagagtgagctttcgtctcagactcacaaggaaagtcctccctaggggacagtatgcaaatcccctggtgggtgcagtggggtggaaagagccaaggagaaggtgggggcgtctcttgtgagcaaaatgacataaatatattttatgtttttaaggaaatcaatagaggtaaaatctgtgttgcctgagtggcagaagggacgtatttagattttcctgctgtttcctctactagacttctagttctttaggactttctcgggcatgttttatgtttctttttaataagcttgatctttcataaatatttgatgattcttatttctttgtttaggtttatttaaaagagtctaggtttgtttattttattttattttattttattttattttattttattttattttatctaaggtaaaacacacagtgcaaagggtgcaactcttaagggtgcaaatgaatgtcaagatccagatcatttcatatcatgatccacatagaaacgcagaaggtttccaattctctcgctgctttcattatgcaccttcccagtcaaaaactgctgctcaaaacacaatcaatgtaaatgatattctgacatataattgttttagtcctggacttaatctttatatcaggtaaagtaaacattttttgtagcttctttctaacttttttcattttttgaggccttggttccttcttgtcaatttgagttgctgtctgctgtcattctctgttattctgaagaattttctcttgaatctcttacaaggcatatatgctattaatgaattaatctttgtgtatgaaggaatatttctaccttgcttttatatttaaacgattgtttttctggatatagaatttgtggctgagaatttgtggctcagtatttaaaaatatcattccactgtcttctcacctccatttgtaatggtgaaaatttagccaatgattttaatattgcttcttagtataaagtaagtcggtattttagtgatgcatttcaaattctctgggtctttgtctttcaacactggtactataatgtgtatagttatgaattgtactgtgcttatcctaaaagggtttcactgagtttctttcatgtatagattaaggtgtctcatcactgtaaaaaatgtttttcattatttctccatttttttctttttcaatttttattttaaaatcagagcatacatgtacagatatgttacaaagttattttgcatgatgctgggatttggggtatgactgaacttattaaacaggtagtgagcactgtaccccataggtattttttcagcctctgcccttcctccctttgtctcccctctagtagttcccagtgtctattgtgcccatcaaccgtggattggataaaaaaaaaaactgtgtatagatacaccatggaatcctatgcagccataaataagaagaaaatcatggtcctgcagaaacttggatgcagctggaggtcatttacctaagtgaactaatgcagaaacaaaaaaccaaataccatgtgttctcacttataagcgggagctaaacatggggtacacatgggcgtaaagatgagaacacagtttttagcctcttcctgtcttctcctttgtgattcctaatacaaatttgttggtattgttcacagggacctataatgtctgaggttttattcattcttctttataatttttcccttctttatatgaggtcatttctattgacttctttttcagatcactgactctcgcgtcatgttaaattgctgttgagtctatctaatacatttttcaattgagttgtacctttcatttttcggattcccagtaggtctgttttcatagttttgtgtctgtttgagagcctctatttgttgaatcattgtctttacaaattcctttttaagtcttttattataggttaaaataattatttgaacatatatttgataagggtggagcacacagacaccatggagatggaccataaggcagggagctcagaattggattagttgaatttggagtctctgactagatggtgctcttgtgagatttaattattttccatgtttcatgtttctcacaatacaaatagcttttattttttaagatggtaactatgaacagaaattcagcttataaattcctgggaattcctaataggaaaattgatgaaaaaatggtttttcttaggcccccacacctgcctctgcctgggacctgactttgtctctgagccggcggaatctatgatgaggttttgagttgggcagtgaaatcatggcagggcaggctgtgctctgggtgctgtggagaacaaggggacactcctgcagggttagtgatgctgggagttcaaggggagactcagcatggagctgcctgttgagtcaccccagcaatcctgtctggacagtgatcatctcacaagtgtacttggatgccagtggatggcccaaatgtgggttcaggttggacaaggacaaagctttagggatgaacatatggggctcatttgatagtctgaagtttcagcacaagcgtaatgaatcatatgggaaaagaaaggagtcacaaggttgtgacttttcatttgatattaaaatatattccctctgctcatttttccctacagaatgtaactactgttacatatttaaccaaagtcattgtttttaattttcattttagtaactgacagcctgtgtgcagagttcctaaataactggaaagccaggccgtcattcctatggctgaagccaggaagtgactgtggatatgaagaaatgtgagtttcatgtacatgtctctaaagccacgggccactgatctggtgggaacctgcagtcatttcactttctcatacccagatgagaggacaccttgatctgtgttcatctgatgatctgatgaactctaaaaactggaccatattctgaaggtctagttcacacttcttttctgtgctagagggactctactcacatgtattgtacactctgcataggacagtctgtgatacatacaagtttttttctgctaaatactcatcaatcttgtcatttatgcatcttctatagttgttacctgacctatggctatggggtcttccaaaagaatgggccagaggtggagctgtgaaactgtagctgaataagaagtgtaagtgtcaagatagggtaaagaagtgttgataataataatatttcaaattagtctgggctcttggctgtgattactggtaagtgggaaagagtctaggtttgttttttttaagttttattttaattgataaagtagccagggtaaagtgcacaaatcttcaatgtgcaactgaataaagtttatgtgtaattcattgtccaggtggaatgatagaatatttcacatactcttgtgcttccctcatggacaatctttgtcagttttcgcccctcccacccagccatagtaactgttattctgacatctaacacaatcacttaggttttcctgtcttgaacttcacataaatagcattaagtgtatttttctctttttagccttggtattgctccttacaatgtttgaggccttcatttcttccagtggactcaaggtcctgtctgatgtcatttcctgggattctgaaggattttctctcaaatgtcttataagacatagctgctatgaatgaatgtacttttttatcaaagaaaatttttttttgctttttctttagatgtgaaggtattttcactggatatagaattcctagtgacttttttctcctttcagcatctaagtatgtcatttcactgcttctaatctctattggtcctaatgaaaacttagccaataacaatatgttgtttctgtgtattggttgggagatgatgtttgacagtgatcagtttgtgaagcagaggcttgtgtcacaatactttccacagtactacatttaaaaatggcgaatggcctttcattcttgatgcagtgaagattttctgtctttcaacattttaatataatgtgttcagttattaatttctattatctaaaagggttttattgaattttttcatctaagaatattttttattacttttgaaaagtttttgtcattatttctccaaggatttttttttcagccactttctctgtctctcctcctttgtgactctcattatacttttgttggtatccttcactctgagctataaatctctgacgtcttcctccttttttttaaacattttatttagactcaataagttctattcctttattttcaagttaactgattattctgccatctcaaattgctattagacctagctaatacgtatttaaattggattattttacttttcatttctagagttccaatttggtcattttttatattttccatatcttttcttgaggccctacttgccaaatcttcttaatattttcttttttatgtcaatgatcatagttttaaaaataattatttgaaaatctttgtagtctttactaaatccgataattacggcaagttagaatcagctttcgttgactattttctgttgtcattattgtagttgctttatttttgttcctttaatattggtcattcttctagtttttttcccaggagctgttaaactgacaattttacatttttgataatacagtacctctctttagattatgggttttttaattttaattttaattttttagaaatagggtcttactctttcacccaggctggagtatggtggtgtgatcatagcttgctgcagcctcaacctcttggggtccagtggttctccagcttcatccacctgagtagctgggactataggggcatgccattactctctgctatttttttttttttaaatagtaagatattttgcccacccagcctggtctcgaactcctggcatccagtgatccttctgcctcagcctcccaaagtactgggattacaggcttgagccaccacgtcaggcctggaatttgttttgtttttctgatcattttttaattttcttcttagttacttgggtgaacttactgatagtacctgacttatgatgcttggagttataactttttgactttcagatggtatgaatgtgatatgcattcaagtagaaatagaaattctagtatttatacaactattctattttctctttcaatatagtattcaataaatgacatgaggcattcaacactttattggaagataagctttgtgtaagataatgtcgcccaagtgtaagctaatgtaagtgttttcagcacatttaggataggataggctgagctataatgttaagtggattagatgtattaaatgcatgttcattgcatgatattgaaaaatctatctcacgtggtgtttgaccactgatatcactgcttccttttattcttaatattaatatttagtttgaatttataggaactgcacatgtatctgcatagtgaagtggtcaccaatgatttgagacgttttgcttaaatatctagaggttataaatctatcttctgtcaacccatctgtgtgtagtttaaaaagcaaactgcatgcaaaatgcagctagttcttgaatccttctggttttactttgcaccggaaactccttgttctcatcactcatatctatatcttctaggtcactaggaatgtgtgcagagattatttcagcaatatgggtctatctcatccaggaatctgctatttactatcagcagatgtactacttgcctcaaacaggtcatcatcttggacttgtaaagctgtgagatttttctgttcatttcctatggagttctgcatgtttagctggaaacactgaataattttttttccactccttggctttactcaagtccacccactttggcagcaagctgctagttttttttgctacgctcatattggtaaaacttcagttctgtaattcatgctgattgagctgggggtagaaggctgctgtcacaggcaaaaggctacagacattttctgtccttactcaaagcactggtactttttttttctataaagaatatgcatccttaattattttatacttcaccaattttcagagtgctgaaatagttttgatacttcagctttatatttaaatgtgtgtttgttgtttatttttgcaccgaagatttattaaactctttgtgatgccataaacagagatgccttctaaaatgcatttagttgaacataatagccacggtgaaatggtacgatgcaatggactaacataagtaattttggacttgacaacttgaactccaaaatggccaaatagagctgagatgctaacactgagtggccaccccactagctgtctgtaaaggaagcagctggtataataatctagtaaacactgatggtcttgttggggtttttgtttcatgtggaatcactgtgggaggccagttgctacgctgctgacagtaataaactgcaaaatcttcaggctctaggctgctgatggtgagagtgaagtctgtcccagacccactgccactgaacctggctgggatgccagtggccctgttggatgcatcatagatgaggagcctgggagcctggccaggtttctgttggtaccaggctaagtagctgctaacactctgactggccctgcaggagagggtggctctttcccctggagacaaagacagggtggctggagactgtgtcaacacaatttctccggtggtatctgaaattggaaataaaacagaaatgcactcatgtaatcaagatcaaaccaactgtctttgagtagagccaaaattgttgatatactttgaattttaattatatttcttgctgagcagaggtggcaagagttttcactaatgtgcaaaaccacctcatgttcccctcacctgggagccagagtagcaggaggaagagaagctgagctggggcttccatggttccctctgggtcctaactgagcagttcctccccagggctctgacacaggcattgatatgggctctggaaggtagggcagctgggagggacatgcaaagcagctgggtgggagctgagcttccagctgcagagaccacctgcttcttcctctctgcactgagcatcctgcgccaccctggttgtcaggccagaaaagtctgttggctcagtctgagtgtagaacttctcccttgtgctcagagaatttcattcctatgtctttcttctcctcaatcacctaaattcacccagatgatgtttggcacaagcctgttaagaacaatataaaaggctgtgttttcatttctctcttcctatcctcaatatgcccagtcatctccctaagtgcattattggatcgatggaaatgaggagtctgttagaacttaatcttccagatacacctttcatttgcttgttagtaatgttttctgagggtcctgaaactttccattaacccagacacataccctctttgagttaaaaagttaaaacttctgtttacagtcacatgtcctggcagccctgacatagatgctccatggcttgccgattgcttgaaattgaccaactaacttaacttccctgtgtctcagtttccatatctgtgtaactgtgacaatactggtgcctaccttacagtgctgtagacagtttaaagaaaataagataaaacatttacagtagtactcaggacattatgtatgcggcaattatttttgtttttattgattaaatatttagcactacagtcatcatcattatcataaatatacttacttggcacagaaaagagtcttcaatctaatccaagaatgttttatcaacagtcaaattaaattctagggctttttcttcactaactgtacacaactcttaaaatcctaatgatttggtcttaatctgtgctaaaatgctcagaccttcaatcattcccgcccatctctgtctaacgcattaattctcatcatccattatcaaaatgttatcctatgaaagtttcccatgtcctgctgctttccttctttcttacataatctttagtctaccttgttatcttttgtcttatttttgccccaggactgacaataaggaaaagctaccatcattacttgtggacttgctccagtataattttgtcaggcttgttatcttggaagtgaggactatgtcttgcaaagaaacatattcattgggtcaatgtgttatcaaataaaagattttatctacttatcatccaataattaatttagactgacttgaacagattttttttaaggacgaaaaggagaagatgatataagaggaaaatacaatacaatatcaaatgctagctattatgactcttgcttcatggatttttacatatatattagacacatggtgggtatatgtgtgcaatgatgatccaaaaactgaatgctgactggcataaggaatgcctgcattacactgagtcttgtctacttttccaattatgaacagaaagctgcagtagtatttgtatgagtatcaaaacttctagctgcctgagatagaggtagagcagatttactgaaataaaagccttggaagtaggagaggttcgtcctgtgatgatatggctgttgctctggttgctgttgttaggaaatacagtgggagtgaaagcaagtagaagattgacaagctctgctcttcctcatactcacaaccccctctagagatggacagatgctggtacaggaatctctgacacctctaaggaagtctctttgctttttccagaatctttcctgacaagtattgtatgagtcacagatgaggtggaagtgggtgtagaagaaaggactagagcgagggaagaagttttcagtcccaggtagttgttgttgccacggggaaactgaatttttcaaagatttgtgccacacttctatcgtgttggggagagaggcatcaaaccaggctcactcctgagagaatcattacattattttagagagaaggaactgtaaatttcttgtcaaatagatgtttaaaattcaaagctatcgagaccatcccggctaacaaggtgaaacaccgtctctactaaaaatacaaaaaattagctgggcgtgctggcgggcacctgtagtcccagctacttgggaggctgaggcaggagaatggcatgaacccgggaggcagagcttgcagtgagcgagatcgcgccactgcactccagcctgggcgacagagcgagactctgtctcaaaaataaataaataaataaataaataaataaataaatataaaaacattcaaagctactgattttgttgttgttgttgttgagatggagtcttgctctgtcacccaggctggagtgcagttgcatgatcttggctcactccgtttcccaggttcaagcgattctcctccctcagcctcccaagcagctgggattacaggtgtgtgccatcacacctggctaaattttgtatttttagtagggacggagttttgccgtgttggtcaggctggtctcgaattcctgacctctggtgatctgcgcgcctcggtctcccaaagttctgggattgcaaacatgagccactgccccggccctactgatgtattactattattcatcttcttgaatacagcaagtggtaaggtgcaaatccacaatttaaacttgagatttctactcctatgtgaattataccagtgaggaacagaaaaattctgtattgtttgggagatgatgtttgacagtgatcagtttgtgaagcagaggattatgtcacaatacgttccacggtattacatataaaaataacgaatggccttaaacccagaagagtctgcatttctcatgagccatactaccaccaagaaagaattgaattgaaactcgtgactacttgatgaagggtgtataggaagagggaaagaaaaaggacacaaaacataatattgtaaatggaaatgagaaagtcattacacagcctattagagtaaaaaaaataaagagaggctaaatgagtaactttttggcaactaacttgacaaaagtggtgcaatcttcacctcctgggttcaagcaattcttgtgactcagcctcccaagtagctgggattagaggcgtgtaccaccacttatggcccttttttttttgcatttttagtagagacatggtttcaccatgttggccaggctggtcttgaactcctgacctcaaacgatctgcccacctcagcctccgaaagtgctgggattacaggtgtgagccactgtgcccggccttaaagcagtattttcatttagtaaagtgtagaagaaaaaacataaataaagtgacaacaagaaaacaaaatgccattatgaaaaatggtaactttagggcagaaaacaagaaaaggcaaaccaagattctcataaggtaagcctccaatccacaatcctaggaggaatgtcaatgctgaaaaccctggagcatccagggagtggccaaaaatactaaatgctgaaaacccagagtacccgagtatcagcctatgagtgtccccacaccaaatgccaggaaaccctggaatatccaggggctgaccagtgcagaaaatcctggagcctcagttgggtggccaacagtgagccccaaaggcctgattgggaccacagaacaatgtgactctggcttcttacggccaacagaacaggagaattcttacatccaagtgtcctgccttaaacaattgcacaaacacaattagcagggagccaaagccaaaactgcaaagcaaacacatatatcagggcagaaaataagataaaatggctgatggataaataaaatggcattagaggagaaatgactaagagaaggaccaaggaggatgtagtcaggtgtgctatggaggacttcaaatggactatcgagtcaaaggccttattccctggatcatccaatataggtcaggtgggcagaggggacacttacaggtgtgcaggagccaaaatggtgccaagcagtctctaacgtggggcctgcgtgaaaatctctccaggctccccagcttgggtgggttgggctcctacggggaactggagcacggagcggctggcctgcatgaagcagtggctctgtggccacttgcccatccccagggctccaccgcctgtcaggaaagatgatggctcttaaaacagcctttggctagtgttaacagctctgcaatgttagcaactctgtagctttgatcgctgtagcactgatcaccgtctcaccctctctcactgatctctgtcttcccaattctccaatagctgtcctgctcattgctgaccgctatgtccatcttctcacaaaatcccatctcttgctgtctcttgttgtcttgctttctctgctgtttctgctgtctcactgccacatcagacgctgcctctcaccatctctagagttgagtggctggcttaatcctgatgcaaggcaagttcttggatttgctcgggaaagaacgttagagtaagccggtgattgaataaaacagctttattgatggggcagcagtgttacagctctgtgactaagcctgtggagcaggcataattcataggcagagggccaagagtagcagccaggtgcagttttacagtcacatttatacccacttttaatcatgtgataattaaggggtgggttatcgagaaatagctcgaaaatgggtcgtgttgccccaacttcccggtgttgccatggcagggcagcaatttccaggtgttgccatggcaaggcgctgcgacttctggatgttgctatggcaatggtaaactgtcatggtactggtgggtatgtcttacggagaggtgttttcagaatcctattcctgttttggccagcctcacatctggtccagagtgaagtgctgcctacctcttacctcaaaagtaacaagaaatctgtaataacaagttacccagaaaaaactccaaattttatttggtggttagtgacatggtacttatcaaaattacacaaactttcaagggaataaaaaaaatactcagaattattataggaggtcataatgtcctccagtccaaaaattaatgaggacataacaaaaaaaggatattaaaggctggtatctcttatgaacatagacacaaaaatcataagaaaaaataaaaatggaatccatctgtgtatctacacatttagtgaacacacgttgtaaaaagtgttacagtttttacgataagaactcttgataggtaattttaatttctgaaaaatttatatgaactataaggtatgttggatctctttccctaacttaaaaaatatttcctcgcatttaaatattttccaatttttaataactttttattacttagacttttagttgatataaataagaaatgtgtattaaaagcctaccattttgatttaacctatgaaacacatttaaattcttggaaaaatccaaaaatacctagaaaagtgagctcttgctagaagatacacagttctttagtgtcaggctgagattatctaccagaaataacttttggctcatgtagctttcagtacactgcaagaataaaagatgtgaagacaacattacttaattggatttgcaattactcactattcactattaaccaattttattgaaaaaaaatgattccaatcaaatactctgattttaaatgtactgttgaacaagtacactcgtgtaaatgcctccaaaatcaatacacacaacatttctataactccaaaaagttttgtcctgctcttcaggaatcaacttgctttccacctcacagaacagaccatccttggtcagcttattgttagtatagatttcactttctttttaagaattttacataaatggaatatagcacgtgttcttttgtggctggtgactttcatgcagcataattgtttcctaggctcattcatgtcgccctgtgtcctcatgatgtgttactcttcacttttgggtactatttaactgtgtagtaatttcacaatgtatcccaccacctgctgatagatatgtgggttgtttccactttgggctattatggataaagctaccaagaatggtattatacatggctttgcatgaatatttctttatttcttttaggcaaatacccaggagtgcagttactgggtcttacagcaagtgtttaatactccaccaaactgttttccaaagtagttgtaccattttacatctcagcccagaattgatgagtgttctcaatgtttcagctacttgtttttaagaatttttcttaatcttcactcaacagtgaccagaatggctaatcatcattaagtcatgttttccttacaattctcttgacttttatgggtgcttgacttgtattaggatattgaaaacaggatcaatattgtctaaaccccctttcaaacacttttcctaagtcatgatatttaggatgataagaggagatctaaagggactgctggtagtagtaacaggcattattcaatatttattatcatactccataaggcaatacattttgagtgaaatagcattcaattagactcaggataaaaagcttctaatctcagctttagcattaaatattaggaaacctttgagaaaacaatccaggaagacaaatcagagtgttttgctagtggagaagtgctgcaacacctaaaccctattaatgccagatctttgcagtgatttccactcataaagttgggttgactccttgccttgttctcctatgtgtctgtgtgacttcatgctgaggggatgtgacatcacagagggagaagtgcacttgtgtacagaaacatggcttaggagattggctttggaggtggctgcaatgaaatatacgttttgaagaagttccctatgaaatgtcttataaactgtttcttctggccaggtgctcgggctcacacctgtaatctcagcactttcagtgaccaaggagaaaggatcaggatcatgtaaggccaagaatttgatgcaagcctgggcaacatagggagaccccatgtctacaacacacacacacacacacacacacacacaatttgtgaacaatgtcatcacaaagtgattatttatgaacatttgctcagaaaagtagaaaataaaacaatgtcttctgagctaacaatactataataaagacgttagttatttaactatagtaaatacagagaatataagattgtctatcttaaccatacttgagagtgcagagaagtggcattaagtatattcacatgttctgccattattactgacataatcagtaaaaatcttttcatcttataaaaattaatatgtataccccttaaacaatactccacccattttctctatccctacctccagcaacctccattgcagttctgtctttatgtcaatgacatgtttgaagcaacttcgctgtgcactggttaccaacgtacttgagcgtgggggaagagaacaccccccacagcaagttacatgaagtgggtttattattacagataagcagcaagggaacacaaaattcttggactcattatgggtcagtcccccaaggcacaggaaagctatgtggagctgatggagttgactatgtgtaccccacatacaccacagtgcaggaactcaggaaagcagccactctgggttttgtatcctggggtaaaaagacacacagggctgaagtgctaatggacattctattctatgggaaactggtatagaggacaggtaggttgttctgctcagttcctgtctatctcaggatgttacaattccagcacgttctgcaattgtacttgagaactcttaaaataagcaagaaagtggagagaactaagtcagtccagggtcattgcagaacggtcttgcagttatctcatcccccttagcaaagctagcatacttcatatgcccaccaacttcccctgaactggaggcagaggtttatcttttcagattgatgaagcaccttgacttacacaatctcaatgcagattatgaagccatagtgagagtacatttcactgggccatgaaaagctagtaccactggtaggaggataaaactccccaagcagtgactaagatgttaagaggtgaaagggggatcttttgatgtcctattgtctgcagccagtgagcctgctttatgatcacccctacttgtatttctaggatatctgaggtgtttatccaggtacagcagccagtgttgggtgttggtaattgcatggaaagtccatttgtttccatgagagtgtgcccattgttatgttgattgggcagtgaggctgtttcttggtcagagtgaagtctcatggaatatccaaaaacatgacataaattcctctcaagggtggccatggtagccccagcatctaatagagtgacatatatttagctgtccaggaagcaagctattgccatagtccttttctccactcatgagatcctttaatagttcagtcactcagttgctattttcctgaccagacagctgggctgttggcaatggcccatgatttagtggaaatggagcaaaatatagtgttgggggcagcctgcatggctactatcatttcatgtagtttgtcccattgggcagaatgaccatgttcagtgtcagtcaaaagatgccatcccctggctggatggtggctgcacccagtggatccactggcatgtgttttgtacaatcatcagggccccatgccatactgacacaggcatgtctctgaatctttggctctatgtggccaaaggagaagctaaattgtcccctatgggccatttgttcccttctagcaagcttgccatttattcatggggcacatgggtcctgtgggatcctggttagggctgattctgactgtatcatttccacttaatgatttggatctgttgggcctgtccagttttattgattgtgtttgtaggtaccaaagtgagaatggttagttaaggtcgcagcgtcctgcctggtgctctagctctgagatactcagcccctatcagtttcctacagcaagcaaggagctgccattcaaaagaggcacaactgttggctgcttcaggaaattttgtgtccaaaatctgagtctggtgcacccagtgacagtagaatcacctgacatcagatgttagtctgagccctgatgtgtgatacaatgtgaagggttcaggaggggtcattcttcttggcaaattaggtgttcagaagagccagtagcactctaaatctcggttgggggaaactcaaattattgagtccccacagagacctccataacattggttcatgagactcccagggaaagctgggaaagatgactgactgaagtccatgtgttgaatcattctcattattaaaagcccctgctcattaatggcatttcgattagcatccacttggaaagcatttttttttttggattatggctcattttaaaaacatctagtcatagctcttccacaatgactttgtctgtaatcatcctgttgcatttcttttaaggcctgatgatctgtcaaaaccaacagccaatattattaaaatgttattctctttgcaatgtgatcatcagacataggccttgcagtttacccactgttttgatttttacatttccagggcttccttgacaatggcactgatgtgactccatccagcatccattgttgtgagaactctatttggcatatcatcattgtgggcatgaacataatggagactttcataggatgcaatgattaatattcaacattagtcaaaatttcttctagtcctacccttggagctctactgggttggaaaatattttcggacaaggacaatcatttggtagagttttaaaaataaaggctacaaataaattttccatagcaagagtatgaactatgtgtggtccagaatacaattttttatggaatgtaacaaaaattatttaaatgtattcaatttagataataattttacaaataggcatatattgcatatataatagaattaacacacttaagtatgagtactatatatatagccaacattttatcaaataatatattgacttgtatgtatcttacatacatgtatgcacattttcccataaatatggtaaattttaattttttattgaaatattagttttaattttgtcattaattttctaagtttataatttgattactaaatatttacatttatgccactaatttaagaaaaaatacatgtgtgtatatataggtagaggtgtaaatactgtatcaggaagcttttatgcattaatgattggtaactggctaaatacacaactcagtgacagaaaatagtaaacatttgttttcatgttcatagatgctcacgttcacagtaatctggctgatcaaggaagggttcaggtgagtggtttctctgcatggcactgagctcgtcttcagcctacacatatcaactgtctgaggacaaggctgaacagcagtgactacccatgactcaagattcttctggcaggtcacaagagtgaacagcatcccaaaccaaactgcacagttgagtttaagtccaataatttctaacatagcttcacacatttcaaatatattgctttatttcagtgagtacaaatttttaagaaaatgtttactccatttaattatagaggtgtttgatcattccatggacaaataattatgttttcaacctttacaatattgaaaatatttgcaaatgtaaatttgcattaataagaaaataaagctggatgcgttttcaacatgtggctttaaatataatttatttaaatggcctcatgggggaaaatcattttaacttacataaattctcattttgtctctcttgtttcttatagagttgcccaataagaagtcctcccatgagatttggaagtccgaaaaggatgactcaatattctccattggtacctaagacagacacagggacagacatgaggactagagaaacacctgaaaagatgctgtaggaagctgagagcatcagcacccccacccctaagcttccagacaggactgaggaccatatggttagaaagcccatacttcagaggaagatgcattctgttgcctgagggaggatcagagattcctgcttctaatatcagctttcatgactactatatccttggctttgaaaggttgtagtgggaaacttaatcttaggaatttggtcattcttgtcatacccaacagagcaaagaaaccagtggggaaaggcactcagggtgcaaaatattgtttctagaatgcaattgaaataggccctattatcccatggaactaatgtttatgtttttttgtataaacatagaaattgactcccccagtcttaaaactcaagatagttacatctgtcttatctgagtttttttttgtttgtttgttttttcagtaaaccaatgaacaggcctcccagatactatcaaggagctgaaacttacatatcactgaatcgggacagtgagacatcagaaccttcacccattatgattgcctcactgacctcctgcttcctgttgaccaaattatcttccttacccctccctaattcctgttttcccacatttcttccctgctatataaactcctaatttcagttggtcagggagatacatttgagaatggtatcacatctcctaggctgcagcacctgattaaagcctgttccttggcaatgcttgttgtcttagtgattggctttctgtggggtaagctgcagagtcttcactgaatccctggcatttcagtaacaaaattctctgcaaccttcactgctttggcttattgtaacctgaaatcaaatttgtccacaacttctgagataacttgatataattctaggattcattttgtccaccactgcttaccagtctgagcttgccagctcccaacccttcctagtgccaatgaactttctcaaagagccacaggtaacattttccctttttcataaaatgctaattttctcttcgttcttccaatatcttgaagaccactgagttttcctgtatgccccacctggcaaatatttctttgcaaataaaacttaaatttagagattcatctctacattttattttgactttagtagtttactttaattctctgtattaagacaattcctgcttagaatatctatagtggcttcttctgtgttatatgaattcaagctgaagccataaactagactcctcaagtgtcatgatctctgtatttatcaaatcaggagatgcattgctatgtctgtgcagttggggctgagaaagagaaaagaattagggtgcagaggcgatttcacgtacccctctaccaacaccatcagagtgtggctgcatctgagcaacactctcagccaatggaggcatcaggaggagcagctggggcagcccagcttcacacatctgcttccctgggggtttatgttcgggttggtaacactgtgggagggaaactgttagcctgttgacaatagtaagttgcaaaatcttcaggctgcaggctgctgatggtgagagtgaaatctgtcccagatccactgccgctgaaccttgatgggaccccactttgcaaactggatgcagcatagatcaggagcttaggggctttccctggtttctgctgataccaggctaaccagctgctaataccctgactcgcccgacaagtgatggtgactctgtctcctacagatgcagacacggaagatggagactgggtcatctggatgtcgcatctggaacctgagattggaaacataaaaacaaatgtccacacaattaatcatgctgtaagagaagttccctgaatagtaaagcagtactcagcacactgaccgagtataatcctagtgttctcctttcttacctgggaaccagagcagcaggagccccaggagctgagcggggaccctcatgtccatgctgtgtcctgactgggtctgactcctgcacagggtgtgatcagcctgttaataagtcttcaggtcaggagactgtgctctgggaacatgcaaatgagcaggggatggggcaggctgggcgcagctgcagggctggctcatctcagtaactcagcaccagctcagtgtccccaggtgtcccaggtaagaccagggtagcacaaatttgtctgcagagaatgtgtttctactgggaactattttgttgtgagtaacattttttggtttctttttgacgatttgaaatattcctcaggagttgatggactaatgtatttcattggtgtatggggattatttaggagaatattgttgtttgtaggaaacacatagtaaaatgttagacggtacaattctcaagtcttcaaaagactcttatatgattccggctagggaagggggtatttgtcgtatacatgcaacatttctgtgagtttaacattgttcctatgtaaaaaaattaaaaataaaatttattgacatgatggtacatacatttgtaagtatcaggtaatggtgttatgccattgttcttaccagtatgagatcaaactatgtactatagatacacaaagatgataccgtgttttctcgatgcatgcagcagtcacagatccacaattatcaagagcgacaggtctctatagtactcagacactaaatgggttgcaccttattcttgttttgggcaccttcatagtctaccttcttttctgccattcagtattatttcccaaagttcatctctcttactgagggtgaccactgcatggagcatgtccctgccatgcaccatcaatgacactttcctcttttactttttatcagtgattggggaaatcatcctgacccaggcaacagcctccctgttaactgctttaggaaagagacactgaatctcttatcaagcagttgcctatgtacatggagaaatcacttggatccagatgaaactggacagggatttgcactcgttatatctcatatctctaatgtgcccaaaaatgtcccagcctgactcagtagcagggaaagtggatccaactacatcagcatcagtgggctgccacctaggactccacaaaattttactgatgcctgactaggggagccaaatcacagtgctgcaggctgtgcacaaaccttcctgctgttttttaagctgcctgaattttaagggaacttgcttatattgggagaaaggaagaaagctccatttgtcctctaaatatttgctgaaaatgaatggacaaaagaaagattaataagagaaaagacaaacaaaattcatttgaagtgcagcagaatatcatagcagggtgattacccagataactcaatgggatacagttgtttatatttcttttctaaggaagagggaattgagaagtgtaggcaacctggaaagaatagatgagaacagaagtgcatcctcaaaagaacaggtcatagcctgtctggataaagcatcaacttcagtctcttgtattttagattcctcttttgtgttaatattccctgatgtaaaaattctcaggaagaatttttttgacaattggtttccttctggagaatctgctattatgcagataagggacatttaggaaaagtctttttgtgcatttggtgctttctaaatgtctttggttttacataatcatcataccagtgcagcgtagtttgagatgttattttctggattcctttacttgcaacccacctgccaagatcctgttccagagagatgcagctacagattgaatgagcagttgacccttgaacaacatggaggtttgggcactgaccatgggtgcagatgaaaacctgtgtagaacttttgcatttctaactccaggcatcatcttgaaagtggagaaagcagaccttaacctgcccatgtcttgatctttaatttcccattctccagaactgtaagaaaataaatttctgttccttatgaattacatagtgacaatgaatctgttatagcagcttgaaatagaacaagagagacagcgcacaatcagtgaggacacgatgaggtgtatacataccccagcttcctcatctctcaggtggaatagcccagaggaacttagtccatgtttccacatgtggttgatctttggttatcctgagtcaggtaggttgttgatgtgtctttttccattcatcttctgttctcttcctcactttcctcctttcctcccagtgtaaatttgctgcctaaacagggatcctcattgagggtggacccaaactaagatagttaaaaaaaaaaattgttaatcttttgtaagaggggtatttctcatctgaattctgataatttctttttctttgacatgtaggaatattcaggaggcacttaatttttttttttttttttaccaatctgttttacattcaatttgtgaactgattttgtttttctgtgtgttaaaaccaaaaattaagttgtaagccaccaacctgctgaatggactcctcttttgtaaagagcacttcaaagaaatttgaaaaactaggttaggccatgactggcaggtgggtttagatgtgcctcattatactttggagttcagacacaactgaccaacattgtcattacaacagagatctttgggctgacaaaacagacgctttgtagcattaagataccatattccaacatgacagataataggccctgaagaaaatctaaatattttaccttaaaaatatttcttcatcatattctgaagtggttctgcaaagctgccagttgtgggggaaatttgcattctatagagaatctcctccccttactaagtcttttttaaagtctgacattttttaaagctctgataagcaacattcaccttgtactttatctgctactgataggattcatctacatgacaagaaccttggcttccacatccccttttctacactcaagcatttctttatgatgaattcaactctttagacagaccttaactctttcaaccagtagccagtaaggaaagctttgaattcacctatgacctggaagcccctgcttcaagctatcccacctttccaggacaaactaatgtatatcttatatgtattgatttatgtctttccctgtatttctgtgtttccctaaagtgcttaaaaccaatgtgtaatccaaccgccttgggcacatgtttacaggaccttctaaggctgtgtcacaggccataagccttatctttggcagaataaccctgtaaattgattgagacctgtctcagatactgttttgtttatactgggtcacaaaatttaaaaatcctctaaaactatctacacatcaataaatctacattagagacagtggagtgagcataccccaacagataaaactcacaagttagaggaacctgagtctaagattttgtccacctcccttgattcataaaaatacttcgtgattttttaaattttactttagagaaggacaattttggggaatatgtttatggtcggtggaatgaataatgtcccaccccaaaggatgtccatgtcctcatctctggaacccaagtgttataggagtttttaagaaattattttaggcagataggaaaaggggtccttgggaaggttttgtttcctttaaagcagctctagaaacacttcttgtctagccagaaagccctggctcttagagccaggctgggaagctttcctatgcaaatcatagccattagaaactggattcacccaaacatggtgattcccaccgttttcttccttgtcaacacatgtgcctgggaaaaacctgaaagatgctataggaagctgagagcagctgcaaccccacccttaagctttcagacaggactgaggaccacatggttagatagcccatacttcagtggcagatgcattctattttctgagggagtaccagagaatcctgcttctactgtcaacctgcctgactactatatccttggctttgaaaggttgtagtgtaaaagttaatcataggaattcggtcattcttgacatacccaacagagccaagaaaccaggagggaaaaccactcagggtgcaaaatattgtctgaagaatgcaattgaaatagaccctattatcccatggaactaatgtttatgattttttgaataaacatagaaactgactcccccagtcttaaaactcaaggtagttacatttgttaatctgagttcttttttcaggaaaccaaccatcaggcctctagatactatcaaggagctgaaagttatatatcactgaatggggacagtgagacatcagacccttcacccattatgattgcctaactgacctccagcttcctgttgactaaattatcttccttacccctctctaattcctgttttccacatttcttccctgctatataaacgcctaatttattttgtcagggagatacatttgagaatggtgtcccgtctcctcggctgcagcacctgattaaagcctgttctttgacaacacttgttgtcttagtgattggctttctgtgtggtgagccgcaggatctatactgaatccctggcatttcagtaacaaaattctctgcaagcttcactgctttggcttattgtaacctgaaagcaaatttacccacaacttctgagataacttaatataattctaggattcagtttgaccaccactgcttaccagtctgagcttgccagctcccaacccttactacagccaacaaaatttctcaaagaacaataggtaataatttcccttttaataaaactctttgctcttccaacatattgaagaccattgagttttcctgtatgccccatttggcaaaaatttcttagcaaataaaacattaaatttatctgtacattttatttagacttcaatactttagactctaattctatctattaagactattcctgcttagaatatctataatggcttcttctctgttatatgaattctaaccaaagccataaactagactcttcaggtgtcatgatctctatctttattaaatcagcagaggcattgtaatgtctgtgcagctggggctgagaaaagaaaaagaaattgggatgcagaggtgatctcatatcctcctctaccaacaccatcagagtgtggctgcatctgaggaacactctcagccaatggaggcatcaggagaagcagctggggcggcccagtctcacacatctgcttccctgggggtttatgttcgggtttgtaacactatgtgagggtaattattaaactgttgacagtaataagttgcaaaatcttcaggctgcaggctgctgatggtgagagtgaaatctgtcccagatccactgccgctgaaccttgatgggaccccactttccaaactggaggcatcatagatcaggagcttaggagctttccctggtttctgctgatatcaggctaaagcactgctaatgccctgacttgcccggcaagtgatggtgactctgtctcctacagatgcagacagggaggatggagactgggtcaactggatggcacatctggcacctgagattggaagcataaacacaaatggtccacacaattaatcatgtagtaagagaatttccctgaatagccaggctgtactgagccccctgggctgagtaaactgctagtgttctccttccttacctgggagccagagcagcagaagccccaggagctgagcggggaccctcatgtccatgctgtgtcctgagtgggtctgactcctgcaagaagtgtgaccagcctattaagaagtcttcagggcaggaggttgtgttctgggaatatgcaaatgagcagaggatgggcaggctgggcacagctgcagggctggctcatctcagtaactcagcaccagttcagtgtccccaggtgtcccaggtaagaccagggtagcacaaatttgtctccagagaatgtgtttctactgggaactattttattatgagagacattttttaggttttttttgacaatttgaaatattcctcaggagttgatggagtaatgtatttcattggtgtatggggattatttaggagaatattcttgtttgtaggaaatatataataaaatgttagacggtatgattatcaggtctccaaaagactctcatatgatcccggttagggaaggggttactttgccctatacttggaacatttctgtgattttaacattgttcctttctaaaaaaaatcaaaaataaaatttattgacatgatgctatatatacatgtcagtattcggtaatggtgttatgccattgttcttaccactataagatcaagcaatttactacagatccacagagatgatgcctatgtacatggagaaagcagtttgatccagacaaaactggaaatgatttgcaatcattatatcgcacatatctaatgtgcccaaaactgtcccagcctagctcagtagcaggggaagtggatccaactatattagcatcagtgggctgcagcctagggctccacaaaattttactgatgcctgagtaggggagccaaatcacagtgccatagcccgtgcacaaaccttcttgctgctttgtaagccgcctgaattttaagggaacttgcttatattgggagaaaggaagaaaactccatttgtcctctaaatgtttgctgaaaataaactgacaaaaggaagattaataagagaaaaggcaaacaaaattcatttaaagtgcagcaggatatcatagcagggtgattacccaaataactcaataagatccagtagttcatatttcctttccagcgaagacggaattcggaagtgtaggcaatctggagagaatagatgagaacagaagtgcatcttcaaaagaacaggtaatagcctgtctggataaagcatcagttcccagtctcttctatttttgattcctgttttgtgttaatcttccctgatataaaaattctcaggaagaagttttttgacaattggtttccttctggagaatctgctttttggcagataagcgatgtttaggagaaggctttttgtgcatttgctgctttctaaatgcctttggttttatgtaatcctcatacgaatgcagcatagtttgagatgttattttctggattcctttacttacaactcacctaccaagatcctgttccagagagatgcagctacagactgaaagagcagttgacccctgaacaatgtggaggttggggcactgaccacaggtgcagatgaaaacctgtgtagaacttttgcatttctaacttaagtactaatagcttacttttgactgctagccttaatgataaaataaatagttgattaacacttttttaagttatttatatcatatactctattattccaataaactatgctaaagaaaaaaatgtaattaagtaaattataaaaatgagaaaatatatttactacttattaagtacttgcttacaggtgacacacacagaagaaaatacaagtggatctgcaaatttcaaacccaatttattcaagggttaactgtaccaggatgaatataggagtctctatctgtattctagggctttctctttgctgtacctctgctcacttccaatggcaatatacatgtcttatgttctttacagtcttgggcagagaactctgcctgcatgcattgctgaccaaatgacctggaatgtgtatctcttaggaaagtgctatggtttcactgtgtcctccagaatccatctgttgtaaagttaattctcagtgtaatggtattgccaattggggcctattgggatgtgtttagatcatgagtgtggtgccctctagtggaatacattaatgccagtataaacagcaattgtggggctgggatctctctctcttctgcttgtctgtcatgttaagacatggccttccttcctttgaaggaccccaaactccaggcatcatcttgaaagcaaagaaagcagaccttaacctgcccatgccttgaacttaaatttcccattctccagaagtgtaagaaaataaatttgtgttctttatgaattactcagtgaaaaggaatctgttacagcagcttgaaatagaacaagagagacagctcacaatcagtgaggacaggatgaggtgtatacatacttcagcttcctcatctctcaggtggaacagcccggaggaatttagtccatgtttccacaggtggttgatcttcagttctcctgagtcaggtgggttgttgatgcgtcttttacaattcatcttctgttcccttcctcactttcctccttttctcccagcgtaaatttgctgcctaaacaggaatccttattgcaggtggacccaaactaagacagtaaaaaaaaaaaaaaaaaaaaaatcgttaatcttttgtatgaggggtatttctcatctgaattctaataatttctttttctttgacatgtaggaatattcaggaagcacttaatttttctttaccaatctatttcagattgaatttgtgcagtgattttgtttttctgtgtgttaaaaccaaaaattaagttgtaggtcaccaacctgctgaatggactcctcttttgacagaaagcacttcaaagaaatttggaaaactagattaggccatgactggcaggtttagatgtgcctcattatactctcctccctttggagttcagacacaactgaccagcattatcattacaacagagatctctggactgatgaaacagatactttttagcaataagataccatactccaatgtgacagataataggccctggagaaaataaaaatattttatcctaaaaatatttctttgacatattctgaagtggccctgcaaagctacctgttgtgggggaaaattgcattctatagagaatctcctccccttactaagtcttttccaaagagtctgacatttttttctaaggtctgataatcaacattcaccatctactttatttactacccataggattcatctacatgacaagaaccccccattttctagactcaagcatttctttatgatgaattcaactctttaggcagagcttaactctttcaaccagttgccaatcaggaaagctttgaatccacctatgacctggaaacccctgcttcaagctatcccacctttccaggacaaacttatgtgtatcttatatgtactgatttatgtctttgcctgtaatttctgtgtctcctaaagtgtataaaaccaacgtaaaatccaaccaccttaggcatatgtttgcaggacctcctaaggctgtgtcacaggccataagccatatatttggcaaaataacctgtaaattgattgagacctgcctcagatagtgttttgcttacactaggtcacaaaattttaaaatgcctaaaccgcagcagcccggcattcctccaggacctcctcccccgggatcttgcttcaagtgctggaaatctggccactggaccgaggaatgcccacagcctgggattcctcctaagccgtgtcccatctgtgcaggaccccactggaaattggactgtccaactctcctggcagccactcccagagccactggaactctggcccaaggctctctgactgactccttcccagatcttctcagcttagctgctgaagactgatgctgcccaatcgccttggaagcctcctggaccatcacagacactttgggtaactcttacagtggagagtaagtccatccccttcttaatcaatgtggagtctacccactccacattaccttcttttcaacgacctgtttcccttgccgccataactgttgtgggtattgacggccaggcttctaaatctcttaaaactccccaactctgttgcgaacttggacaacattcttttatgcactcctttttagttatccttacctgcccagtttccttattaggtcgagacgttttaacaaaactatccacttccctgactattcctgggctacagccacacctcattgccacccttttcctcacttcaaagcctcctttgcatcctcccctgtgtctccctgccttaatccacaagtatgggatacctctactccttccttggcaactgatcatgcaccccttaccatcccgttaaaacctaatcactgttaccactagagcctgttatcacccacctgttacaacatggcctcttaaagcctacaaattctccttactgagggaagagagagaccctctcatattgttttatattgttttatactcagtacctgttttaagagtaaaaatcaaggaagtgaaatcagagacaggcagcccggcgccaggcctgggcctgcctggcctaaacctagtagttaaaaatcatctcatgacttagcaaccaatgttatccatagattccaagcattgtatgaagaacattgtgaaactccctgttctgttctgtttgactctgactaccagtgcatgaagaccctgttacataacccctagattgctcaatcaatcacgaccctttcatgtaaaatctttagtgttgtgagcccttaaaatggacagaaattgtgcactcaaggagctccgattttaagacagtagcttgccgatgctcccagctgaataaagcccttccttctacaactcggtgtctgagaggttttgtccatggctcatcctgctacattacaactcccctatcctacccatccaggaaccagacaaatcttacaggttggttcaggatctttgccttattaatcaaatcgtctttcccatccaccttatagtgccaaacctctacaccctcctatcttcaatacccccttccacaactcactattttgttattgacctcaaagtcaccttctttactatccccttgtatccctcctctcagcctctttttgcctttacttggactgaccgtgacacccaccaatcccaacaactcacctggactgttctgccccaaggcttcaggaacagcccacactactttggccaggccctttctcatgatctgctttcttttcacctgtctgcctcccaccttattcaatattttgatgatcttcttctttgcagtccctcttaccaatcttcccagcaggacactaccctgcttcttcaacatctctatttaaaggggtaccgagtatccccctccaaggcacaaatttcttcccctagtgttacctatctcggtataatcctccatcagcatacacatgcccttcctgcagactgtgctcagttaatctcccagacccgaatccccaccacaaaacaacaactcctttccttcttaggcattgttggatatttccgactctggataccaggctttgctatcctaacaaaaccactttacaagctcacaaaaggtaacttaactgatcccatagaccctaagttttttgcccattgttctttttgctctctcaaaaaggccctggagacagctcccacactagcactccccaactcgtcccatgctttttccttacacacagctgaaatacaaggctgcgctgctggagtcctcacacaggagccaggcccatgacctgttgcctttctatcaaaacaacttgacctcacaattctggtgcagccctcatatttgcgtgcagcagcagctgctgctgtaatacttctggaagccctcaaaatcacaagctatgctccacttaccctctacagttctcacaaccttcaagcattaatatcctcctcacacctttcacacttactgtctgcccctcgactcctccagctctattcatcttttattgaaaccccaacagtaactattggccatgggcacgatttcaacccagcttctcagttagtaaccaacacaagtcctgaaccacgtgactgcatttccctaatacacataggatcttcctcctttcctcgtatttctattcttcgaattcaaaatccagaccacccaatcaattttcaccaggtaagctggatatgctgtcatgtcccacatctctattattgaaactgctgcacttcctccctccaccacttcccaacaagccaaactgattgctttaactcatgtgctctctctcgctaagggaatgcacattaacatttatactgactccaaatatgctttccacatcttccataaccatgctgccatctgggctaaaagaggcttccttaccacacaaacctcttccattatctatgcctccctaataaaggtcctccttaaggctgctctcctgctggccaagcctggagtcattcattgtaaaggacaccagaaacctactcatcttattgcaaaaggaaatgcctatgccgacaggacagcaaaagaaatagccaatgcctccacacccgctaatattccagctcccactccagaggaccagtatttttcttccttatctatcactaccacctactcttttgaaagcctgctctactagtcttttccaactcagggaaagtgcttcttaaatcatggaaaattcattcttcctgcctcacaagctcagtccatgctttctttccttcatgaccacttccatgtgggatacaagcctctggctcgcctcctgcagcccctcatctccttctcttcatggaaatccatccttaagacagtcacctctcaatgctcgtctaccatgccaccagcccccaaggctttctcagccctcctccttttcctacgcatcaggctcatggatttactccaacacaagattggcagattgacttcactcatatgccccatatctgtaaatttaaatatctcctggtttggattgacaccttcactgggtgggttgaggcatttcccactatctctgaaaaggctactgcagtcatttcttcccttctaacagacataattccctgatttggcctccctacttctattcaatctgacaatggtttggcttttattagtcaaatcctccaagctgtctctcaagctcttgatattcagtggaaacttcataccccctaccatcctcagtcttcaggaaaggtagaaaggagtaatggtcttttaaaaacacacctcaccaagctcagcttccaacttaaaagggactggacagtatttctaccacttgcccttctcagaagtagagcctgacttcaagatgctacagggtacagtccatttcaacttttatatggacttactttcttgcttggccccaaccttgttccagacaccagccctctggacaactatcttccagtcctccagcaggctagacaggaaattcgcccgactgctaatcttctctttcctactccagattcccagccatatgaagacaccctagctgaatgatcagttcttgttaagagtctgagccctcaaactctacagcctcgatggactggaccctacctagtcatctatagcaccccaactgctgtccatctgcaggaccctccccattgggttcaccattccagaataaagctgtgtccattggacagcaagcctgatctctcctcttcctcctggaagttgcaagtactctccactacttcccttaaactcactcacatttctgaaaacagtaataacccttatgaacctaatatgttccttcattctattaggtctattcatccttactctactttttgcaacagggctttacacagtcacccccactacttggactgtgccccaaaacttgtcatccctactatcttctgtctagtcatactcctattcaccattctcaactactcataaatgccctgctcttgtttatactgctggtttacactgtttctccaaaccatcacagctgatatctcctggccctattgccaaaccaccactcttgacttcctcttggagtggatagatgatctttgctggcagggcacactccaatattttcaccatgatgaagtcctattctttatttttatactcactcttattctcattcccattcttatgccaccctctccctctccccaactatctccactacactatcagtctcactcactctctccaagccatttctaatccctccttagcgaacaattgctggctttgcatttccctttcttcctgcgcttacaaagctgtccctgccttacatacctactgggcaacatctcctgtctccgtacatctccgaacttcctttaacagccctcacctttaccctcctgaagaacttctttactttctagacaggtccagcaagacctccccagacatttcacatcagaaagctgctgcccttcttcgcacttacttaaaaaacctttctccttatatcaactctactccccccatatttagacccctcacaacacaagctgctattcctgtggctgctcctttatgtatctctcggcaaagacccactggaattcccctgggtaaccttgcatcttctcgatgttccttcactcttgatctccaaagcccagctacacataccactgaaacaattgtggctttccagctccatattacagataagccctctatcagtactgacaaacttaaaaacattagcagttattattgcttaggaagacattaccctgtatttcactccatcctttgctgccttccccttgctcttcagactctcctcccaggccctcttcttgtttgcttatacccagccccgtaaataacagtgaaaggttgctcatagacactcgacactttctcttacaccatgaaaatcgaaccttcccctctatgcggttaccccatcagtccccattacaacctctgatggctgccgcgctagctggatccctaggagtctgggtacaatacacctcttttagtactccttctcatcttttcactttgcagctccggtattgccttgcacaaggtctcttcttcctctgtggattctctacctacatgtgtctatctgctaattggacaggcacatgcacactagttttcctaagtccctagattcaatttgcaaatgggaccaaacagcttcctgttcccctcatgaaaccgacacgataaaaaagtgttattccactaattcccttacttgtcagtttaggaatttctgcctccactattgctctcggaactggaatagcaggcatttcaacctctgtcacaaccttccttagcctttctaatgacttctctgctagcatcacagacatatcacaaactttatcagtcgtccaggcccaggttgaatctttagctgtggttgtcctccaaaactgccaaggcctcgacttactgctgaaaaaggaggactctgtgtatttttaaatgaagagtattgtttttacctaaatcaatctggcctggtatatgacaacataaaaaaactcaaggatagagcccaaaaactcaccaaccaagcaaataattatgctgaacctccttgggcactctctaattggatgtcctgggtcctcccaattcttagtcctttaatacctgtttttctccttctcttattcagaccttgtgtcttccgtttagtttctcaattcatacaaaaccgcatccagaccatcaccaatcattctatatggcaaatgctccttataacaaccccacaataccaccctttacccgaaaatctttcttcagtttaatatcttctacactatgttcccatgccacccctaatcccactcgaagcagccctgagaaacaatgcccattctctctccataccaccaccaaaaatttttgccaccccaacacttcaccagtattttgttttttcttattaatataagaagataggaatgtcaggtctctgagcccaagttaagccatcatatcccctgtgacctgcatgtatgcatccagatgacctgaagcaactgaagaacaacaaaagaagtgaaaatagccagttcctgccttaaccgatgatattccaccattgtgatttgttcctgccccaccctaactgatcaattaaccttgtgacattccttctcctggaaaatgaatctcaggagctcccccacaaagcaccttgtgacccctgaccctgcccacaagagaacaaccccctttaactgtaattttccactaccctacccaaatcctataaaactgccccaccactatctccctttgctgactccttattcggactcagtcagcctgcacacaggtgattaaaaagctttattgttcacacaaagcctgcttggttgtctcttcacacacacatgtgtgacagattacagccctactgacaccttaacattagctcagtgagacttctgacacggggtactatattttatttgtgtgaagccaataagactgtggtgatttaaacagcagcattggaaactaatgcaaggggaagagatgtctttcacctcactgagagcatggttgtcctctgttcttggaaatatttccaccttgttatctggtgtcaattatgacatattttctagtatttaaagaaaagatctgctgccctaaaatcctatgtccagtaaaattattatttagaaatgaaggacaaattgagaagtcctcagttgtagaaaaactaagagtatttgctgccagcagatccactttaaacataggcaaaatgagccctaggaagataaaactaaagataaagagaggatgttaaataatgttagggacaaaaggctacaaaaatgagaagatagatggatataatgcattgctaaatcatgtgtgatagttgtatcaaagttgtaatactgttttgttcctaatatatgcagataaattacttttaaaaaacaatctatttacaatgggggaggaaacatgacataaaaaaggtaaaattctatatttattttaaatggtaatatattgatgccaacatactgtgagaagctatgcatataaaggaaataccatgacaaccaatttgaaaatcattataaaaagagataccccaaaattaggtaaaattaaaatgaaattgtgaagatgttcaagtaacccaaaagaaggcagcaaaaagaaaacagagaagcaaaaaaagatatagcaaaaaagtagagtgcagacttaaattttaatatatcaatatcaatatattaaatatgcaaattatgaaactttgaaaaagacaacaattgatgaataaaaagaaatgtcccaactgtatgttatctacaagacactcacatcaaatataacagtataagtagattgaatataaaaggaaggaaaatggtatactatgcaaacattaataaaaagaatcagtagcaaatactaatatcagataaagtagactacagagccaaagaatgttaccaggggcagaaaggtacattacataatgaagaaagtcattttggaaagaagacagagcagttctaagtgcgtagacaccaagcaacagagcgatatagtgcatgtggcagaaactaacaaaacaattgcacacagagacttcaaaaacccctttttaatcttcgataggacaactggacagaaaatcagcaaggatttaggactcaacaatatcatcaacccacgagatctaactgacatttatagaacactccaacccataacaatagaagttcacatttttttcttccaagtgcccacaacatataccaagataggacatatcctgcccacataacctctcaacatatttgcaataattaaaatcacagtgaatgtgttctctgaccatggagggatcaaactagaaatcaatattgaaaatgtaacccccaaattttcaaatatatgggaactatacaatattgttctttccaaagaaccagcctttggcttgcctggtgttcagtgtcactttttctgtttgcagttttattgatttctgccctaatatttattatttattttgctcatgttctacttcagatataaattgctcctctttatgtagtttcataaggtggaagctgagattattggttttatcccttttattttctgaaaaatactcatatgcatatgtttatctacgtgcatacacatgcataaatatgtgcagatgcatatgcatacacgtggttttaataccataaattaccctgtaagtgctgctgaatacctatgcgtattttcttttctctgagctcaaactccactcacttgcaaacctgcccacttaatctgcatgttcattggtgtctcaatctagaattgagcaaaaataacaaactcctttcattttatctcaactttcttgaccgctaatacatttaacatcagtaagtcagaatctatctaatagattaaggccaaagctgccaggtcactcctaatctgactcttctcacaccaaggagtgtaaatgacattgatttaaaaatatggtatcatctgcctatgtctccaacaatcttcactgccccaaaactagtttatgccaggatccactttgcccagataagcatctcttctgcttctcacagcccaattcgagtcattactttgctaaaaaataaatatgaccatgggggtactttggttaaaaaaattcccagaatgtcctgctgtacttacaaagcatttgctccccaaacagaaaatgaaggccttattaatttcacatcagtcacatgtggtgatctttaagacactgagagaaaatggctctgacctgccccctcacgaactttctcttttttacctcggttggttaagtcactctcctcatagtgcctttctctgtccttcacacgttcatactgtattccttctaagcgccttgattgtcatgaacctcagtgcccttcagaaacttctcttcaggtcagttgttctcctcatccaggtcagtcacctcctcagaaaaagtagcctctacctccctaactaactgactccttttcctcattaaccacttcctcttcccttgccatttttttcctttatgacccttaactttttctagaatctttttgttgatttatgtttaattagacatggcctttttttcaccagaaaagatataggtaaatgagagtcagacactgactttctcaggggtgcagcctagatacgttcctggtccagcatagttgctcaattaacactttattgaatgaatgaataatgaaaagttagtaagaaactctccaagacataatcaacactcataacctatacacgttgaaaacaacccactgaatgtaaaacatggattattctgagtaatgagaagtttgaatagcagtgtgctgctcttcatagtcagctcttcatagtcagtgtgctgctcttcatagtttgtattttgctggggagataaggaagacatccaaagtccatgataatcaggtaagagtattcttatcttttttaaaaaacaagcaaatagactttgcagtcacaaaaaaattgcaataaatgggactacactatcacttaactctattggctcctgttcacaaaaacaggttgtattattaactcttctttgaaaacaaaccagctccaaacaaaatgccataaaatgagtatgtgcagtcctccctcagtatccatgggaaatagtttccagggcaccctgcagatattccaatttttggagactcaaaacctttatgtaaaatgcacaatatttgcatataacctacacatatcctcccgtacatttcacaccatctctagcctccttatagtacctagtacgatgtctacacatgacttaacttgtgtagattcatccaagtgttactcagcacatggcaaagtcaagctttgctttttggaattttgtggatttttttttcaaaatatttttgatccaggattagttgaatccatggatgcagttcccatggatagagagctgactgtacagctccttataattctgagggtcagctctgtggttcttccattctgggctggctggactgatctctgctgagtccgctcttgtgtctgcagttaccctgtggttcatttgcgactggatggtctgatgtgacttctttaacctatctggaagctggtttgatgtgcaggttggacaacttttggtatcggtttacatgggtcaggaagatgggtcctattccccaatctgtattaggtttgttcccagatcaactctggggttcaagtctattcattgtgggttgtttgggagaaattctacatgaacaaagctgaactgctgtcatttattgctgttagcagttattgttatcctctgaaatgcatcttatataaccaagatctccccagggtggcccaacagtacagctcagctcagcccatcctgtcacttcgctggatgactgcaggtgtgagaaaggcaatatgctcagtcacaggaaaggcaggggcccaccctggggctgaaacctgcagacacagcgttcacacagcttctttgcaaaatacgaagacttcattttctttatacttaagatagttatacatttttttctataatgtccctatgctatttaactatttttaattttcagaactggttgtatttattatttctgtgttaggtgctcttagtcacttatggcaagagtgagttaatagagacaacatacagagtagccatggaacaatagagaagtgtgtgtattcagacaggataaagatcaaaggggtgacaaatacattcttttgagaagcagattctcatagatcaccacaagtcaaggtccacattcaaggtgcagtggcgtgtcagtcacattgtgcaaatggtcagctctgcacattaaacttggctagcacattgcaggaccaaaattacctgtaaaggtatggggaaaataaaccatcatggaaataacaatttgaaggagttctcaattatttatacttggatataaagcagaacgctacaatgaatgaacctacaacctaaaacctttaagccttttaaagaggtttctttttgtcagggtatttctcagcaaataatgataaaaaatttatggataaactacttgcacaattagccacaataaatcccttccctgtactcatcctttggttggcctcattctaaatggatgcaggtgttgcccatgtgtcttgctcaggccaataggataatagcagatgtgacacaagtggagtcttggaaagggcttgcacatcgaagctttcctctctctcacagtgcttggaaaccctaaggtcacaatgagaataagcctgtgcccatctacagtcaatgtcagtggcatggctgctcttcggtctactatttgttcttaaaatgtgtgctaagtttgttatggccatgtaacaaattaccacaaatttatcagcttaagactacacccatttatcatctctcaatttctgagtcagcagttggcacatggctttgtcgggtcctggccattggatttcacaagactgtgccacagtgtagattgggcttcattctcacctgtgagtcccctgagaacatagatactttagagctctttcaggtagttgcagagctcattccttagcatttctatgactcagggcttcaatttctaactggctcttggctcaaggctgctcttaggtccaagaggctgtggacaattccctgccatgtgatgctcacacaggcaatgcccacatggctggttgcttgttcatggtcagcagaaggtttcagagagtgtctctttccagtctgctatgacagaggcttatagaatacaatcattggaaagacatctcataacctatgacatatcatatggattagaagcaagtctaggttccgcttgctctctgtggaggtagattatacaattgtgtgattcactggggagagggttctgctagggtgttctggcatctttagtttcctcaaatatcaggtacttgtactgagtgtgaaatctgtcctgtacttactggcattgactagtcctgtgacccctgggaacatcttgggaagcatactttgtaagagaggttttagggtaacctagctattggaagcataacatttgcaaaatatcctaatctttgtgatttctaacatgtcctcaaggttccttaattgcaattatcataagccaattatctctaaatatccgcaaaatttatatttaatagtaggaaaatgatttattaaggagtctattaaacaagactcagggaaatgatgtcaacacccaattgctgctgcccactgctagactatgtgagacaattttcatgaacaatagaacagatactgcatgctagacacttctgtgagcaccactggcctgctacctctagaaatgtttgcagaacaagggcaattgctatgagtctcaaaatatatatttttttattatactttaagttctagggtacaagtgcacaacgtgcaggcttgatacatagggatatatgtgccatgttggtttgctgcacccatcaactcatcatttacattaggtatttctcctaatgctatccctcccactgcccccgaccccatgacaggccccagtgtgtgatgttcctcaccctgtgtccaaatgttctcgttgttcaattcccacctatgagtgagaacatgaggtgtttggtttcttttccttgtgataggttactgagaatgatggtttccagctttatccatgtccctgcaaaggacatgaaatcatcctttttatggctgcatagtattccttggtgtatatgtgccacattttcttaatccattatatcattgatggacatttgggttggttccaagtcttgctattgtgaatagtggcatgataaacatatgtgtgcatagtaccatgatttataattctttgggtaggtacccagtaatgggattgctgggtcaagtggtatttccagttcttgatccttaaggaattgccacactgtcttccacaatggttgaactaatttacactcccaccaccagtgtaaaagctttcctatttttccacatcctcgccagcatctattgtttcctgacttcttaatgattgctattctaactgacgtgagatgatatctcactgtggttttgatttgcatttctcttatgaccagtgatgatgagcatttttcatgtgtctgttggctgcataaatgtcttcttttgagacgtgtctgttcacatcctttgcccaatttttgagggggttgtttggtttttttcttgtaaatttgtttgagttctttgtagattctggatattagccctttgtcagataggtagattggaaaaattttctcctattctgtagattacctgttcactctgatggtagtttcttttgtcatgcagaagctctttagtttaattagatcccatttgtctatgttggcttttgttgccattgctttggtgttttagtcatgaagtccttgcccatgcctacgtcctgaatggtattgcctaggtgttcttctagggtttttatggttttagatctaacatttaagtctttaatccattttgaattaaattttgtataaggtgtaagtaagggatccagtttcagctttctacatatggctagccagtttttccagcacgatttattaaatagggaatacttccccatttcttgtttttgtcaggtttgtcaaagatcagatggctgtagatgtgtggtgttaattctgaggcctctgttctgttccactggtttgaatctctgttttggtaccagtaccatgctgttttggttactgtagccttgtagtatagtttgaagtcaggtagtgtgatacctccagctttgtttttttttgcttaggattgtcttggcaatgcgggctcttttttgattccatatgaactttaaagtagttttttccaattctgtgaagaaagttattggtagcttgatggggatggcattgaatctataaattaccttgggcagtatggccattttcactatattgattcttcctatccatgagcacggaatgttcttctatgtgttttgtgtcctcttttacttcgttgagcagtggcttgtagttctccttgaagaggtccttcacctcccttgtaagttggattcctaggtattttattcactttgacttaatctgtgaagtgtatttaaattctcattctagagaagaaaaatccaaagtacttggaaaagagaaatcttgccatgagatacacagttcttcagtttcaaagcagagattatctctcagatattctggctcatacaattttcagtacactgcaagacagaagatgtgaagacaacactacccaattggccttacacttgctttgctcactgttaactaagttcactgtaaaaaaaaaaaaaaagattacaataaaacacattgtcaatgaactgtcacaaataaatacatctttagaaccacatccaaaatccagacatagaacatttctatagctccaaaacattttgacccactcttttggaatcaacttgctttctgcctcacagatcagggaattttgatctgcttcctgtcagtacagatttcattttccttgtaagagtttcacataaatgaaacataggatgcgctcttttgtgtctggtgacttttgtgcagcatgactctttctcagattcattcagatgtcctgtgttctaattatgtgctcctctttatttttgagtattatttaactgttcagtaattttatgatggatcccttcatctattgattgccgtgtgggttgtttccattttgggctattatggataaagttgctgtgaatgttcttgaacaagactttgcatgaacatatgtcttcatttcttttgggctaataccaaggcgtgtagttgctgtgtttatcagtaagtgtttaatactctgtccgactttaccgaaagtggctataatattttatatgtccaccaataacttattatagctccacaccctccaaaatatttcaattttttttttaagatttcacctaattgtcactcaacagtaaccagaatagctagtgattattaagctatgtttttcttcccattttcttgtcaatttggggaattgatgtgttacaggacattgagaacagaatcaatactgtcctagttccctatcaaacacttttatcaagccataatatttaggatggtaacatgatatataaagggagtgttggagtagtaataagtattttcaatacttattatattccataaagcaatatatcttcaatgaaatggcatttaactagacttagcatagtaaggttctcatctcaaccctagtattcagtattagcaaaagtttgaggaaaaaaaatatccagcaacataagccagagagtgttttgctagtcaagtagcactgcaatactgatgctcttctaatgccagcccttcacaataatttccactcagaacatttggttgcctccttgccttgttctccttatgggacttcatgctgagggcatgtggcatcacagagggagcagtgcacttgggtgcagaaatatagcttagtagattgtctggccttagaggtggctgcaatggaatacacattttcaaggaagttccctgttaaacctcctggtaaactgatagttaagaccaggtgcggggacttatccccgttatcctagatgtttgcaagatcaagtagggagggtagcagaaatctaggagttcaagaccagcttggaaaacacagggagactccctcatctctagaaaaaaaacactgtttgttaagatgtggtgtgaacaatggcatctctaagtgattatttattaacatttgctgagaaaattagaaaatagaacgatgccttctgatccaataatatcataataaagatgtgaagtttttaaactatggtaagtatagagaacataaaattgcccatcttagccattttcaagtgtacaggacaatggcattaagtatagtcacattgttgggctagcatcaataatatccatctccagaactctttccatcttctagaactgaaactccatagccattaaatgacaaccccctccccgtttcccctgctcccagtccctggcaacctgtaatcaagttctgtctctatgacagtgactgctgtgaagcaggtttgctgtgccctggttaccaacctgtcagagtccagggagacagaacaatcatacacaacaagttacaagaatctagtttagtatttacaggtgaccagcaaggcacggcagaagctgaggatttattgtgggtctttaccctgaggcacaggtaagtggggctgatggaatcttgactgtgtgtacccctcttggaccagagctaaggaaccccagaaagaagatgctctgggttttaaaccctggtgtcacaggacacatggagctaaagtactggaggacttaagtacaggaggacagtactagagggagctggatcagaagccagtctgttctgacctgtccctcgctatttcagaatgttacatttccagcacattctacaattattattgagaagtgtaagaaagagagtggggaaaatcaagtgagtccaggaccatcagaggactggagtgaagtcgtcccccaacacagacatcctccgtagaaagctattccattttatacgcctaccaaccaccgtgaactggaggcacaggtgtgtcttgtcagacggatgaagcaccttgactgacacaatctcaaagcaacatcattgagacagagccagaaaagatttcactgggccaatgaaaactactaccagaggcagaatgatcaggcccacctgaagcagttatgtagcccaggatcccatgatccacagaagaagttgctaaaggggtgaaagaagaatccttcaggtgggattttctgaatctgcagaatccattttctgcaattatgagcttgtttccagatctcctctacttgaatttctaggatacctgaggtgtttatccaggtatagcagggggtattggaaattgtatacattcctcccagttgggattttttaaaggtctagagcaacactgttatcttaaacatccatcccgatggagttaagggatgtctgctgggttaccaaggcagtggctatggaggaggagcaatatctgccatggtcagggacaagttccttatcatttcactttttttcatgagcactgactcctatacatagtaccaaaaatatcataaaagacataaacctatcatctgttgtaccttctggtaggtccctagtaagtctgaggtacagctttgggcttcaggctctatgatttacctaattccaaggagcaatatccagagacaaccccagcatgcccaacatgcaggatctcactattccacagatatccagagatggcatcacatatcctgcattttggtcactcccaaaccgcttacagagaaagatgtagcccttgggtgcatacagccccccttttcccatttttcttcaatcactctgtcatggttatgctggtattggtgcgttcattagccaagtctcactgatagtagagttgcatgagcaaagttttgctcatacaatattgtctgtagacagagggctagcattagtccagtccttgtttttatcattgccattgggatgtttctcatctatgcaatcaaaaaagtatggtgcatcaaaatattagtccaccaatgttttttttaattgtggtcatgacattcgccagaggcaattaagttaaacaggggtcctccagtttcctcccatgtggcaggtgtcagattctcactttgtgggccagtgcttgggtccttttgatgtacaccttagtattaggaatgttggtgtaatttacccttggtagaatgaaagggaacctctagttaatgacagaatgaggtcaagaatgggagattcactattttgaaagatcaccctggtgacctaaaagaagctaacaaagacattgtgcttctaggcctttgctgcctcattcttgtcaaaatgcagcctcacaggttaatgcatcgtctctcacccatcccagggtctcaggtgtcccctacccatctacaagggttgggccgtgttggtgtaggaatgcggtctggctgtccttgctctgtgaacaatccattgcctttgtcacttgatccagatatttcagtcctgattgtccactccaggaagggagattctgccctgtaaaaactggacatatttcataatatcaccaacactaaagggaggataagatgtccctggcaccagaagagggcccctagctccgtgatatttcttagtcttgttatccatcactgtgggatcttgtagaaaggaagcacccagaggaaacataatcctcctattagagttagggggcctgtctggggcattgtaatggcctagattgcaaaccaccccagagcatgtattctaaaggaaaaaaagaaaaggaatggttaggaacactgaaatagctttcacaggtccagactaatataagtgtctgcctggcctacctttacttccacccagctctgtgtttctcaacatgcactatttccctttttgtggcccaggatctttaatgtacatatttctctagtcagatgggataccaccccattaacagactttgtagatgtcctttctgcatattgctgtgtgattccactgatctagcattcactaggatcattggcctgtggatgcagggtgcatggaaagttcatcgtgttccatgagagtgtgcctattgtcacgttgcttgggcagtgaaagatgctcctttgtgagtgagaagtctcatggagtatccaaaaatatgacataaattgcactcaagggttacctaggtagtcccagcatcaaattcagcatcatatttctttttcctgcaggtggaaagctgtggccatagtcctttccttcacactggggattctttaatagtccagtctctcagttgccattttcctgaacagatggcaaggctgttgacaatggccgaggatttagtggatatgtggcatggtgcgttgttgggacagcctgcatggccattaccactgaatgtagttttgcccactgggtagaaagcccatgttaagtttcagttaaaaaagtggccatccactggctgaatggtggccacacctagtggatctgtcagttagcattttgctcagccttcagtgactcctgccatatggaaatctctgaatcttgggctccacatgggcaaataaagagccaaattatcacctacaagttatttggtcccttctagcaagctccccatttgttcatggagccacagatcctgtggggtcctgactaaacctgatcaagaatgtgccatttccatttgataacatggctctgttcagattgttcagttttactaatggtgtttgtaagtatctaagtgagaatggacagctaagggaccagtgtcacagtcacacatggtgctgaagccttaacatgttcagtctccatcagtgcctaatagcaagcaaggagttgccattcaatataaacacattcagtggctgattcaggcaacttatgtgtcctaagattgagaggctggtgcactcattgatagttttctgttgctatacgctccactgagtatgcatagaggttgtggatacctggacttccatctggttagcaggctgtaaaaatcttagagaagtgactgggccaggccttgttgaacagattccaaggctactgttgcaaaacgcctttttcaaagttggcaactttgttcatgattttgactaagggaaccaaaagaacacccaggtgaggtttatgccgtctcccattcgcaaaggggcctacctgccactgagtctccttttattcagtgggtgccacagcgaccaatgtttccagctgttcagttggcataataattaactatgagtacacagctcactttcactatacatatattccttgatggaagttacagcatcatacatgattagcgtgtcagaaccttcaccacatctgatagggtatcaattcaattacctagggtttgtgtgtcagttttgcttgactaagaatatgttttctcctttctatagagacggctgcacctgtgcaggtgataagatcatgaactgcaccctttgccttacttttttgttgtaaataatttgcccgattcaatgccatattatggaagaatttcttaactgtgatgaaagcacttggaaaatcctcaaataatatttcatgcagaaatataactgaaagaaagacaaatgcatatacaggaaaacaactgctgctcttctcatgttggatgaggcctgctaaaaacacctgacaccagctgttagtctgatccttgatgtctggtacaatcttgggttattctccttggaaaagtggatgctcagaagtgccagtatccccatgagtcccagttaactgaaattcatattgttaagcccatgcatggatagtcatgacatcagttcatgagattccctgggaaagctgggaaaggtaactgatgaagtccatgttttgaattattttaattattttgagctcctgcttctaatggcctttagataaatattcacttggaaaggatttattttttctactggtccttttttggaaggtccagtcatatctcctccagagtgactttgtgtccaatccttcagatgtgtttcttctaaggcctgatgatctgtcaaaaccactagtcaagatagtgatattgttggtaatatccagagcggggagaggacaatagtactcccaatattgcgggaggtgtacacccctctttgtgttattgttcttaatatccagggggaaaacaggatgacgttactaccaatatcgtggggggtttacaccctcccttgtgagattcttcataatatccggcaggggggtggataggactatattattcccaatatcgtggggggtgtacacccctcttgtgatattattcataatatcctggggggagacgacaatattactcccaatatcgtggggggtgtacaccccttattttgatattgttcgtaatatccagggttggagaggacgccattacccccagtattgtggggagtgtacaacccccttgtgatattgttcgtaatatccagggagagaggaagatattactcccaatatcgtggggagtgtacacccccaacttgtgatattgttcataatatccaggaggggagaggacgatattactcccaatatcgcccgggctgtacacgcccccttgtgatattgttcgtaatatccgtgggggaagggaagatggtattacttccaaaatcgtaaacacattgtgtgtacacccccctgtgatattgttcgtaatattcggggtgggggggagaggatgacgttactttaaatatcgtaaacacgttgtgtgtacacccccccaccccacgatattgttcataatatccagggagagagaggagatgatattactttcgatatcgtaaacacgttgtgtgtacacccccctgtgatattgttcgtaatatccgggagaggagagtatgatattactcccagtatcacggagggtgtacaccccccgtgatattgttcataatgtccagtgggggagaggagatgtattactttcaatatcgtaagcaacttgtgtgtacaccctcctttggtattgtccataatatccagggtgggagaggatgatattactggcaatatctcggtggctttacacacccctgtaatattgttcgttaaggagttaagaggatgatattactcccagtatcgcgggggagtgcacgcctctgtgatattgttcataacatcttgggagagacaggaggaaattactcccaacatcgcggggcatgcacagccccctgtgatactgttcgcaatatccagcggggaataggatgacattactcccaatattgccggggatgttcaccccactgtaatatttttcttaatattcaggggggaaggatgatattaatcataacactgcggggggtgtacacccttctgtgatattgttcattgtatccagggatggttggagatgatattactttcaatatcgtaaacaccttgtgtgtacacccccctgtgatattgttcctaatatccagtgggggaaaggataatattactcccaacatctcgggaagtgtacacgtccctgtgatatttttcataatatccaggggggcagaggatgatattactcccaattttgcggggggtgtacaacccactgtgatattgtcgtaatatgaagtgggagagaggatgatgttactcccaatatcgccgggagtgtacacccccctgtgatattgtttgtaatatccagggggggattggaggtgatgttagtttcaatatcgttgacaccttgtgtgtacacccgcctgtgatattgttcgtaatattcagagggggagaggatgataatactcccaatattgcggggagtgtacaccaccatgtgatattgttcataatatccagagaggggagaggatgatattatgcccaatatcgtggggggtgtgccccccctgtgatattcttggtaataatcggggggagatgacattacttccaatattgtggggaatgtacacccccttttgatattgtttgtaacatttggaggggagaggatgatattactcccaatatagtggggggtgtaaaatccccctgtgatattgtttttaatatccggggggatttgagatgatattactttaaacatcgtaaacaccttttgtgtacacccccctgtaatatcgttcataatatccaggtggggagaggatgatattacgcccaataccacggggttgtacatacccctgtgacattgttcctaatatccaggggaggaggggttgatattattcccaatatctcagggagtgtacacctccctgtgatattgttcataatatccaggggtgattggagatgatattactttcaatatcataaactttttgtgtatacacgcccctgtcctattgtttgtaatatccaggaggggagagtatgatattactcccaatattgtggggggtgtacaccctcttgtgacattttttgtaatatctgggagggagaggatgatcttactcctagtattgcaggtggcgtactccctgccatgatattgtttgtaatacacagggctgccaggatgatattactcccaatatcttggcattgtaccctggcccagcatgatgttgttgttcgtaatacccaggcagggagaggatgatataactcctaatatcacatgcagtgtaccccctctgtaatattgtttgtaataccctgtggtggagaagataatattattctccatatcaggggtgatttactcctcttttgtgatattgttcctagtaccctgtggtggagaggatgaaattgctcccaatatcaccaccgatgtgacattgttcataatactcagggcaagtctttcctgtgtttgtcccatgatagggaataagtctcttgagatctgatggttttatgaagaggagttctgcacaagctctctctctttgccttttgccatccacgtaagttgtgtcttgctactttttgccttctgccatggccgtgaggcctccccagccatatggaagtgtaacttaattaaacctcttttttttggtaaattgcccagtctcggatatgtctttattagaagcatgaaaatgggcaaatacagtcaattggcaccaggagagtgggccgctattgaaaagatacccaaaaatgtggaaatgactttggagctgggtaacaggcagaggttggaacagtttggagggctcagaagaagacaggaaaatgtgggaaagtttgaaactccctaaagagttgttaaatggctttgaccaaaatgctgataatgatatggacaatgaaatccaggctgaggtggtctcagatgaagatgaggaacttgttgggagctggagcaaaggttattcttgttatgttttagcaaagagattggtgacattttgctcctgccctacagattggtggaactttgaatttgagagagatgatttagggtatctggtgggagaaagttctaagcagcaaagcattcaagaaatgactcaggtgcttttaaaggcattcagttacataagataagcagagcataaatgtccagacaatttgcagcctgccaatgtgatagaaaaggaaatcccatttctgaggagaaattcaggccagcagcagaaatttaaaaaagtaatgaggagcccaatgttgttaatcctcaagacaatggggaaaatgtctccagggcatgtcagaggtcttcatggctgcccctcccatcacaggcccagaggcctgggaggaaaaagtggttttgtgatccaggcccagggccttcatgctgtgtgcagactaaggacttgttggcctgtgtcccagctcttccagccatggccaaaaggggccaatgtagagctcaggctgtggcttcagaggccccaagccttggcagcttccacgtggtattgagcctgcaggtgcacagaagtcaagaattggggttgggaaaccttcgcctagatttcagaggatgtatggaaacacctggatgcccaggcaagaagtttgctgcaggggtggggtgccatggagcactgctagggcagtgccgaagggaaatgtggggttggagccaccacactgagcccctactggggcactgcttagtggagctgtgagaagaggggcactgtcctccagatcccagaatggtagatccactgacaacttacaccgttcacctggaaaagccacagatgctcaacgccagcccttgcaagcagccaggagggaggctgtactctgcaaacctacagggacagagttagtcaagtccacagaaactcacttcttgaatcagtgcgacctggatatgagacatggagtcaaaggagaccattttggaactttaggtttaactgccctcctggatttcagacttgtctggggtctgtagtccctttgttttggccaatttctcccatttggaacagctgtattaacccaatgcctgtacccacaattgggcctaggaagtaactatcattcttttggtcttacaggctcataggttgaagggtcttaccttgtctcagataagactttggactgtgaacttttgagttaatgttgagatgagttgagactatgggggactgctggaaaggcatgattggttttgaaatgtgaggacatgatatttgtgaggggccaggggcagagtgatatggtttggctgtgtccccaaccaaatcccatcttgaattctcacaggttgtgggaggtacccggtggttggtaattgaatcaggagggcaggtcttctctatgctgttcttatgatagtgagtaagtctcatgagatctgatggttttataaagaggagttcccctgcacaagctctctctctttgcctgccaccatccacgttaagatgtgacttgctcctccttctgccatggttgagaggcccccccagcttatggaatcgtaagtccattaaacctctttttttgtaaatttcccagtctcaggtatgtctgtttcagcagggtgaaaacagactaatacaggattcagacagatttagaattttaatggcttcttgatggatttaccaatttataattataaaatgtccattttatctcttgcgttaaagtcatgacctagtttctgttgctcagttttacatgatatgtacttttcatcctttcattttcaaagccattctatattcttactatagtgtgtatttaatgattaacatacatctttgattttaatcctgtctgataattttatgatttacttggaaaaatttgtttatttacgatgcaattattgtaaagttagggttaaacctaccgtcttgtttcctctgattttcttgattcatgctttcatttgaattagtttaattatagattttttcttatattaacttgctaaatatgcaagattattatacagaagatatcctcaacttattaatgcctaatacacatatagtgtattaaaatttctctctcaaattatttctaggtaagtgacacaagcagaatcaaccttcggaagatcatctatttcctgctgggttgacctggaatgtgtgatatgacctaaggtaacctttgagtcaccacacagacctagagctctgtgtgatgcagcacttcctcaggagcttgcagtggcatcagggcccagccttgaatgccaggcaggggtctctcgactctgtgattcttcccaggaaatacataagaacttgcatctgggttcatatctcaaacgcaacccaccagtctctcacgtactgacctctgctccaagtcttcagatggttatttttcatggggtaaaaatatggcttacatattatcttgtaattctgtttaagatggcatacttatgttcctttattctttcaaacttggtccttattgttgaaacccagctttggagttcagaaaactactttttacttcaacatgctgtggttgagactgtggaaagacttttggcactaggtctttatttttgcatacatttgcagcaacatatctagtaacttaaaaatctagaccgtgaagagttatattttggtactccctgaaaaaagtaggaaaaaatacagtgcctgctggtgtcctggtcaggggtctgccttcggaaaagtggtggggggaggtggaggaggggagggaaactgttttaatattaccaaaccttatcaacatacatatactctagtaactgctaaaccaaatcaaaagaatgtattagttttgcgttgccagtaatcagtctcaattaggtgcctgttacgcagaacgaatttacttgatgaatgaatgtagggaaggaagagaggcttagaatgagctttcattgagctttctcttctctcgtgtctcattgctcaaaggggaggtgtacctcctcctttttgcagactctgtcatgcaaaggccgctgcagctgatgggaacttaaaatgtggtgcctgaggtgtagctgagaaatttatggtcatgagccctcagctgtaccaagtcctctgagttctccaacatcttggtctttaggcatctaagagaatccacagtgcctgctctccacagaaacaacacatctgggcagctaggccacagcaagcagggaggtttgtgttcaggactgtaccattgtgggagaataatgtgtactttgctggcagcaataaaccccaacatcctcagcatccatcctccttattttaaacatgaaatctgtccccgacccactgccactgaacctgtctgggactccagggtccctgttggaaaccaaatcaatcaggagccgtggaggctggcctggcttctgtaggtcccaattcaaataggtgtatccattactgtgaaaggggctatgactggatctacaggagatagaggctggctttccaggggtgacgggcagggagagtagaggctgggtcacacagcatctccattggatcctgaaataataagagagaagtgcaaggttatgtacaaacattgtgagccattttaataattttctgtctgttatttatgttttgctcaattattttttgtgtatgattttggttaatactcccaaaacatacaggtttaaaaagaaccaagatttgcaaagcacaaataagcctctagaagtcacctatcccatccccctctttctgtgtcacagctttcactaaagtacatgtccttgctccttctggaatcttcctcactctcacagatctagacatcacatgccccatcctggaggacaagacacatctaacacgaggacagaacacacatgggaggtggcagggcccacagagttcaccctcccaccccatcatcctccctcatttcccttctgctctcagcagggacccagtgcattagcagccctgggagctgagcagggagcctcactgtgggaaggtgaactgaggagtcctgatcagtcaaggcaaggttagagctgagcttttatctcagactcacaagggaaggtcttccctaggggacagtatgcaaatcccctggtgggtgcagtggggtggaaagagccaaggagaaggtggggacctctcttgtgagcaaaatgacataaatatattttatgtttttaaggatatcaagagaggtaaaatctgtttcctgagtggcagaagggacatatttagatgtttcctgctatttcctctacccaatttctagttcgttaggactttctcaggcatgttttacacttctctttaataaggttgagctttcataaatatttggtgattcttatttcttggttcaggcttatttaaaagagcctaggtttgttttattttattttatttaaggaaaaacacacagtgcaaaaggttcaaatcttaagggtgcaaatgaatgtcaaaatccagatcatttcatgtcatgatccacatcaaaatatggaaggtttccaattctcttgctgctttcattatgcaccttcccagtcagcaactgctgctcaaaacacaatcaatgtaactgatactgtgacatctattataattgtttttttttcctgtacttaatcttcatatcaggtaaacattttttgtagcttctttcttatttctttcattttttgagggcttgattccttcttatcaatttgaattgctgtctgctctcattccctgttattctgaaggattttctcttgaattttccacaaggcacatatgctataatgaattagtctttgtgtatgaaggaacatttctaccttgcttttatgtttaaatgattgttttgctggatatagcatttgtggctgacttttctcccccagcatttaaatatatcattccactctcatcccacctctattagtaatgatgaaaatttagccaatacctttattattgcttcctagtatagagtaagtcagtattttagtgatgccttccaaattctctgtgtctttgtctttcaacattggtactataatgtgtattgttatgaactgtattgtgcttatcctagaagggtttcactgagttactttcatgtacagactaatgtgtttcatcattgtgaaaaatgtttttcattatttctccatttttttctttttcagtttttattttagaatcaaaccatacatgtacagatatgttacaaagttattttgcatgatgctgaggtttggggtatgacagaaattattaaccagttagtgaacattgtacccataggtagtttttcagcccctgccctttctccctttgtgttccttctagcacaatgtctattgtgcccatcaaccagggattcaataaagaaactgtggtatatatgcaccatggaatactatgcagccataaataagaacaaaatcttgcccttgcagaaacttggatgcagctggaggccattttcctaagtgaacagatgcagaaacaaaaaaccaaaaaccacatgttctcacttataagtgggagctaaacatggggtattcatgggcataaagatgggaacacatttttagcctctttctgtcttctcctttgtgattcctaatacaaatttgttggtattatacacatggacctataatgtctgaggttttattcattcttctttataattttttccttctttatatgagaccatttctattgacttgtttttcagttcactgattcttgtgtcatcttaaattgctattgagtctatctaatacatttttcaattgagttgttgtacttttcatttctagatttcccagtatgcttgttttcatagttttgtctctgtttgagagcctctattggttgaatcattgtctttacaaattcctttttcagtcttttattataggttaaaataattctttgaacatatatttgataagggtggagcacatagacaccatggagatggaccataaggcagggagctccgaattagattaggtgaattttgagtctctgactatatgatgctcttgtgggttttaattatttcccatgttttatgtttctcatattacaaatagcttttatttttaagatagtaactattatagaaattcagcttataaatccctggaaatttctaacagaaagattgatgaaaagagggtttttttaggcccccacaccagcctctgcctgggacctgactttgtctctgagccagtggaatctgtgatgaggttttgagttgggcagtgaaatcaccacagggcaggctgtgctctgggtgctttggatgacaggaggacactccttcagggtcagtgatgctgggagttcaaagggagactcagcatggagctgcctgtgagttatcccagcaatcctgtttggacagtgatcatctcacaagtgtgctcggaagccactggatggccaaaatgtgggctcaggttggagaaggacaaagctatagggatgaaaatataagactcatttgatactctgaaatatcagtacaaccatcatgaattatatgggaagagaaaggagtcacaagattgtgattttttatttgatattaaaatatgtcacctctgctcatttttccctcaaggatgtacctactgatatacatttaaccaaagtcactgtttttaattttcattttagtaactgacagcctatgtgcagagttcctaaataacgaagccagaccatcattgctatgggtgaagccaggaagtgactgtggatgtgaacaaatgtgagattcatgtacacgtctccaaagacagaggccactgatctggggagaacctgcagtcatttcactttcccatacccagatgagaggacaccttgatctgtgttcatctgatgaactctaaaatctggaccatattctgaaggtgtagttcacacttcttttctgtgctagtgggactctctcactgacgtgtattgtaccctctgcataggacagtctgtgatacatactacttgttttctgctaaacacccatcaatcatgtcatttatgagtcttccataggtgttacctaacctatggctatggggtcttccaaaagaatgggccggaggtggagctgtgaaactgtagctggataaaaagtgtaaatgtcaagaaagggtattgaagtggtgataataataataataatccaaattagtctgggctcttggctgtgattactggtaaatgtgaaagagtctaggtttggtttttattagttttatttcaactgataaagtagccagagtaaagtgcataaatcttgaatgttcaactgaatacagtttttgtgtaattcattgtccaaatggaatgatagaatatttcacattcccttgtgcttccctcatggacaatctttgtcagttatcacccctcccacccagcaaaattaactgtctttctgacatctatacaatcatttaggttttcctgtcttaaactttatataaatagcattaagtgtatttttatctttttagacttggtattgctccttacaacttttgaggccttcatttctttcagaggattcaaggtcctgtcttatgtcatttcctgtgattctgaaggattttctctcaaatgtcttgtaagagacatagctgctatgaatgaatgtattttgtttatcaaataatttttttgctttttctttagatttgaagggtattttcgatggatatagatttcctggttgcctttttttttcctttcagcatttaaatatgacatttcactccttctagcctctattggtcctgatgaaaactcagccaatggctatgttgttgtttttctgtatatagtatctgctttcattcttgatgcaatgaagattttctctttgtctttcaatattttaatataatgtgttcagttattaattcctattgattatctaaaagatttttattgaattttttcatctaagaattttttattacttttgaaaagtttttgtcattatttctccaaagatttcttcagccactttctctttctctcctcctttgtgactcttattatacatttgttggtattcttcactctgagctataaatctctgaagtcttcttttttttctaaactttttctttagactcaataatttctatacctctattttcaagttaactgattgttctgccatctcaatttgctattagacctagctaacaaatatttaaattggtttattgtacttttcatttctagagttccaatttggtcattttttatattttccatgtcttttcttgagcccctacttgccgaatcttctttttttttttaaatattttcttttttatgtcaatgatcatagatttaaacataattatttgaacatctgcatattaactgctttgtagtctttgctaaatccaataattgggacaagttagaattagctttcattgactattttctgttgttattattgtagctgctttatttttattcctttaatattgttcatacttctctgcttttttccagaagttgtgaaactaaaaattgtacatttttgatagcatattatagtagctgtctttagattttgggcttttttattttaattttaacttttttagaaatagggtcttactttttcacccaggctggagtgtggtgctgtgaccatagcttgctgcagcctcaacctcttggggtccagaggttctgcagcttcatcctcctgagtagctgggactataagggcatgccaccactctctgttatttttttttttaattgtaagataagagtgtcactattttgcccacccagcctggtctcgaactcctggcatcaagtaatccttctgcatcagcctcccaaagtactgggattacaagcttgagccaccatgtcaggcctggaatttgttttgtttttctgatcattttttaattttcttcttagtttcttgtctgaacttactgatagtacctgacttatgacagttggagttataatgttttgactttcagatggtgtgaatgtgatatgcattcaagtagaaatagaaattctagtatttacacaactattctattttctctttcaatatagtattcaataaattacatgaggtattcaacactttattgtaagataagctttgtgtaagataatgttgaccaacagtaagctaatgtaagtgttctgagcatatttaggataggataggctgaggcataatgttaagtggattagatgtattaaatgtattttcaatgcaagatatagaaaaatctgtatctcatgtggcgtttgaccacagatatctctgcttctttctgttcttaatattaatatttagtttgattttataggaactacacatgtatctgcatagcgaagtggtcaccaatgatctgagacattttgctcaaatatctggaggttataaatctatcttctgtcaacccatctgtgtgtagtttaaaaagcaaactgcatgcaaaatgcagctagttcttacctccctctggttttactttgcaccggaaactcctagttctcatcactcatatctataacttctaggtcactaggaatatgtgcagagattatttcagcaatgtgggtctatcttatccaggaatctgctatttactatcagcagatgtactacttgcctcaaacaaggcatcatcttggactagcaaggctgtgggctttttctgttcatttcctatggtgttctccctgtttagctggaaacactgaagaattatttcccactccttggcttcactcaagtccacccactttggcagcaagctgccagttttatttgctatccttacatgggtaaaactccagttctgcaattcatattgactgagctgggaatagaagggtgctgtcacaggcaaaaggctacagacattttctgtccttactcaaagcactagtactttttttttctataaagaatatgcatccttaattattttatgctttgccaattttcagagtgctgaaatagttttgatatttcaactttatatttataggtgtgtttgttgtttattcttgcacagatttattaaactctttgtgatgccataaacagagatgccttctgaaatgcgtttaaatgaatgtaatagccacactgaaatggtatgatgtaatggactaacataagtaattttggacttgagaacttgagctccaaaatggccaaatagagcagagatgctaaaactgagtggccaccacactagctgtctgtaaaggaagcagctggtataatctagtaaacactgatggtcttcttgaggtttttgtttcatgttgaatcactgtgggaggccagttattatactgctgacagtaataaactgcaaaatcttcagactgcaggctgctgatggtgagagtgaactctgtcccagacccactgccactgaacctggctgggataccagtggccctggtggatgcaccatagatgaggagcctgggagcctggccaggtttctgctggtaccaggctaagttgctgctaacactctgactggccctgcaggagagggtggctctttcccctggagacacagacagggtggctggagactgcgtcatcactatttctccagtggtatctgaaattggaaataaaacagaaatgcactcatgtaatcaaaatcaaacccactgtctttaagtagagccaaaattgttgatctacattgaattttaattatatttcttgctgagcagaggtggcaggagttttcactgatgtgcaaaaccacctcatattcccctcacctgggagccagagtagcaggaggaagagaagctgcgctggggcttccatggttccgtctgggtcctaactgagcagttcctccccagagctctgacccaggcattgatatgggctctggaaggtagggcagctgggagggacatgcaaagcagctggggtgggagctgagctttcagctgcaaagaccacctgcttcttcctctctgcactgagcatcctgcgccgccctggttgtcaggccagaaaagtctgttggctcagtctgagtgtagaactcctcccttgtgctcagagaatttcgctcctgtgtctttcttctcctcaatcacctaaatccacccagaagatgtttggcacaagcctgttaagaacaatataaaaagctgtgttttcacttctctcttcctatcctcaatatgcccagtcatctccctaagtgcattattggatcgatggaaatgaagagtctgttaaaacttaatcttccagatacacctttcatttgcttgttagtaatgttttctgagggtcctgaagctttccattaacccagccacataccctctttgagttaaaaagtgaaaaacttctgtttacagtcacatgtcctggcagccctgacatagatgctccatggcttgccgattgcttgaaattgatcaagtaacttaacttccctgtgtctcggtttccatatctgtgtaactgtgacaatactggtacctaccttatagtgctgtagacagtttaaagaaaataagataaaacatttacaatagtattcaggacattatgtatgcggcaattaattttgtttttatttattaaatattcagcactacagtcatcatcattatcataaatatacttacttagcacagaaaagagtcttcagtctaatccaagaatgttttatccacagccaaatttaattctaaggcttttccttcactaactctacacaactctttaaatcctaatgatttggtcttaatctgtgctaaagtactcacaccttcaatcattcccacccatccctgtctaactcattaattctcatcatccattatcaaaatgttactctataaaaggttcccatgtcctgttgctgtccttctttcttacacaatctttattctaccctgttatcttttgtcttattcttgccccaggacaataaggaaaagctaccatcattacctgttgacttgctccagtataattttttcaggcttgttaccttggaaatgaggactatgtctggcaaagaaacatattcatcgggtcaatgtgttatgaaataaaatattttatctacttatgatccaataattaatttagacctacttgaacggtttttttttaatgaacgaagaagaagatgatataagaggaaaatacaatacaatagaaaacacaagctattataactcttgcttcacggatttctacatatatattagacatatgctgggtatatgtgtgcaatggtgatccaaaaactgaacgctaactggctgaaggaaagcctgtattacattgggtcttgtctatttttccaattatgaacagaaagctacagtactatttgtatgagtatcaaaccttctagctgctgtgatggaggtagagaagatttactgagactaaagccttggaagtactagaagtttgtcctgtgatgttatgggtgttgctgtggttgttgttgttaggaaatacagtggaagtcaaagcaagtagaaaatttacaagctctgctcttcctcatactcacaaccccttctagagatgacagatagtggcataggaatctctgacacctctaaggaagtcttttttgctctttccgggatctttcctgacaagtattgttttgagtcacagatgatgtggaagtaggtgtagaagaaaggactagagcaagggaagaagttttcaatcccaggtagttgttgtaggcacagggaaatggaatttttcatagatttatgctacacttctatcatgttggggagagaggcatcaaaccaagcttattcttgaaagaaacattacattattttaaagagaaggaactatgcatttcttgtcaaatagatgtttaaaattcaaagctacaatttttttttttgacagtatcttgctctgtcgcccaggctgtagtgcagtggtgcgatcttggctcacggtaacctccatctccctggttcaagtggttctcctgccttagcctcccaagtagatgggattacaggcatgtgccaccacacccagctaataacaggagggagtaaagggccacacaagcatgtacacaagagacaacttttcttcttttttacagaataagtctaaatgtaaaatagcgttataatgtatggactcatgtttaagacaagtctcttggttttctaatttgtgttgaacccaagcagtgttgtgatagaaaatgagtttctttttctttaagctgaatttgaatttgctccaatagcctaatagacaccctagtggtaagtcctctgtgatgctcgccattgtccccatgtctaacaaggatttctactggacatagaagtttttctaagtccaacaagagggaaagagactgggccatcattgttctcatctcagatttccacttcctgcatagaaggtatacatataggtagccagacgttatgaaaatggattgtaagcatttgttagtgaacaaaatatgactcaaacagtatttttattttttatttttaaatttctattgcttattatttgagacagactgtcactctgtcacccaggcaggagtgcagtgggtgcaatcttggctcactgcaacattcacctcctgggttccagtgattctcaagcctcagccacccaagtagctgggattacaggtgtgtgtcactacgtccagctcatttttttttttgtatttttagtagagacagggttgcactgtgttggccaggctggtcttcctgacctgaaatgatccgtccatcttggcctccaaaagtgctgggattacaggcgtgagccaccgcactgggatttaagcaatatttttattaagtaaagtgtagaagaaaaagtgtaagtaaggtgacaataagaaaacaaaatgccgtaatggaaaacgataactttagggcagaaaacaagaaaaggcaaaccaagattcctgtagggcaagcctccaatgcacaatccaaggaggaatgtcaagggtgaaaactctggagcatccagatagtggcccaaaataccaaatgctgaaaacccagaatacccaagtaacagcctatgagtgtccccacaccaaatgccaggaaaccctggagtatccaggggctgaccagtgcagaaaatcctggagcctcagtggggtggccaacaatgagccccaaaggcctggttggggccataaaacaatgtgactctggcttcttagagtcaacagaacaggagaattcttacatccaagtgtcctgccttaaacaattgcacaaacataattagcagggacccaaagaaaaaactgcaaagcaaacacatatatcggggcagaaaataaaataaaatggctgatggataaataaaatggcattagaggagaaatgactaagagaaagaacaatgaggatgtagtcaggtgtgctatgggggaattcaaatggactatctagccaaaggccttatttcctggatcatctatataggcaggtggatagatgggacacttacaggtgtgcaggagccaaaatggggccaagcagtgtctgacatggggcctgcatgaagatctctccaggcttcccagctcggatgggttgggctcctatgggggaactggagcacggagcggctggcctgcatgaagcagtggctctgtggcctcttgcccatccccagagctccaacacctgtcaggaaagatgatggttcttaaaacagcctttggctagtgttaatagctctgcaatgttaacaactcagcataaagtcacacagacacacagacactgtagctttgatcgctgtagcgctgatcaccgtctcatcctctctcactgatcgctgtcttgccacttctccaatagctgtcttgcccattgctgatcactgtgtccatcttctcataaagtgccatctcttgctgtctcttgctgtcttgcttctccgctgtttccactgtcttactgccacatcaaatgctgcttctcaccatctctagtggtgagtggctggctcaatattgatgcaaggcaagtcctcagctttgctcaggaaggaatgtaagagtaagccagtaatagaagaaaacagctttattgatggggcagcagtgttacagctctgtgactactcctgcggagcaggggtaattcataggcagagggccgagagtagcagccaggggcatttttacagtcacatttatacccacttttaatcatgtgataattaaggggtaggttgttcagaaatagctagaaaatgggtggtgttgccccaacttccaggtgttgctatggcaggggcaggaatttccaggtgttgccatggcaagcgctgtgacttctggatgtttctatggcaatggtaaactctcatggcactggtgggtatgtcttatggagaggtcctttcagaaccctgttcctgttttggccagcctcacatctggtcctgagcagagtcctgcctacctcttgcctcaaaagtaacaagaaatctgtaatgaaaatttacccagacagaaaactccaattttatatttggtagttagtgacatggtacttatcaaagttacacaaagattcaagtgaataaaaaatactctcagaattattataggaggtcataatgtcctgtagtccaaaaattaatatgcacataacaaaacaaagaaattaaaggctgatatccattgtgaatataaaaataaatatcttaagaaaaaaagaaaaatgcaatcccactgtatatctgcacatttagtgaacacacattgtaaaaagtgttacagtttttataaaaactcttgataggtaattttaatttctgaaaaatgtatatgaactataaggtatgttggatctcttcccctaacttaaaaaatatttcttcacatttaaattctttaccaatttttaatgactttttattgcttagaattttagttgatataaataagaaatgtgtattaaaagcctaccattttgatttaacctatgaaatatatttaaattcttggaaaaatccaaaaatacctagaaaagtgagctcttgccagaagatacacagttctttagtgtcaggctgagattatctcccagaaataacttttggctcatatagcttccaggacactgcaagaataaaagatgtgaagacaatgttacttaattggatttgcaattattcactattcactgttaaccaattttattgaaaaaaaagattccaatcaaatacactgattttaagtgtactgttgggtttaataaataaatacattcttggaagcaaaatcaatacacacaacatttctgtaactccaaaaagttttgtcctgctcttcagcaatcaacttgcttccacctcacagaacagaccatccttattcagcttattgttagtatagattccactatctttttaagaatttcacataaaggaatatagcacatgttcttttgtggctggtgactttcgtgcagcataattgtttcctaggctcattcatgtcgccttgtgtcctcgtgatgtgttactctttacttttgagtactatttaaatatgtagtaatttcacaatgtatcccatcacctgctgatgaccatgtgggttgtttccactttgggctattatggataaagctaccacgaatggcattatacaaggctttgcatgaatatttctttatttcttttaggcaaatacctaggagtgcagttactgggtcttacagtaagtgtttaatactctgtcatactgttttccaaagtggttataccattttacatctcagcccagaattgatgagagttctcaatgtttcagctacttgtttttaagactttttcttaatcatcactcaacagtgaccagaatggctaatgatcattaagtcatgttttccttacaatttccttgacttttgtgggtgcttgacttgtatcaggatattgaaaacaggatcaatattgtcttaaccccttttaaacactttttctaagtaatgatatttaggatgataacaggagatctaaagggaatgttgggagtagtaacaggcattatccaatatttattatcatactccttaagacaatacattttgagtgaaatagcattcagctagactagggataaaaaggttctaatctcagctttagcattaaatattaggaaacctctgagaaaacaatccaggaagacaaatcagagggtgttttgctagtggagaagtgctgcaacacctaaaacctattaatgccagatttttgcagtgatttccactcataaagttgggttgactcctagccttgttctcctatgtgtctgtgtgactttatgctgaggggatgtgacatcacagagggagaagtgcacttgtgtacagaaacatggcttaggagattggctttggatgtggctgcaatgaaatatatattttgaagaagtcccctatgaaatgtcttatacattgtttcttatggcagggtgctcgggctcacacctgtaatctcagcactttgagagaccaaggaggaaggatcacgtaaggccaagaatttgataccagcctgggcaacatagggaaaccacatgtgtacacacacacacacacacacacacaatttgtgaacagtggcatcacgaagtgattatttatgaacaattggctaagaaaattacaaaataaagcaatgtcttctgagctaacaatactataataaagatgtcaattatttaactgtagaaaatacagagaacataaaattgtctatcttaaccatatttaaaagtgcagtgcagtggcattaagcatattcacatgttctgctattattaccgatactgtctccagaattcttttcgtcttataaaaactaatatctataccccttaaacaatactccccccgtttcctctatccttatccctagcaacctccattccagttctgcctctatgtcagtgacatctttgaagcaggttcactgtacactggttaccaacgtacctgagcgcgaggaacacaacacccccacacagcaagttacatgaagggggtttattattacagataagcagcaagggatcacaaaactcttggactcattatggatctgtcccccaaggcatacgaaagttatgtggagctgatagagtcgactgtgtgtaccccgcttgcatcacagctcaggaatccggaaaagcagacactctgggttttatatcctggggtaatgagacgcacagggctaacgtgcttaaggacattccattctatgagaaactggaatacagcacaggtaggctgttctggccagttcctctctatctcaggatgttacaattccagcacattctacaattattcttgagaactcttaaaataatcaagaaagtggagagaactaagtcagcccagggtcattggagaactgtcttgcagttaccccaccacctagacatcccccttagtaaagctagcatatttcctacacccaccaatgtcccccaaactgaaggcagaggtttatcttttcagattgacgaagcaccttgatttacacaatctcagtgcagattattaagccatagtgagagtacatttcgctggtctaaggaaggctactaccactggcaggagggataagacccccaaaagcagtgacctagtctaggatcccatgatcaagaaattaagatgccaaagaggtgaaagggggatctttcagatgccccattgtctgcagccattgagcctgcatcaggatcacctctacttatatttctaggatacctgaggtgtttatccaggtacagaaggcagtgttgggtgttggtaattacatggaacatccgttatgttccacgagaatgtgcccattgtcacgctgattgggcagtgaggttgtttcttggtcagagtgaagtctcatggagtatccaaaatatgacataaattcctctcaagggtggccatggtagcccgagcatctaatagagtgacatatatttagcagtccaggaagcaagctattgccatagtccttttctccacacaggggatcctttagtagttcagtcactcagttgctgttttcctgaccagatgactgggttgttgaaagtggcccatgatttaatggaaatggagcaaaatatagtgttaggggcagcctgcatggctgctatcattgtatgtagtttggcccattgggcagaatggccatgtttagtgtcaatcaaaagatgccatcccctggctggatggtggccacacccagtggacccactggcatgtgttttgtacaatcatcagggccccatgccatattgacataggcatgtctttgaatctttgactctatgtggccaaaggagaagctgaattgtcccctgtgggtcatttgttcccttcttgcaagcttgtcatttgtttatggggcacatgggtattgtggcatcctggttagggctgattcttactgtaacatttccatttagtaatttggatctgttgggcctgtccagttttattgattgtgtttgtaggcaccaaagtgagaatctgtagttaaggtagcagtgtcactcctggtcctctagctctgagatactcaggccctatcagtttcctacagcaagtaaggagttgccattcaaaagaggcacaaatggtggctgcttcaggaaacatttgcctccaaaatctaagtctggtgcacccagtgacaattttacattgccacagactccagtcagcatgcctagaaatagtggacacctggatttacatcgagcaagcaggctctaaaggtcttaaagaaatgccttggacatgtattgttgaatagattcgaaggctaccgttgcaaagggctccattcaaagttgtcaaatttgttcatgcttttgactaaggtgaccaaaaaaaaaaaaaaaaaaaaaaaaaaagactcagggggacagtgcagctaggtaagaatccagtggctttcccgagcttatttgtcttgcatttttggtgacatggattgttgttcatatcggcttcctctggcaggtccacctggaaagcattatatttagcaagaataaaggaggctgtgaatgatgtcactgcggactgcgtatattccctgttgcaaatgtcaaatccatgaagcaaaaagggatttactagaggttattaaattccttacaaattgttgaaaagccttaaaaaacaggctccagtcaaagcctctagaacaattccaagaatcgtactgctggcacaggtcgggggagcatctcctgcgcctgagactccacattcaagctgtctcttgcagcagaagagagagcagctcttctcactactgcccccagaaggacagcagctctggtatcaactatcaactgctagaaatctgacccctttctctgactgcccatcagatgtgttactacagagtcgttttggattgagatgagggaggggaaatgcctgatctcactcaaatgtgctcattttcctggtctgagtcacagccaggcagcacagtcctgtgggcacaatatcttcacttgccaggttcctataaaatgggagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttaggtccaaatgattcagtgataaaactaaagagaaaaaataaatacacttttcaacgttgaagctgaccaggtgtctgtctctggtgtttacccctccacatcccacgatgtgtttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaagtcaattatgtttgctcttgctttatatgggctagatctatggccccagcacacatctgaacgccctgtgttgacaacttatccagtattgtattgagtctgaatggtcacatgcttatcatatcatttcttccaatttcatgcaataattgtcatgtcaactgtttggattaagaaccatcagccagaaaaccacagccctgagaaaatagaaatagagtatttcaagctgttcagtgggcatagcaatgatgagtctacagctcattttcaatatataaatattctgtttatgagagtaacagtgtttcagagcctccaccacatctgacagcataacaatgcaatagcacaagagtttgtgtgccagcgttgcttgactaataatgggtttttctttgtctatagggtaagctgcacctgtgcacatgacaagatcatgagctacactttgcttcactttttttgaggtcaataaactgcttgatccaaagccatattatggaagaaattcctgactctgatgaaaacacttggaaaatcctcaaataatattttatgcagaaacataaccgaaaaagaaggcaaattcatatattgcaaataaccagtgccttcctcatgttgcatgaggtccactagaatcacctgacaccagctgttagtctgagccctgatgtgtggtacaatgttaagggttcaagaggcatcagttttcttggcaaattaggtgttcagaagagccaatagccctgtacatctcagttagttgaaactcacattactgagtccccacagggaccttattaacattggttcatgaggctacctggggaagctgggaaaggtgattgactgaagtccatgtgttgaatcatcctgattattaaaagcccctgcttgttaatggcatttcacttaatattcacttggaaagcattttttttattatggctcatttttgaaatgtctggtcatagcttttgcagaatgactttgtctgaaatcagcctgttgcatttattttaagacttgatgatctgtcaaaaccaacagccaatatttattaaactgctgttatcttgcaatgggatcatcagatgtaaccattgcagtttacccacggttaggatttttacatttccagtgcttctttgacaatgacactaatgtgactctatccagcgtgcattgttgtgagaactctatttggcctatcatcattgtgggcatgaacataatggagactttcataggatgcaatggttaatattcaacattagtcaaaatttgctctagtcctaccctcggagctctactgggttggaaaaatattttaggtaaggacaaccatttggtaaagttttaaaaataaaggctacaaataaattttctgtagcaagagtattgcatacataatagaataaatgtgcttaaatatgaatactatatatatttgtagccaacattttatcaaacaaatatatattcacttctatgtatcttatatatatgcacatttttccataaataaggtaaattttaattttttattgaaatactagttttaattctgttcttaattttctcttaataacttcataaattgatcactaaatattcacatttataccaccaatttaagaaaaaaatacatatgtttatatacacgtagaggtgtaaataccgtatcaggaagcctttatgcataatgattggttactggttaaatacacaactcagtgacagaaaacagtaaacatttgttttcgtgttcatggatgctcacgttcacaatcctctggctgaccaaggaagggctctgatgagtcgttcctctgcagggcactgagctcaccttcagcctacagatatgaattgtctgaggacaaggctgaacagcagtgactacacatgacacaagattcttgtggcaggtcacaggagtgaacaacatcccaaatcaaactgcacagttgaatttaagtccaataatttctaacatagcttcacacattttaaatatattcctttatttcagtgagtacacattttcaagaaaatgtttactccatttaattatagaagggtttgatcattccatgaacaaataattatgttttcaaactttacaatcctgaaaatatttgcaaatgtaaatttgcattaataagaaaataaagctggatgtgtttccaacatgtggcttcaaatataatttatttaaatggactcattggggtaaaaatcattttaacttatgtaaatatccctttttgctgtgcttgtgtcctatagagttgcccaataagagttcctcccgtgagatttggaaatcagaaaaggaagactcaatattatccattggtaactaagacaggtacaaggacagaggtgaggactggagaaacacctggaaggatgttgcaggaagctaagagcatcagcacgcctacccctaagcttccagacaggactgaggaccacatggttagaaagcccttactttaggggcggatgcattctgttttctgagggagaaccagagaatcctgcctctaatatcaactttcctgactactgtatccttgtctttgaaaggctgtagtctgaacgttaatcataggcattggttcattcttgttatacccaacagagccaagaaacctagtggggaaaggcactcagggtgcaaaatattgctgctggaatgcaattgaaataggccctgttatcccatggaactaaggtttatggttttttgaataaacttagaaattgtctccccctccctgtcttaaaactcaagatagttacatctgtcttacctgagtcctttttttcagtaaaccaaccatcaggcctcccagatactattaagaagctgaaacttacatatcactgaattgggacagtgagacatcagaaccttcacccactgtgattgcataactgacctcctgcttcttcttgaccaaattatcttccttacccctccctaattcctgttttcaacatttcttccctcctatataaacccctaattaattttgtcagagagatacaattgagaatggcgtcccatctcctcggctgcagcacctgattaaagcctgttccttggcaatacttgttgtcttcgagattggctttctgtgtggtgagctgcaggatctacaccaagtccctggtatttcagtaagaaaattctctgcaaccttcagtgctttggcttattgtaacctgaaatcaaatttatccacaatttctgagataacttgatataactctaggattcactttgtccaccactgtttaccagtctgagcttgccagctcccaacccttcctagtgccaatgaactttctcaaagtgcaataggtaatatttccctttttcatggaacactgactttttctttgttcttccaacgtactgaagaccactgagttttcctgtatgcctcatttggcaaatatttctcttcaaataaaacattaaatttagagattcatctctacattttatttagacttcagcagtttattctaattctctgtattaagactattcctgcttagaatatctatagtggcttcttctgcattatgatttccaactgaagccataaactagactcctcaggtgtcatgatctctgtttttattaaataaggagaagcattgctatgtctgtgcagttggtgctgagaaagagaaaagaattagggtgcagaggtgacttcatgtccccatctaccaacaccatcagagtgtggctgcatctgaggaacactctcagctgatggaggcatcaggagaagctgctggggcagcccagcctcacacatctgcttccctgggggtttatgtttgggtgtgtaacactgtgggagggtaactattatactgttggcagtaataagttgcaaaatcttcaggctgcaggctgctgatggtgagagtgaaatctgtcccagatccactgccgctgaactttgatgggaccccactttgcaaactggatgcagcatagatcagggacttaggggctttccctggtttctgctgaaaccaggctaaataattgctaatgccctgactcgcccgacaagtgatggtgactctgtctcctacagatgcagacagtgaggatggagactgggtcatctggatgtcacatctggcacctgagattggaaacataaaaacaaatgtccacacaattaatcatgttgtaagagaatttccctgaatagtaaagcagtactgagcaccctgggctgagtaaactgctagtgttctccatccttacctgggaaacagagcagcaggagccccaggagctgagcgaggactctcatgtccatgctgtgtcctgactgggtctgattcctgcacaaagtctgaccagcctattaataaggcttcagggcaggaggttgtgctctgggaacatgcaaatgagcaggggatggggcaggctgggcacagctgcagagctggcgcatctcagtaactcagcaccagctcagtgtccccacgtgtcccaggtaagatcaaggtagctcaaatttgtctgcagagaatgtgtttctactggggactattttgttatgggaaacattttatggtttctttttgacaatttgaaatattccttgggagtcgatggagcaatgtatttcattggtgtatggggattatttaggagaatattcttttttgtaggaaacacatagtaaaattttagaccctacaattttcaggtcttcaaaagactctcatgtgatttctgttagggaaggtggtacttatcatatacttgcaacatttctgtgagtttaacattgctcctttctaaaaaaaaattaaaaataaaatttattcacatgatgctacatatatttgtaaatgttaggtaatggtgttatgccattgttcttaccactgtaagatcaagcaatttacttcagatacactaagttgataccgtgtttcctcaatgcatgcagcaattacagatccaccattatcaagagctctaggtctctttaatatccagagactaaatgggctgcaccttattcctgttttgcaccttattcctgttttgggcaccttcatagtctaccttcttttctgccattaagtattatttcccaacattcatctctcttagtgagggtgatcactgcatggagcatgtccctgccatgcaccataggtgacactttcttcttttactttttatcagggacatcatcctgacccagacaccaagatccctgttaacatcttttggaaagaggcactcaatcttttatcaagcaactgcccaggtacatggagaaatcagttggttccagatgaaactggacagggatttgcactcgttatatctcatatctctaatgtgcccaaaaatgtcccggcctggttccgtgggaggggaagtggatccaactacatcagcatcagtgggctgcagcctaggactccataaaattttactgatgcctgactaggagagccaaatcacagtgctgtagcctctgcacaaaccttcctgctgctttataagctgcctgaattttaagggaaattgcttatattggaagaaaggaagaaagctccatttgtcctctaaatgtttgctgaaaataaactgacaaaaggaagattaataagagaaaaggcaaacaaaattcacttaaagtgcagcaggatatcatagcaaggtgattacccagataactcaatgagatccaggtgtttatgtttcctttctagggaagaggtaattgggaaatgtaggcaacctggagagaatagatgagaatagaaatgcatcctcaaaagaacaggtaatcacctccctaggtaaagtatcaactttgagtctcttccatttttgattcctcttttgtgttaatcttccttgatataaaaattctcaggaagagttttcttaaaaattggtttccttctgaagaatttgcttttaggcaggtaggggatatttaggaaaagccccctgtgcatttcctgctttctaaatgcctttggttttatataatcatcatacaaatgcagcacagtttgagatgttattttctggattcctttacttgcaacccacctgccaagatcctgttccagagagatgtggctacagactgaaagagcagttgtcccctcaacaacgtggaggttggggcactgaccactggtgcagatgaaaacctgtgtagaacttttgcatctccaagttatgtagtaatagattacttttgactggaagccttaatgataaaataaatagttgattaacccttttttatgttatacatattatatactctattcttccaataaagtatgctaaagaaaaaatgttattgagaaaaccttaaaaatgagaaaatatatttagtacttattaagcgcttgctcacaggtgacacacagaagaaaatataagtggatctgcaaatttcaaacccaagttattcaagggttaactgtaccatgatgaatgtagcagtccccatctatagtctagggcttttccctttgctgtatctctgctcatttccaatggctatatatatgtcttatgtgcttcatgatcttgggcagagaggtctgcttgcatgccttgctggccagatggcctgcaatgtgtatctcttaggaaagtgctatggtttgactgtgtcctccagaatccatcgttgtaaagttaaatctcagtgaaatggtattgccaggtggggcctattgagatgtgttagatcatgagggtggagccctctagtggaataccttaatgccactataaacagggtttatggggctggaatctctctgtctcttctgctggtctgtcatgttaagacatggccttcgttcctttgaaggactgaaagctccaggcgtcatcttgaaagcagagaaagacgaccttaacctgcccatgccttgatcttaaatttcccattctccagaaatgtgagaaaataaatttctgttctttatgaattacacagtggcaaggaacctaacctgttatagcagcttgaaagagaacaagagagacagctcacaatcagtgaggacagaatgaggtgtatacataccttagcttcctcgtctctcaggtggaatagcccagaggaatttagtccatgtttccacatgtggttgatcttcagttatcctgagtcaggtgggttgttgatgtgtcttttaccattcatcttctgttccctccctcactttcttcctttcctcccagtgtaaatttgctgcctaaacaggaatcctcattgctggtggacccaaactaagatagtaaataaaatcattaatcttttgtatgaggggtatttctcatctgaattcttttatcatttccctttctttgacatgtaggaatattcaggaaacacacaattttttttttaaccaatctattttagattgaatttatgcggtgattttttgtgtgtgtgtgttaaaacaaaaaattacgttgtaagccactaaccagctgaacggactcctcttttggtagagagaacttcaaagaaatctgaaaaactaggttaggccatgactggcaggtgggtttagatgtacctcattatatggtccttcctttggagttcagacacaactgaccagcattatcattacaacagagatctttggattgacaaaacagatgctttgtagcaataagataccatactccaacacgacagataataggccctgaagaaaatcaaaatattttaccctaaaagtatttctttgacatattctgaagtggccctgcaagctgcctgttgtgggggaaatttgcattctgcagagaatctcctccccttactaagtcttttccaaagagtctgacattttttttaaggtctgataaacaacattagccacctactttgtttgctacccataggattcatctaggtgacaagaacctttgcttccacacccccttttctaaactcaagcatttctttatgatgaattcaagtgtttaggcagagcttaactctttcaaccagttggcagtcaggaaatctttgaatccacctatgacctggaagcccctacttcaagctatcccacctttccaggacaaactaatgtaaatcttatatgtattgatttatgtctttccctgtaatttctgtctctccaaagtatttaaatgtgtattcttgtcaccctgggcacatgtttgcaggacatcctaaggctgtgtcacaggccataagctttgggaaaataaacctataaattgattgagacccgtctcagatactgttttgtttatactggtcacaaacttaaaaatcctctaaaacaatctacacatcaataaatctacattagagacagtggaatgatcataccttaacagttaaagctcacaatttaaaggaacctgagtctaagattttggccagctctcttgcttcataaaaaatacttcgtgatttttaaaattttactttagagaaaggcaatttgggggaatatatttattgtcaatgggatgaataatgtctctaccctaaaagatgtccatgtcctcatctctggaacccaagtgttacaggagttattaagaaattattttaggcagataggaaaagagtgtccttggtaaggttttctttcctttaaagcagctccagaaacgtttcttgtctagcaggaaagccctggctcttagagccaggctgggaagctttgatttgcaaattccggccattagaaactgagtccagccaaacctgtcaattcccaccatcttcttccttgcccccacatgtgcctgacaacaaggctgcccccacatatccccatgtgtagagaatattttggcaccctgcatttgcatattaaaagtcttgttgggaaggccagttattttgcaggcttcatgaatggcatgcctggtcaaaccagtccctagagccctatataaatcagacaccacctcctccagcctcctcatataagagccacttttctgctgcaatggagttttgtctttgttggaatccctcctccctctgtctctgtgtgggggagctgttttcttcttccttccttcttgcatattaaacctttctctccctaaaaccactccacgtgtgtctgtgttgttttatccaaagtggtgtgagaccaagaaccctggtgttcctccagtcaacggagccgtatcataaaaattctaccttacatagcaaaaagagaacttgacagatataagtgaagaataagcgacccagttatctagatgaaaccaatatgatcacaaaggtccttaaaataaaagaggaggcttgcagtcagagaggagctgggacaatggagagggatgtggtttgaagagggaacgggttactctgctacaaaaaaaaatatgaccacgggggtactttgcttaaaaaatatcccagaatgtcctgctatacttagagagcatttgcttcccaaatagaaaatgaaggcctccttcatttcacaccagtttctgctacatgcactgtatcgctctgttgcttggtgtctacgcacttagaactgctctgtcttctttccgaaatgactttcttcattatgtaatgtacatttctgtcactggtaacattcttggctttgtagtctactttatctgatattagtatttgctactgattcattttattaattttgcatactatgccattttcttttcttttatattgagtctacttctagtgtcatatttgatgtgagtgtcttatagacagtatactgttcggacattcctttttgattcatcaattgctgtctgttataatttactaatttgcatatttaatatatcgataattattgatatactaagatttaagtctttgctctacttttttgctgtatctttttttgcttctccgttttctttttgctgccttcctttgggttacttgaacatttttagaatttcattttaattttacctaatttgagggtatctctttttatagtgatttttaaattggttgtcatggtatttcctttatatccatagcttctcacagtatgttggtgtcataatattaccatttaaaataaatataaaattttaccttgttttatgtcatttttcttcccccattagtaatagattgtgcacatatactcatgtacccttcacaccatctctagcctacttataatacctgacgcgatatgtatacatgacttaacctgtgtggattcaaccaagtggtactaagcacatggtgaagtcaagtttttctttttggaactttgtggattttttttctatatatttttgatccaggtttagttgaatccatggatgcagatcccatggatagagagatgactatactgctccttataactctgaggatcaactctgtggttcctccattctgggctggctgaactgatctctgctgagcctgctcatgtgtctgcagttaccctgtggttcagttgtgactagatggtctgatatgacttgtttaacctatctggaagctgatttgatgtgcaggttggacaacatttggtttcggtttacataggtcagggagatggggcctgttccccaacctctattcagttcgtttctagatcaactcaggagttcgtctattcattgtaggttgtttgggggaaattccacacagaacattggtaatgaagaagctgaactgctgtcatcagttattgttatcatctgaaatgcatcatatattaccaaagtctccccagggtggcccaacagtgcagctcagctcaccccatccagtcacttccctggttgcctgcaggtgtgagaaaggcaatgtgctcagtcacaggaaagacaggggccctccctggtgctgaaacctgcagatagttttcacacagtttcattccaaaatacaaagacttcattttctttgtctttaaaatagttatacattttctttctataatgtccccatgcttttcaactaatttgaattttcagaactggaagtatttattatttctgtgttagatgctcttagtcacttatggcaagagtgagttaatagagacaggatatggattagccatagaacaatacagaagtgtgtggattcagataggataaagatcaaagcggtgacaaatacattcttttgaagcggattctcataggtcaccagtcaatgtccgcattcaaggtgcgatgatgtgtcagctacattgtgcaaatggtcagctctgcagagtaaacttggacagcacactacaggaccaaaattacctgtaaaggtatggggaaaataaaccatcatagaaaaaatagtgtgaaggagttctcggttatttatacttggatatcaagcagaacactataatcaatgaagctataacctaaaaactttaagacttttaaagaggtttcccttttctcagggtatttctcaggaaaaaatttataaattatggataaactacttgcacaattagctacaataaatcccttccctgcactcatcctttggttggcctcattctaaatggactcaggtgttacccatgtgtcttgctcaggccaataggataatagcagatgtgacagaattggaatattggaaagggcttgcacatcgaagctttcctctctttcacagtgcttggaaaccctaaggtcacaatgagaataagcctgtgcccatctccattcaatgtcagtggcatggctgctcttaggtctattatttgttcttaaaatgtgtgttcagtttgttataaacatgtaagaaattacctgcaaatttatcaacttaagactacacccatttataatctctcaatttctgagtcagcagtcagcacatggctttgctggatcctgcccattggatttcacaagactgtgccacagtgtagactgttcttcattctcacctgagactccctgagaagagagatattttagagctctttcaggtagttgcagagcccatgccttagcacctctgtgactcagggcttcagcttcttactggctcttggctcaaggctgctctcaggtcccagaggctgtggacaattccctgccatgtgatgctcacacaggcaatgcccacatggctggttgtttgttcaaggccagcagaaggtttcagagagtgtctctttccagtctgctatgacagaggcttacagaatacaatacaatcattggaaagacatctcataacctctgccataccatatgggttagaagcaagcctaagttctacctgttctctgtggaggtagatcacacaatgccatgactcactggagacaggtttctgctagggtgttctggcatctttagtttcctcaaatatcagggtactcgtactgagtgtgaaatctctcctacatctacttcatcgtgctgtgtctgactgatcagacatttgacacatgacttttttttttttttgtgacggagtctcactctgtcgctgaggctggagtgcaatggcatcatgtcggcccactgcaacctctgtctcctgggttcaagcaattctcctgcctcagcctcccgagcagctgggattacaggcacccaccaccatgccaggctagtttttatatttttagtagagacggggtttcaccatgttggccaggctggtctcaaactcctgacctccggtgatccacccatctcggcgccccaagatgggattatagggatgagctaccatgcctagcctactttagtttttaagtagatttaatgaaatctatttagtagccaaaagccaagaatgccaatagttttacctggctactctctgaaacaatggtattaaaaagggtctttccagcccctttccagcagaaagacaggtgctaagaaacagtggaagtgtgaaggtgggggaagggagagaaacagtttttatatacctaaactaacccagctgcatgtaaaccagtaactactcatcaaaataaaatacagaaagcatattagttttggtttggtgtgaaccagccttaaatacaaagttgttacactgaatgggtttaattgaccaaaatgcgtagggaaggcagaaaggattaggatgcccttctactcagctttatctgctgtcaagtctggttcctcaggggacacatggatcccctccattgtcctgcagattctgccaggccaaggctgttaaatctggcggggtctcatgtgtggacttctgggtgtatacagggagaaactagagaaaggccgagcagatttttactgcatgtaggtaatctacgtgggcttttagagaaaaaaggctttagataaaaagtgtttgacaaagtcacacatggtttgtaaaaaaacaaaaaataaaatacaacttgaaaactcttggagaagtgacactttagtttcccaaatcactcttcttcatacacttccacttagctttttttcaccttctagctctgtggtcttagaaggacatgcacttaaaataatttgtttccataggaatccaacaagtaaaagcataaacaacatcaaataaactacatcattagcatagaagcatgtcaaagaaactgagattagattttgagttttggcacaagtattagagaaatagagaaaagatttaaaagatagaataagacttacacaagaaagcaggacagcaatacgacaattgaacctatcatagaataataggttgtgataatggatggtgagaagaaatgcattggacagacatgcatgggcatgattgatttgagcaatttagcatggatcaagacaaaatctttaggatttaaagggctgtgagctgggtagtaaaaagccccattttagcacctcttggggctgtagatggaaagaacttggatttaaaactattttcaataagtgtctgctaagtgctaagtattatagctataaggatacctaaattaatagaagcacatattatctgttggatatattctaaatcttttaccttgtttaaattgtaaaccgacctatgaggtagaacctattattgtcacagcattgcgggtatagaaaaggaggcaaaggggggttaagttactttactaatgtcacacaacatgtaagcggtaaagctccatccccaaccccaagggtttgacttcagggcctgccaagacaacatctggactgttgcatggatcttgcctggctgtacatgaagctctaattccaggatggatgaagattccattagaacttggagtagcattaataaaattgcttccttgagaccaggcgaagtgtccagaaagcaaaggagtttaactgcttaaaggaaaggtgcagatttgtaggaaatgaagctctggactgtgaacagagtttttcaaaacaattaaggagaagagaaattgagtctagtttgatagatgtgttgtgcagagtgagtgtagtggagattagagaatcagccaaggaattatcccctgccttcatggatggcatcaacatctgtcttcatggcaattgtattggcagcctgagtgtcagagcctgggtcctgcccatccatgcagctgtggtcacctttgcacctgcagtgctggagttacttgagtgttactctttgaggtagcttcaggacacttggtaaaaatcactaagtggcaagtgaaaggcttggaagaaaagttctaatcagctcttcattcccacctgatgcaatttttgctgctgctgggaccccaagttctttgtctcctccccgccgcttttttttttttttttttttttttgagacagagttttgcttttgtttcccaggctggagtacagtggtgtgatctcggctcactgcaacctctgcctcctgggttcaagtgattctcctgcctcagcctcccaagtagctgggattacaagtgtgtacccccacgcctggctaattttgtatttttagtagagatggggtttcaccatgttggtcaggctgatttcaaactcctgacttcaggtgatccacccaccttggcctcccaaagtactgagattataggtgtgagccatcgcgcctgaccccttgcctcttttgtaaatagaaatcaacaccaggccaaacagaaattgtctcaggcaaggtttaataggtttgtggcaagagcaaagcaagggagcagcctatgggtaagagatcctggtggctattccttgaagtgcccagctcttaccattttaaggaagctgaggcggaaaaaggaatgacatacaagcatggttaggcaaagttttctttgcatttgtgcagtggagcgtcatgctctaacatatataacatggtgaggaaatggaggataagccctgccttgggtggatattttagtattacaatgagattataatgaggaaaaatcagtgaaaggtcagttctggggaccatcccaccttcagctggctagatctcatttggtgctttggggaaatgccagctctatcagcaaccttggaagatggtcaggttcttatcaggaatgttagagttccactttagaaaccttgggaggctgggcacagtggctcacgcctataatcccagcactttgggaggctgaggagggcagatcactggaggtcagcagtttgagaccagcctggccaacatggtgaaacgctgtctctactaaaagtacaaaacatagccgggcatggtggtgtgcacctgtagtcctagctactctggaggttgaggcaggagaatcgcttgaacctggaaggcataggttgcagtgagtgtagatcgtgccactgcactgcatcctgagtgacagagtgagactctatctgaagaaaaaaaaaaaatgaaatcttgagatactcaggccctatcattttcctacagcaagcgaggagttgccattcaaaagaggcacaactggtggccacttcaggaaacttttgcatccaaaagctgagtctggtgcacctagtgacattgccacagactccagtcagcatgcatagaaatagtggatacctggatttccatcgagcaagcaggctctaaaggtcttaaataaatgccttggacatgtatagttgtatagattccaaggctaccgttgcaaagggctccattcaaagttggcaactttgttcatgattttgactaaggtgaccaaaaaaaaaaaaaaaaaaaaaagactcagggggacagtgcaactaggtgagaacccagtggctttcctgagcttatttgtcttgcatttttgttgacatggattgttgttcacattgtcttcctctggcaggtccacctggaaagcattatatatttagcaagaaaaaaggaggctgtgaatgatgtcactgcggactgcgtatattccctgttgcaaatgtcagatccatgaagcataaagtgattaactagaagatattaaattccttacaaattgttgaaaagccttaaagaacaggctccagtcaaagcctctagaacaattccaagaatcatactgctggcacaggctggggaggagctcctactgcttgagacattcaagctgtcttttgcagcagaaaagagaccagctcttctcactactgcccccaggaggacagcagctctgctatcaactctcaactgctggaaatctgacccctttctctgactgcccatcagatgtgtcactacagagtcgttttggattgagatgagggaggggaaatgtctgatttcactcaaatgtgctcattttcctggtctgggtctcagccaggcagcacagtcctgtgggcacaatatcttcacttgccaggttcctataaaatgagagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttagatccaaatgattcagtgataaaagtaaagagaaaaaataaatacacttttcaacgttgaagctgaccaggtgtctgcctctggtgtttacccctccacatcccactatgcatttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaaatcagttatttttgctcttgctttatatgggctagatctatggccccagcacacatctgaatgccctgtgttgacaacttatccagtattgtattaagtctaaatggtgacatgcttatcatatcatttcttccaatttcttggaataattgtcatgtcaattctttgcattaagaaccatcagccagaaaaccacagccctgagaaaatagaaatagagtatttcaagctgttcagttggcacaagaatgatgaatctgcagctcattttcaagatataaatattctgtttatggaagtaacagcaccattcatgattagtgtttcagagcctccaccacttctgacagcatagcaattcaatagcacaagggtttgtgtgacagctttgcttgactaataatgggtttttccctgtctatagggaaagctgcacctgtgcacatgacaagagcatgagctacattttgcttcactttttttgaggcaaataagttgcttgatccaaagccatattatggaagaacttcctgactctgatgaaaactccttgaaaatccacaaataatattttatgcagaaacataaccgaaaaggaaggcaaatccatatatagtaaaataaccactgccatcctcatgttccatgaggtccactagaatcacctgataccagtaattagtctgagccctgatgtgtggtacaatgttaagggttctggaggggtcagttttcttggcaaattgggtgttcagaagagccagtagccctgtacatctcagttagttgaaagtcatattattgagtctccacagggacctccataacactggttcgtgaggctagctgggaaagctggaagaggtaactgaagtccatatgttgaatcatcctcattattaaaagccccctggtcgttaatggcatttcaattaatattcacttggaaagcttcttattcttgattatggctcatttttgaaacttctagtcatagctcttacagaatgactttgtctgaaatcatcctgttgcatttcttttaaggcctgatgatctgtcaaaaccaacagccaatattattaaactgctgttctctttgcaacgtgatcatcagatgtaggccttgcagtttacccactgttatgagttttacatttccagggcttccttgacaatggcactgatgtgactccatccagcatccattgttgtgagaactctatttggaatatcatcattgtgggcatgaacataatggagacttttataggatgcaatggttaatattcaacattattcaaaatttgctctagccttacccttggagctctactggattggaaaaatattttaggtaaggacaaccatttggtaaagttttaaaaataaaggctacaaataaattttctgtagcaagagtatgaattaggtgtcatcacaaataccattttttttgtgtggaatgtaacaattatttaaatgtatataatttagataatattttataaataaaatatgtatatattgcatatataatagaataaatgtacttaaatatgaatactgtacgtagttgtagccaacattttatcaaataaatatatattcacttctatgtatcttaaatatatatgcacttttttccataaagaaggtaaattttaattttttattgaaatactaattagttttaattttgtgtttttctcttaataacttcataatttgattactaaatattcatatttataccaccaattcaagaaaaaatatgtatgtttatataggtagaggtgtaaatactgtatcaggaagtgtttatgcattaattacggtaactggttaaatgtacaactcagtggctgataacagtaaacatttgttttcatgttcatagatgctcatgttcacaatcatctggctgatcaaggaaggtctctgctgagtggctcctctcagcagagaggagcctgtagattgtattcagcctgtagatatcagttgtttaacgacaaggctgaacagcagtgactacacatgacacaagattcttgtggcaggtcacagtagtgatcaacatcccaaaccaaaccgcacagttgaatttaagtccaataatttctaacatagcttcaaacatttaaaatatattcctttatttcaatgagtataagtttttaagaaaatgtttactccacttaattgtagaggtgtttgatcattccatagacaaataatcatgttttcaaccttcacaatcctgaaaatatttgcaaatgtaagtttgcattaataagaaaacaaagctggatgtgttttcaacatgtggcttcaaatataatttttttaaatgacctttttgggggaaaatcattttaacttatggaaatatccctctttacctctcatgtcctatagggttgcccaataagagggtcccccatgagatttggaagtgagaaaaggaagactcagtattatccattggtacctaagaggcagagagacaaaggtgaggactggagaaacacctggaaagatgctctaggaagcgagaacttcagcaattccagacttaaacttccagacaggactgaggaccacatgggtagaaaacccttacttcaggggtggatacattctgttttcagtgggagcaccaaagaatgctgcttctaatatcaactttcctgaatactatatccttggttttgaaaggttgtagtgtgaatgttaatcataggaattgggtcattcttgtcataccaaacagagccatgaaaccagaggggaaaggcactcagggtgaaaaatattgtttctagaatgcaattgaaataggccctattatgccatggaactaatgtttatggttttttgaataaacatagaaattgacttccccgatcttaaaactcaagatagttacatctgtcttacctgagttcttttttcagtaaaccaaccatcaggcctcccagatactatcaaggagctgaaacttacatatcactgaatcaggacagtgggacatcagacccttcactcattatgactgcataactgacctcctgcttcttgttgaccaaattatctcccttaaccctccataattcctgttttcccacatttcttccgtgctatataaacccctaatttttgttggtcagggagatacatttgagaatggtgtcccatctcctcagctacagcacctgattaaagccttttccttggcaatacttgccttagtgattggctttctgtgtggtgagctgcaggatctacgctgaatccctggtatttcagtaacaaaacactctgcaaccttcactgctttggcttcttgtaacctgaaatcaaatttgtccacaacttctgagataacttgatataattctaggattcactttgtccaccactgcttcccagtctgagcttgccagctcccaacccttcctagtgccaatgaactttctcaaagagccataggtaatattttccctttttcatgaaacactaactttttctttgttcttgccacatattgaagaccactgagttttcctgtatgccccatttgggaaatatttctgtgtaaataaaacattacatttagagattcatctctacattttatttagacgtcagtagtttactttaattctctgtattaagacaattcctgcctagaatatctatagtggcttcttctctgttatataaagtccaactgaagccataaactagactcctcaggtgtcatgatctctgtctgtattaaattaggagaggcattgctatgtctgtgtagttggggctgagaaagagaaaagaattagggtgcagaggtgacttcatgtccccttctaccaacaccatcagagtgtggctgcatctgaggaacaatctcagctgatggaggcatcaggaggagcagctggggcagcccagcctcacacatctgcttccctgggggtttatgttcgggtgtgtaacactgtgggagggtaactattatgctgtagacagtaataagttgcaaaatcttcaggctgcaggctgctgattgtgagagtgaattctgtcccagatccactgccgctgaaccttgatgggaccccactttgcaaactggatgcagcatagatcaggcgcttaggggctttccctggtttctgctgataccagcctaaatcatttctaatgccctgacttgcccggcaagtgatggtgactctgtctcctacagatgcagacagggaggatggagactgggtcatctggatgtcacacctggcacctgagattggaaacataaaaacaaatgtccacacaattaatcatgttgtaagagaatttccctgaacagtaaagcagtactgagcactctgggctgagtaaactgctagtgttctccatccttacctgggaaccagagcagcaggagccccaggagctgagcggggaccctcatgtccatgctgtgtcctgagtgggactgattcctgcatgaagtgtgtccagcctattaataaggcttcagggcaggaggctgtgctctgggaacatgcaaatgagcaggggatggggcaggctgggcgcagctgcagggctggctcatctcagtaactcagcagcagctcagtgtccccaggtgtcccaggtaagatcagggtagcacagatttgtctgcagagaatgggtttctactggagactattttgttacgagagacattttttagattttttttgacaatttgaaatattcctcaggagtcggtggagtatcatatttcattggcgtatggggagtatataggaggatattctttttttgtaggaaacacatagtaaagttttagacgatagaattctaaggtctttaaaagactattgtataattccggttagggaagggggtatttattgtatacttgcaacttttctgtaagtttatcattgttcctttctaaaaaaaattaaaaataaaatatattgacatgatgatgcatatatttgtaagtatatgcagctagagagaaaaaacagatcacctacaaagggaagccatcagactaacagaagacctctcagcagaagagattgggggcctatatttaacattcttaaagaaaataaattccaactaagaatttcatatttggacaaactaagcttcggaagcaaaggagaaataagatccttttcagacaagcaaatgctcaggaaatttgttaccaccagacctgcctaacacaagcttctggaagaagcactaaatatggaaatgaaacaccgttatcagccactataaaaacacactgaagtacacagaccagtgacattataaagcaaccacacaaacaagttggcaaaataacaggctaacagcatgatggtggtatcaaatctaacatatcaatattaaccttgaatgtcaacaggctaaacgccccacttaaaagacacagggtggcaagctggataaagaagcaagaccaaatgttatgctgccttaaggagacccatctcacatgcaatgaagcccatggactcatataaagggatggagaaaaatctaccaagcaaatggaaaacagaaaaaaaccaggattttaattctaattcagatgaaacagactttaagtcaacaaaaatcaaaaagacaaagaagggcattacataacagtaaagggttcaattcaccaagaagatctagttactctaaatctatatgctgccagctcaagatcacctagattcataaagaaagttcttagacactttgaaggagacttagattcccacacaataatagtgggagatttcaacaccccactgacagtattatacagattataatctgtataattaattttctgaggcagaaaattaacaaaggtattcaggacttggactcaaccctggatcaaatggaccttatataaatctgcagaactcttcaccccaaaacaacagaatatacatattctcatcaccacatggcacatatgctaaaattgaccacacaatcggacatacatcaatattcagcaagtgcaaaagaaccaaaatcatgccaacctctctcggaccacagcaaaatgaatgtagaattcaagactaagaaaatcactcaaaaccatggaaattaaacaacatgctcctgaatgacttgggtaaataatgaagttaaggcagaaatcaaaacgttctttgaaatgaatgagaacaaagatacaatataccagaatctctgggacacaggttaggcagtgttaagagggaaatttatagcactaaatgcccacatcagaaagttatacctcagattaacagcctaatatcacaactaaaagaactagagaagcaagggaaaaccaattccaaatctagcagaaaacaagaaataaccaaaatcagagttgaactgaagtagataagacacacaaaaaaattcaaaagatcaatgaagccagtgcctgtttttattttgaaaaagctaatgagataaatagaccactagctagactaataaagaagaaaagggtgagtatccaaatacataaaattagaagtgacaaaaggacattatcactgaccccacagaaatacaactaaccatcagagactactatgaacacctctatgcacaataactagaaaatctagaagaaatagataaattcctggatgcatacaccctcccaagactgaaccagaaagaaattgagtccctgaagtgagcaaaaatgagcttgtaattgaatcagtaataaatagcctaccaaccaaaaaaatcccaggtccaaatggattcacaactgaattaattccgcggatccttctatagtgtcacctaaatgtcgacggccag

SEQ ID NO: 4 - DNA, 149172 bp, Artificial Sequence
  Description of Artificial Sequence: Synthetic polynucleotide
  RP11-1134E24
  modified_base (148933)..(148933): a, c, g, or t
  modified_base (148940)..(148940): a, c, g, or t
  modified_base (148944)..(148944): a, c, g, or t
  modified_base (148947)..(148947): a, c, g, or t
  modified_base (148953)..(148953): a, c, g, or t
  modified_base (148959)..(148959): a, c, g, or t
  modified_base (148961)..(148961): a, c, g, or t
  modified_base (148969)..(148969): a, c, g, or t
  modified_base (148971)..(148971): a, c, g, or t
  modified_base (148979)..(148979): a, c, g, or t
  modified_base (148981)..(148981): a, c, g, or t
  modified_base (148986)..(148986): a, c, g, or t
  modified_base (148990)..(148990): a, c, g, or t
  modified_base (148992)..(148992): a, c, g, or t
  modified_base (149000)..(149000): a, c, g, or t
  modified_base (149003)..(149003): a, c, g, or t
  modified_base (149009)..(149009): a, c, g, or t
  modified_base (149014)..(149014): a, c, g, or t
  modified_base (149020)..(149020): a, c, g, or t
  modified_base (149026)..(149026): a, c, g, or t
  modified_base (149033)..(149033): a, c, g, or t
  modified_base (149039)..(149039): a, c, g, or t
  modified_base (149047)..(149047): a, c, g, or t
  modified_base (149050)..(149050): a, c, g, or t
  modified_base (149063)..(149063): a, c, g, or t
  modified_base (149065)..(149065): a, c, g, or t
  modified_base (149070)..(149070): a, c, g, or t
  modified_base (149072)..(149072): a, c, g, or t
  modified_base (149074)..(149076): a, c, g, or t
  modified_base (149078)..(149078): a, c, g, or t
  modified_base (149082)..(149082): a, c, g, or t
  modified_base (149084)..(149084): a, c, g, or t
  modified_base (149089)..(149089): a, c, g, or t
  modified_base (149093)..(149093): a, c, g, or t
  modified_base (149095)..(149095): a, c, g, or t
  modified_base (149098)..(149098): a, c, g, or t
  modified_base (149100)..(149100): a, c, g, or t
  modified_base (149102)..(149102): a, c, g, or t
  modified_base (149104)..(149104): a, c, g, or t
  modified_base (149106)..(149106): a, c, g, or t
  modified_base (149108)..(149108): a, c, g, or t
  modified_base (149113)..(149113): a, c, g, or t
  modified_base (149115)..(149115): a, c, g, or t
  modified_base (149120)..(149120): a, c, g, or t
  modified_base (149122)..(149122): a, c, g, or t
  modified_base (149124)..(149124): a, c, g, or t
  modified_base (149126)..(149126): a, c, g, or t
  modified_base (149130)..(149130): a, c, g, or t
  modified_base (149133)..(149133): a, c, g, or t
  modified_base (149136)..(149136): a, c, g, or t
  modified_base (149140)..(149140): a, c, g, or t
  modified_base (149148)..(149148): a, c, g, or t
  modified_base (149152)..(149152): a, c, g, or t
  modified_base (149154)..(149154): a, c, g, or t
  modified_base (149158)..(149158): a, c, g, or t
  modified_base (149160)..(149160): a, c, g, or t
  modified_base (149169)..(149169): a, c, g, or t
  modified_base (149172)..(149172): a, c, g, or t
ctggccgtcgacatttaggtgacactatagaaggatccgcggaattctacagatattctctcactgagagacaagaataactgacttatccaggctgcaagtctggtgcttgttctatttgatagtctgatgctgtaagttttttgtcacaaactctgaagagtaaagtggaaactttgactttttgcttctgattgcagatttctatccaaagagggagttgagggaaatgcttcctgttgtcctaattacacagtactaagtgaacactggatatggagtcagaagggaaagtagacttgtgagcccatcacatatggagaaaacacttttggttcccattgttggcagggacagggaggcaggccatgttgcctttcacaaaaaaaaaaaaaaaaaaaaaaaattctgctaccatccctgggagctattgttagaaggtcatgttcaacaaactcgcaaagtgttttcttgattgttgtttgtgtcaccattactcaacgttgtgtagaatgtagtcaggtgatattatccccaattttataccgagacttattttaggtggattatatgactcagtcagaatcgcatcaaagcagaaccagaaccaagtttgttttcaactccagtgcttctttccgaagttttatttccattgtcagccacttaactattttaaaacgtatcttttggaatagggatctctcaataggaatccacagcaaagatgaagagaaaactagatcagttgccttggcaattttgtccactcagaccaggacattcagggatttctagattgaatttgtgtttccttctgactacattgttgaaatgatctggatcatctcctaatcttgctcttggactctctaggtgtattctcagtgtctgtgagggagggcatgtgttttaagcagtaaattcctaaaggcctgtggaggcccaaggccatgcacactgagggagttgtggatcaagtggcatgatgggcccagtctatttctggcagagctgttattttagctgttattctctttggccagttatctcccttagagtagtgcctctttaaatgctttttcatttggtgaaatctaaaaatttgtctctaaaaggcatgctgccaggcctcttttcatattaaagtggtcatctccacattgtagatagtaaatcatgttcaaagaaaagaccttaaaaattcttcatattgccttgcagaaatcacagtattttagatgtgttggggagcttcacaatcactcagtttaacccattcatgttacagacagggaaactgaggcctggtgactttcccagttattaacaaggtagtgactgagaagggacttcagttcgctgtttttaatgactgtatagtgagcatctgatgtttggtcttctacagaaagggaacagagttgactaaagtgaaaataccctagttcagacatcagaggcaaaaaaattaatcataatcacaacagcaccttacagttgtggagtcctttatagtttttagactcttagacacagagaaatagagaaatataaatatggaaaataaggtttatttgatattttatgaaatggaaccctaattcaccaacatttttacccctttatagtactgcaataatttgttgtgagactctgaaatcgtttctgaattatcagaggaagaaaatcatttaaaaaaggaaaccagagctactggctctatcttacttcggtcatggtcttttaaaatctattcaatttattttaactagactaattcattcttaaagtaagtcagctaacatggaattttctgaggttacttaaaaaattttggaaatttccttagctctgcatgaagtatttttatctcttcttcttcttttttttctaaagaaatagtgtttgtgggtcttgataactgcccacaacagattttatatcatctggttttgatagagcaagggggtctaatgaatgattgaaactaacatttataaaatctttcaaatttgagaggcaggttcttggaagaaggaggatacaacagaatggcctctgtgtcactggtaggactctgaagacaggacttactgcctatgttccgacatgaagaaacagactagtgaagtatgttgtcaaaactttgagaattgtaaagcaatgttcacatgtaggttgataaaaataacagaagaagttatgttaacctaggtccgaccctaggtgctgtcatgttgtcactaccttcataataagcttcaaagaggtgctctgttattatctttaaaaattacagacgaggaaactaaggtttagacagtgttagtaacttgctcagggccagtcactcaatgtgtggcagagctggattccaagtcagtgctgtctggctctaaagcttagattcttttcattgcacttttattattaaaccaaagaacttatgattaaaatattttctgctttccttgacgatttatttcaagatctaaccatttctttttcctggacattctgagcagggagcactagctctcaacttccctgcctctaccctctggctgggctgcaccttctcctgctgcctgttcctcctgcttcatcagcacacagtgggactatacattagccagggtgttagacaggccctccctggaccttgtcttactttcccccttgtgttatgaggacaagctctgtagtaactacattgagaatcttaggagcaaaggctccccacccccatgggggcacgtcagtgacatttggctcctccattttgcttaagaaacctgtgaccagaccctcaccccaggcccatagtgagaaaagcctgttttcatttcttctttcaccaagcccatctggatagagcaggtgcagggctaggctcttaaaatagaagcccttgtttcatgtgacgtggcacggtggaaactcccttgcttccttgcctgttgatcagattaatgaaatgatgaaggtctctcccctcatcgtggtgttttcttgacttcctgtcattgtcagttgacctttctagtttcttcatttgtaaaatacaggacttgttcttcataacctcaagggtccctcctatctttgataatctgtctccatgcttccgattaggggtcagattttggaatttaccatttctatcttgtttatttctcccagcaatattattccagcaggaatagctgggactaaaacttattcttggttaaagcacatcatctcaccatcttgacatcccatttgctctataccatcaaccatctctgaccctgaaccccagtctccttctttgtaatttaggaataataataccttattcatggtgtgaatcatatgagagagaggatttaacattgcttagcaagtgatacacattaggcattcagacaatgcttgttcacttggggtcaaataataaggtccattttctcttcatgacttctagctattgattagctttgaggctgaaaaataagtttaagatgggccctctgacctcaagaggctagcaatattttatcttctttttaacgctatctcctataggaaggaaagctagcaatattttggataagacaaaataaatacatatgaaacagagaatggattaagtctggaaaatccttccagtgctacacctaggacaaggtaccccatgcagagcaggtaaattcttaaaaggatggtctctgagtcaaattttggagagtgaagtgccagcatagctgatcatcctaagaaaaagtcaagaccgcaagttatgggttccaacagtggagaaaaggctaaggaaattatgcactgttagtaagatagaatgatgtgcaccattcaaaatggtcaatatgatgcataagtagaaaaaaagaagtgctgtgaaacaacagcaagtgaaagaatttgaacacaaaattctagtaatagtgtcaatggctatgtatgaagatactcagataaatgttagaaaagaatataatgtgggaaatgaaaataatagatgtgttagggttatgggtttttggatgaatttcaaaaacattccttttattaggctttcacttcttaagtcaaacattttgaaaaatttcacattgtatgacttggattgcataatataccagttcctgggctaaggttccatctttctctggggcaggatttcctctctggttttcatcgtgatctctgcctttgaatggcttgctttttcttttaagagaaaaaagtatgacaaatccagtaggtgatggaatcctctctcttccatttatatttctgtggatcttccttctcaaattgcctataacttcatattgaatctgaagaaagggagagtttctaggagccctgatataagggctcagggatttgtgctgccatttctttagaaaatgcctgattttcccaagaatgggtcagctctaatggaggtacctattccttcaaggaaaagcagtcaacttagcaaacaggtaattccagaggtgatttacgttttactttggcagatggagccttcattttcaatagaactccctgtgaacttcctttaaaagtgttttgacttttctggaacacatggactccatgcagtgacgtgcccggtaggcagtaatgcatacttagggctggccttccacagcttgagtaggtgggttccctttaaatgaaacaatctgaagagatgcaacacaactgtgacccttggtggtcttccagcttttaatctgattcaggccactcatttcaaccctatgcaagccaatttgacgcaaatgagtccaatctaaccagtccaaaaaatacttgggtgtttgtgccaataaatctaacgatcaaatcattcccccttgaattagaagttaacaagacaggatagctcatactgccctctagtcattcctgccaccattaagaagcctggggctctttcttaccccatgtgccaacttctcagggcctccttgtctaattttgcttgagaatgtagagtagaggaaggagaaatggacagacagcctagagaagtgacttacagtctgggttcagctctaactactaatagtgttgaggacgtcagtcagcttctcgaagtctcagtctccatatttgttaaaataaagagggtagtctggtttttctggccccttctctcctgtcctcctagactatgaattcatttttagctttttaatgcaaatttttgattcattagaatctagcttcttcactctgccacttttagttggctcttcttagagcattagtgcccaatttgcactgttagaattttcccttgtttgtacccttcaaaatttttctttttttgggcaaggattgtatttttttctttttaactggctccttgaggatagatgttgtgatatctgtgtgcttgtatgtcctcaactgtgccctgcactgttagggcccttgtcaaaacaacacatttctcagtgattctgagactctttctcttatctatagaagtcataactcaagagtaaaatcataccaatattttacataaaccctagaatttttatagatctattatttctttttagagtacatattggaagtaacttcacaaggaacattttctttacttttttttttggaaaaaagatttatgcttataaccaaatgaggttgtttggcaaatttgtctggagagacacacacactcagggcaaataggcactcctttcctgggcaactcaattacctcttgcctctggtcaaaccactccacaaataaagtggactgatcctcttgactctatgtgtaagtgcccattgtgtgtgcacagagctggtgagaacggccatggtgctaggtgggggtggtgttggtggagttggactagattatctgggatcatgcgaaatggaaattcatttctagctggctggcttcagaaggtgccatctcctatttttatatgaagcgtgctttggaactcagggcaacgaagggtgggtgtgctgcacaaggacagcagaagagtgagctgactggtccctgaaatcgcagttggaaagtggattaccagtgcagtagaactcttcacggaggcctggaccatcaggtctaatggtgttgttccaggtgggtggtcatgtggagcaaaaatatttgaaatcagcgagcacgtacctgagagatgacttttccacttgggctagtctcttgatatttctggtcctgtttcttcatctgtaaactgggttagtaatgtcacactctgtgagttggtgcatccagataacaaacaaacaaacccacacacagaaaaacaatccccataaatgccctataaacttatattaatcatcaacaattcatttatttgttcactcacttatttattcaacaaatactcgtatgaccaaagcactgtgctttgtgctaagctctacaataaatatagaattgtataaagatcaaggagtaaaaatcctagttcaggtcctcaataaatgataggtgaatcatagactgaaacgtggaagtaaagtaaggaggtcttccacgactattgtgatcttcaaatgttcttttgggtgcagagtttccccgggaaactgccagtttctataatggacaaaagactttgcttttcaggagtatatattttgataggaaataaagatagaaatacttggaacttagacaaattaaatacataaatgatggatagtatgtagggaatacagtactgtggggaatcaaagagagggtgaattctgggtgaaatcaggagggtttctcattattcacagatgatctcttacaggaggtgggaatttttaggtcagctggaaatggaaccaggctttcatgttcagatatacttgcagataaacaactcataagaattataagactaacagcttcgttagtttacatttgacaatttatttgtgcctcattattttgggatgtgtcaagaatctgataacatgggtgataatgctatttgccactgtaatatcaggtagtcctagtgaaaatgcaacttttaagaacttgtttaattgtatctaccaactcttactgcagaatgtagacttgaaagaagcacattcctttttcttacataatcattaggggttactacatttctgagcaacaaggctcaagagtttccaatggaaatgtaatttcaattagaaaaccaaattgaggttgagggtggagagagccagctgcagaaggtatctggacagcagcatgtatctgcaggcctgcgtgtgtgccagggtgggggcaaggaggggtagattgtgtcattttccacatatgtttatttagcttctcctgtttcagggactttgggttttattaatagtcaatttaggatattgtgcctccatcctcaagcattgtcaatcttaaaaggatgggtgggagtggtaggcattaagcctcagaatcttctagccctttggctggagtggttctgtctgctattgctgcaacctgaggaaatctttcaaattctgggtgggctgctctggttaatatagtggagactctaacaaaaattatgtcatccagcaatagagctctggtgcagtgagtggcagactaactgatgaacatctcaatgcacagcaattctcagcagccctcagccagggcactcctagggagggcctctggttacaatgctcttcagagcctgcccagtctgtctctgtttctctgtcttttctttcctttctcattattcccatcactattattgtttctctttctctaaggtctgtatattatcctttcccctagttctttgaaaaatttacttcagttgcacacacaatagaattaaatgataaacatcaattttctaaataaaatgctgtgtacacccacactcacacccacagagtattttctatttcttaacaacaacaagaaaaacaacaaaatgcatagtaagaattaaaaaatctggaggaatattgaaggccagggcagattatttgtttagattagtgatccttaacccagaatttcctcacatctagattattgtctggtggatgacaaaggaaaatatatattggaaacccagttgtggatccttgagaatacagtagaaagaacagtgaaaattgaaagggaaaaggtgagaaaaccttcttattcatgtccaggaacagaattgggcttgaatttggtggctgcagctctgaacggactcaaagtgagtgtctgtaaatcctgctcagcaacacgaggacaggggttgccatgtcctcctcttccttatgtaccttccctcatctgcctccctatctctagcacatggaccaggggctcataaatgtctgtaggatggaaaaatctaggaatacatgtggggtcagaagttgtaagagattgggttgaatatattctgattccccaagttgtttttgtctacttattttctttttcttctctgtgatggttctttttttcttgttatttgtatctttgcacaatgaaagacaaaaaaaaaaatagttctagtcactagaggacttcagtaaacatgctatcacttacctgcttatgaaccaagaggttgggaaggcaggtctcagttggcatgtagcccgagaagagtttgtcacatcttagagtctagaacctcctttcccacagagatacaaaacacacagttaactcactggtattttggctgggaagatagctgaatgatagcaccactttaaatcatatagtgatgactgctgctgatgatgcacatttcttttcagtatgaaatattagttttttgggaaatccaatgttcaccctaatcttgcagcattttgtaatttccatcatggcactgagcaggaggcaggatgggctgaagggaaatacactgaactgaactggatccttaggcctgtgggtgagacacagtattggcagatagtgccttcaccttgtggctcagtttcttcaggtttcaaaattgagagacttttttcacttttacatgttaagtaggtaaggatgaacggaaggattgtgatgtattgcatattggaagaaacaaaggtatcaggtcaaaattaagaagggtttatttgtggaattactgcagggagaatatccactgagctcagccattgaactcaagaacctgttagtaattaagaatatgaaaagattgtgaattgagcaccttctctgcaccatgccccgtacaaagtggattatacacaatatttcatttgctgttcacagtgatgttgacatagaggtttattgttattgctttattataaacaagtaaccccaaacaaagaggggataaaaaagtgatagattcccatgtgagagctcactaacccatggtatcccaatcagagggctagagcattggaatgacgtgtgaagacactgttgatgttaggtaattcccaggttggttaatgtttgggcaggaggggtataacttctctggcctccaatatgtgttaggcaccccttctgtgtgcttacgtagagctctgtaggcactcctctcagctccatttctccatgttgcaatttctggttatttgtttatacactactctaggagctccttgaggtagagagttctgtcttgttgactatgttatctgcaaatcttcatagagagccaggtacatggaaatgctaatacatttctatggaattagtgaaggtggacattcatacgtccaggcatatgaacaggtttttctctggagttggtgttgtttggtgtagaagggctgtcaatgagccttatgacttgaggaaggatcaacagatgggtggatagaagtacagatggttatatgcatggatggaaagggaatatggtagaagagaatgcttctgtcatgggctctaggaagtttactgaaatatattctgaaaggttgatatgtatagttcatccttattcttcccagcctctcttttctgagatgaccaaactattcaacataaatggtttcctgctgctcttaaatatttccaggacacttctgggtctcctgaagcacctgcttgctcacagcttcattctcacgtgaagtctgcataggtcctgttaccatatcagaactcttagaggacacttattctgggctgaggttttccaaggtgagaactccaggactggagatggagcagtgcatttaggtgaagtgatatcaaacaaggttggggttggtgttacttcccatcccagtgctggacacagccttggccaggtcctgttgtgaccccaggtgcacggggccttgggaacttctgaaagggtgtggagtgctccacccagccctgttggaggaggatgggagcgaaagcaacagatgtgctcaaggttctgttttcagttccccaaagggtcttctccttgaccaaagcagtgtgacggttgctatgacagttgctatcttggtccctgggactctccctcataaggtagcattactttttttaatcttctcaggcaagtaaccatgaaactctgtaataaccagtctgaggtggggctggttgggggcatgtttgggcctgagtactgggatgtgatggtggaatatgctggggtaccaagaggtacctttgattaatgagttatttttccaaattagaccaacactcctcctagttgtcttaggcttgatgactctccatttctgcagaagttcagaattcttcccttgagatgtctgcaattagttcattgttgcaaattataaaaacataacaggtagaaagaacactgaccttgaatctcaaatctgtctctaccaggtcatgtcattcagtctctgcttgggtcttctcatgtgttaaatgagagctttgatttccaagctccttttcactctgagagtcactgatgttttgcctctgaaaatggcaaccatgaagagtagttactgagaaaccagcactgtgttttagagttagggctcttgatcaggctgcctcattttgaatcctgatttgggaatttctgatgatgtgatcttggacatggtattgactttctctaagtcttagtttttttttttttttttatctgcaaaagagggtaaaacaagctaccccagaggctgctggaagattcagtgacatgttgcttgtcagtgttgagacattgtatccattacaactatcatagaataaaaacctgttacaagttggcatgggccgagctgccagcaatttcatacatctcttttatgcctattttgtttttcattttgatcatcaatattttaatggtgtgtcataaattgggggctctttcttatttgttcttggacccatggtgaaataaaagcttgtatatttttttagaaggattcatagagatgaaaggcccttactgaacattcagtctgaccttattagttttaaaggagctgactgagacctaactgttattattacaaactgatattattggaaaccaacacagaacctaccatgtgcaaaactgtgggaaaggcttggaagtctgggtttgacaacctgagtttaaatagtgattctttgtcttactagctccgtaatcccaaacacgtaatgcaatctttcttagtctgtttcttcatctatgagacagggctaatgagaaacatctcagtgtatggtatgacagcaaagggggtcatacaggtgacagtgctagcaaatgtcagtcccctcctcttctctacctcccaactcccttgaccctctcctctgtcatcccttttctggctgcgtgcagagaatcttgctagctttagggatacaaaaggttccagagttgggagacagactgttctcatacagagatcaataaccacatgatatgggtagtaagggccattcagatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcaggtgagggcatgtctgttggggtgtttatggagggttttttcagggaaagggtctgcaaatggagccaacaagaaaggaactggcaggtggtcaggatgtcctcctgtgagagtcactcttctccccatcctctctcctcttagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgtagagcccctttgtccttccagtgaccacctcatttctctccttccctcttctaattctctccttgaaagcattgtccatgcatgctctctccaatttcttcgctctcattctcttttgaacccatttggatcagacttttgcccctggcattctatagaaactgcacttgtctagttcaccagtgattcccaatatggctaaatccaatggcccatttccattcctaatcttggttgacttgtcatcagcaattgacacagttgatccattttttcctctttgtaacatttttcctcttggatcctaggataacaacactgtcctgtttttttcatctccttctctagccagtctatttcaatcttcttttctggttcctcctcatcttgctgacttctttacgttggagtgcctcctggctcagtgcttggatttcttttttggtatgtcgttgctaggtactctctcccagtctgatggctttttacaccatgtgtgtggtgatgacatcacgtttgtgtctccagcactgacctcttgcttctgaattctagactcttatagccagttgtccatctgacatctccactttgttgtctaatagacatctcagactcaacgtacccaaaacagagctcctaaagcttcaggaatcgagactgtgtctattgacataaggataataaaattgattaggggaattaaataaaatagaaatagaccaaacttacattgtcatttgatttccaacaaaagcaccaaagcaatctaatgggaaagaaaagtctttacacgaatagtgctggaattttcagcagctcatgaaatgtatatatattttatgaaaaaaagtaaaaataaaagtaaaaaatggtgctggaacagctgcacatccacatggaaaaaatgaaccttgacccttacctcatgctatacacaaaaattaattccaggtgaattaaagttgagctcccaaacctatgcctatgttctatagacttcttcatttcagttaaggcaactctatccttccaattcatcaggctgaaaaccctggattcccccttcagttttctctcttccccacatcaacactagcagtgcttcctggcagggctactttcaaagtagcttcatctcctgcttggattatgtaacaggctcccaactggggtttccacacatcttcctatcccaccctggatgggttattctcatcagatcacccagagaaatcctgtttatgtatgtcagatgatattattattatttttattatttttgagacagggtctcactctgtctctcaggctgcagtacagtagcacgatcacagcttactgcagcctccacctccctgggctccctacctcagcctcccaagtagctaggactacaggcacacaccaccacgcctggctaattgtttgtataatattttttgtagagacagggtttccccatgttgcctagtctggtctcaaactccacccacctcagcctccctaagtgctgggattactggcgtgagccaccgtctccggcctcaatattattattttgctcaaagcctaccagcctcatctcacttaaaagaaatgcttcctgtgacccacaaaacccgacatgacctgccctccctataaccctgtgtcatgagcactccgggcacatgcccacctcagggctttttatttgcagttcctgctgtgctcttacctatttatccacatggtttacttcccacttcatttaaatctttacctgaatgctaccttcttagtgacacctttcctgatgaccctgtcaaaacttataaccctcctccaacaattcctgcccttgctttaatgctctgtttaccccgtcgttatctaaaatactatattttaaaatttatcaatctttatcatttatctccccagctagactataagcttcacaaaggcagggagttttacctgtgtgatagcctcaggatcaaagacagtacctggcacatttcaggcattcaatacatacttactgaatgaaagaataaagtgtggccaggcgcggtggctcacacctgtaatcccagcactttgggagactgaggtgggtggatcatctgtggtcaggagtttgaggccagcctgacgaacatggtgaaaccctgtctccactaaaaatacaaaattaaccgggcatagtggcacatgcttgtaatcccagctactcaggaggctgaggcaggagaatcacttgaacctgggaggcagaggttgcagtgagctgagattgcaccattgcactccagcgtggacaacaagagcaaaactccatctcaaaaaaaaaaaaaaaaaagactaaattgtgattgaggtttacagatgactggtcagtgtttcccatatccccaaactgttttcctgcttgatgctattatttcatggggcaagttcaatttccttatccattgcttgactgtccaattagattggcagagcgttaatggcaaggactgtgtatcttatcttgtactgttctatatcctccactattgctgccattgtgagggggaacaagggagtggcttccctccatccagttccctacatcatatgtcatatcatacaaatatattagtatttataaatatattaggtctacctccttctctgtgcaaaatatgtcatatcaatgtctgagttctagtatgttcatattcttgggcaattatgtaattatggcttatgttgtcataacttctatgcccgtatttataagaaaaaaatattgagagcatttccaggaaaataattgactggaagaagagagagtggtaaaaaggaattaatagtgagctaactatcagtatatacaagcccagccttctaggatctggataacccgaagcaagaatttctctgtcagttttctcatctgtataatggtgagagtgggggtgttgaagtagaaaaatcctttgattaatatttattctaatccttgactaggtgctcagtgttagtccagggaactctatcttatttcttcatgggccagcttaatgtcaagatccaaaactcttgtgtaaagcttgggaccattttcaaggatacatttagtagtttacaataatctagataacactgactgatagaaatatgcaggaaatacagaaaattataatgtgatccacatatataatttagaagttttcactagccatgttataaaagtaaaaagaaatctgtgcaatcaattttaataatatttttgtttgcacacaagatatacagggtaatctcaacatgtaatcatataaaatattaatattttacacgtattttttgtacaaaatgttaaaaattggatgtgtttttacacgtatagcccatcttagtatggactggccttatctccagagctcaataactctgtgtggctagtggcaggatattggatatcaagtctagaacatacgtgaattaattcaaggttcaagcacattaaggctgaaagagttatgactgaagaacaagttcaaggaggaaatcaaacaatagccaaatttcactgagctactccttccattactaatgataacaaatatttatagatcccttagtatatactaggcctgatgcttagaactttatatgaactgtttcatttaatcctcacagcaatcttacaagtaagacctccaccccctttcagatgagaaaactgaagcacaaaagtgcagtaacttgctattatgacttgtgagcatattttcccaggcaattatatgcacagtatgatgtaggtaaagcagcccaataatttattcactatatttctccatgctcatggtaaggactgacttgatccctggtggtcacccacttgtgctccctcagtgagggaagggctgcagagcccctggcccgtgtcctagtgactcaggcttgggatctccagcagctgctatggttgacaatttagtttagtaaaatgttagatcctaccctgataactgttataaaaaatcctccttccccttccccagcacaggtacccagcccaaggggcactttctatggaaagatgaaaagaactgacatggacttgagctcactgggggtgcaggtttcaagaaagaacaaagagagctgttaggttgaagagacgcagttgaagagttaagtcttggaattgttaatacctggaacaaggcacggtgtgaaaagacaaagaaacacacaaacatcaatctgtcctcctcttttctctttctgtttcatttcttatcctccatcagtcagactttgcttcctctttctcctccttcacctcctcctccctgcccttcccaatttctttctatcttccatttattgttcttccaaaattcgtatactcatcctctcttctccctttctcttttctccaaaataatatgttcaacttactgacttgctcagggacttgtgggggcgaatgtattagcaccaaacctaggaaacatggcgaattctaaaaacttgttctcatagaaaaaagagttaaaaatagaaagctacagtccagttttgaagccacagaagacctcactctgatgtatagacattagagtcagaaaaagactttgaaaagaccagtgaagctccttgtcccacagacagtgtgagggagggacaaggggaattgtgtgcccaagcgtacttgggatggtgtaggtggctgataagagtgtcagtggaggtggtggttagcatttggagtgccccaatcttgtgacactaaacatttattgttatactaaccccactgccaactaccaggaagttttcatttttcttactgtgtcttagtctccatggcatctataaactgttttcccccaatgtccaggcatcattcctctcccacagttgatgtctggctctgtgccatgggtgtgggcctgcctcttctctctcagaatgactgctgtttcatgcttggtgagccacgcagtatgccaagctgctgtctctgacctggagaaaggatacccatcctaccacaggtggggcatatcatgggatggccttcctggttttccttggcagacacatttttctcacttttttttttctctcctcccttctctttttccctccctctttgatttcttctcttttccttttctttctcttgcctcacttctgccctagatctaccatgggacccagggagctttggagccatgcaacccacagtgtgctaagctttttactcatgctatttcttttaatcttcacaattctttacctatcaggcattaccatcagatctgcaccttacaggtgagaaagggaggcccacaccgattaagaaatgtgctcagggccacacagcctgtacatgtcagagtaagggcattctcatgccaaggttcattttcagagccaaaagcataccacgtctcaggagaagcaggctagatctcttgtctgcttggcttttaactcatgctgacctgaactttctggatttgagtaactctcagacctgtggagcccgatttctgtgagtggattttgccagccacctggggaggtgaacccttgctggggtatggctcatcagtgtagaagggagttccttcagaggtacgctgtcttctcggccatccccattgtagtagtttcttgggtctgccctaacaaagtaccacaaactaagagccgtaaaacaacagaagtttattctgtcataggtctggagacagaaatctgaattcaaggcacaggcagagttagtgtcttctgcaggttctcggggagaaaccatcccacacctctccagcttctggtggctcccagcaatccttggtgctctttggctctcagctgcatccctctggtctctgcctccttggtcatgtggctttcttcctatgtgtcactgcatctccaatctccttcttcttataaggacaccagtcattggatttagggcccactcggatccagcataaaaaaaaagtttaaaaaaattatttggaaataattatagattcacagaaagtagcaaagacaggatataaagcacagaggtctgatgtgtcctgcacccagtttctcctgttggttacttcttacgtaattacagtacgatattaaaaccaagaatttgacattgataaaataagtgtgtacagttctatgtcattttatcacatgtctagatgcctgcaactaccactgcaatcaagatacagatttatcccatgatcacaaagatctccctttatagtttcgcctactcttctttctccaccaccctaacccctggcaaccagaatctgttctctatccctataattttgtcacttcaacaatgttacataaaaggaatcacatggtatgtgaccctttcagattggcttttttcactcagtagaaagtccttcagaatcactccagttctctgtatcaacacttcgttcctttttattgcctcatagcattctatggcatggatatattacaatttgttaggctagttgcctattgagggatgggttggctctttctagctttggctacaacaaataaagctgctgtgaacaatcatgtatgggttctgtgtggacataagtttttatttcctgggggtaaattcccaaggagtacaattcctgggtcatatggtaggtgtcttttgtttagtttttcaagaaactgacaactattttctagagtagctatacccttttatattcccaccagcaatatatgaatgatccattttcaccgcatcctcacaaacatttcagtatgacctaattttgacttgattacctctgcaaagaccctatttccaaataaagtcacatttatgtgacccatttatgagtaccaagagcaaggagttgagcatacctttttgaaggacacaattccacctgcagcacctgtcttcacttgcttaggttatgggtgggtttcccttcagagtgttatcttctgagaagaaggtttgaattcatagctggattatgcctgcctttgattgttcaatttggcccccagggatgagtgagcaagttcatgtcattggaagggacattactgagtctcacccctactcaaacctccaaagtttgaaagatttgatactcatcaacattctcaagaggcagaagggcaaggtgcttccttatgtagtttctccatgactgtccttccccactttcccagtactgactggaaagaaaaacaaagcaggacaaagggattgtcagtcatttgagggaagggatgctgtgttagttactcctgaaccccttcagagtgtaggcagagagaggtacttagaaaggtgtgttggatggatgagtagctgagaggggcagggccagagtgccccatagaatgaggaagagtcctcatttacatgtgcccttcccccttcccaaacatgtgagtgttcatacatgggtttccagtgtctgggcaaggttaattctgtcctctgtccccttgctgaaggtctgtttcatttaatttctatgtatgtgtgctcctagctagccaaacagggcacagatgccaggaaaatagcaggcctgttgttttgttgagcaccttgagccctggaaggcagactcattcagggctcaagagggcaggattaggcaggtagctatttgatcccaggcccccccacttaccagctgcgtggtcttgacctattacttattcctcttctatctattaactgggtataagatgttctttatgtgaagttattttgaagcataatgtgtatacagaacagtgcacagatcataactgcacaaccccacacgaggaacagaacattaccaagaccccagaagccccttcttgtcttctcccaggcactaactcgcccacccccagctaagagtaatttccatccaaatttctaactttatttttacctggttttgaactttatatggatgaaaacatacagaacatatcttttgcattgagtttctcttatgtaacattatttttatgagattcatctgtgtgagtaggtatagttgtagcttgttaattctcctcattgggtattctaatgtataaacataccacagtttaataactcattctattgttggacaatcgggctatttccaatttttggcttttgtaaataaagctgctttgaacattcttgcatagttttttggtgggtggggacactcagtcatctagaagtgggattgctgagttatagaatatatttgtctctcagctttatagaacctttgcaacattttaatgaatgtttttaatctcacagtatagtgtggattaaattaggttgtggaaagtactcaatacggcccttggcagacaggagtccctcagtacctgtttaaaaatgtaaataaggcatgacattccattaagtctaagtaccatgatgaacttaaacatttccctattgtttgtttatttaattgcttttattgtgttgttattttatatcatgttgcaatgaatgattctctttatagcaggtttcttcttttgaaaaatttgctttggttgattctcagggaattgaatcaaaggatatatgactgtaagacctgtcacccttaaaaaggactatgagggcttgctgaggaggggaaaacaaggaagcaagtctctcctaccatggcccaggggactgtgaggacagaaggcttgtgggtttgagggaggactgtcttgcagaggatgatagggtaaaatagaatgaaggatgatttttataaatggttatgcgccttaggatgactacatatttagtcccttataagagaaattgagtagttggtaaaacaacagataataattattaaatgaggaaagagagaaaccacaggtgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccacagttcctgaggaaagaagcaaacaggatggtgtttaagtaacaaagttctgcccttgggtgtgttgtttgcggataatcacagggcatgttagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaaccatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttgcagaccaaaataatctccttaaatatcacttttgagatcagctggggtaaacgacagcaacacaatgacaaatcattaaactattttagagattatgaaattaaaatactcagattaaaattttcctatcacagaattaaggtactggaaaatatgtttaagtttttattaatcacattgctataggtttagatattttgtacaactgaaataaaatcacacactggcagctacatttttgaaagttaaaaacatggtcacgaatatatcttattttaaaatcagttaatataccttaatggtatttaatgccaaattcaaagtgaattgatcaagccctcagtggccaggtcatgggtgtgatttttactctgaaagaattacatatttctttctttttggttgagcttttgttatttaaatacatttgatgagaggatattgaaataattaaatagcactgaaaaaaaaaaaagctttaaattatttacaatcccctaatggaaattttcactaatgagatatcataatgaatgtgaattttatttctgaaatctctaataaatcagtcttctccctggttttcccagctcagcgcccattacgtttctgttctctttcccttagtggcattatttgtatcactgtgcatcaggaaagctggctacggcagcatcaatcgggcagacacagggtggccacggccactagcggcaaggcggctgccccaagagcgcggtggcatggccaccaaagccactcaatcgagaaagaccgcggctctgtctacagctcgcggtgccacggccttcttggcagaataaaaatgtagacaagtaataacagaggataatgaaagaacatactctttaaaatatttcctatttttttcacagacccacggtcattaaaaaatgcaattatttactttttttcatttaaacacatttctttgagattgagcttttgggaataaccacctttccaccattacaataagagataatttcacgtttagtctaatgtacaaattggatttttaaaaaatgagctctatctgtgaagcccttattcctatagaatgtgtctttttgagtttattacttattacagactctaaaaacaacattgctgctgattttcaagtaagctgcctcttctacatagcaaataggtacacttcacttttccctgatttttcttagggcgtgctattgatttttattgttgtctgacaaaataatttatcaaacaaaagggagaaagactaaaaaatgtatttttccacttttctgtatcatgcataatcagcaacaaccaatacaatatttggcaagagtgaacaaaaataaatttacttttgctccttagaaatacaagggttcctttttagttacactttttttttttactttgtgtcattcagtttagagcaatttaatctttttttctccaaatccatttttgaagctgagtttaacttttgcaacccatggcaaatcttaaatgccctcatttaccaatctttaccaaactcctatttaagcctctaaaagtcaatactggccatcagacccaaatttcagaagacaatagtgaaaaattacttacgtttaatctccagtcgtgtcccttggccgaaggtgatccacagtgttaacttaattactttccccttaacaaaaatctcttttcgctgttaatatcactaacctgaccgatgcagagaaaatcttgcaattgagatgcctcacttaactggctagcgcttggctgttccttaagatgaactaattttctatcccttactcatctgactttttgaaagaatctggtactctttggaattgacctgagctaatatctcaaacacaaaaacgctccaaatttaaaaccttataagaaaaagcattaggaaagtgcacttacgtttgatctccaccttggtccctccgccgaaagtgagccacagtgagggatctcaccctttcccctcaacaaaaacctctcttgaagccaatcatatgagataggctgcttgttcagagaaaaatctagctatttcttccccatttcccccatgaatcctattctcctctcaaacccaatgattcgtctatttgctcagctttttaagttcattttctggtgtcctgctatttacttctgggtcaccaggtttattcaaccaaaatatcacaaaacttgcacaaatgatacaatggcactaaaatctcacgaataattgagacagatgtacttacgtttgatatccactttggtcccagggccgaaagtgaatcacagtgattcgtcttaacttttccctttacaaaaacctccctgaaagctcagcaagcctctttcccccaatgaagttattttgatttagaaatcttaaaaattagccacaagctagcgtcctgtggaacaatttcccctcctctgtacctaacctgggaatgaagtttgttagatccctggcatccgactaatgaaaatccacacaaaggaacacaaagtaaactaattagcaacagtgaagaatcagtggaaaaaagtacttacgtttgatctccagcttggtcccctggccaaaactgcacacacaatggttcctcttaacttccctcctatacaaaaactccctttctgacaattgaccaaggctctgtccagaacatgttatgttccccaggacatttctgaagctattacttagacaagttattctcacccaatgactgaatcttgcttgctcttcaaagaaaatgtgcaatcaattctcgagtttgactacagacttatctttatcttttccctgaaggatatcagaggctgattgcagagtcaccttatagatcacttcatagacacagggaacagaagacacagacaactgaggaagcaaagtttaaattctactcacgtttgatttccaccttggtcccttggccgaacgtccaccacagtgagagctctccattgtcttgctgaacaaaaacccttctcaccaaaggggaacagagtcctgggtcagctgctgaagctcaactcccttttcgagcaggtgtggaaaccctgaggcttctctgacatagcatgtgtttattttcttaggtgagacctaaaatccaagaagagaatatatttacgtctatggcctgatggttcctttctttagcaacttgccacatctggactgcttattatttatttattttttagaaagtagactgaatgttaattacaaagaaaaacaagcaattaaaaaaaatggccagtttttttgtactttcttttggggtgggctgggggggcttttgcaaaggataaacttcatttagtgtaattatggaaatcatcagcttctcaatgagtaataattacaggttgtcttactattttatcttctcctttgctgcaatgttatttaaaaaaaggtagactaaatatatatcaacttaaggctcataactttgaaatgcattttgaaatgtagctccagatggtatacgaaaccaaagtgaagactaatagagtagaaaagtagactttacttggttggtttgtctgttttcacagcacaggaagagctcagctcttactgagctggaccaggcgcatgccatctttggagctgccatggagtcccagtgttccatagtgtttccatagtaatctcatcaacaacactgaagaccttttcagtattttcttttgagtccagctccatttttgcagccttgtatctctcttaaccttccatctccaccccttccatacattactcccacctccctacactccttagagtttttctatggcctccagctttcacaagcactccctctgcttgggaacatctttgtccacctgggttagcttgtgaactgctaattgtctttcaaaattcaactgaagagagaccttctctcagattagccctgagcaggtgacctgaatttacagagtacagagacaggtcactgggcctagagtacctaattattttttattttatttatttattttttttgagacggagtctcgctctgtcgcccaggctggagtgcagtggtgcgatcttggctcactgcaagctccgcctcccgggttcacaccattctcctgcctcagcctcccgactagctgggactaaaggcgcccgccaccacgcctcgctaattttttgtatttttagtagagacggggtttcaccgtgttagccaggatggtctcgatctcctgacctcgtgatccgcccacctcggcctcccaaagtgctgggattacaggcgtgagccaccgcgcccagccgagtgcctgtttatttttacctgctttcagattctcttctacccttctaaattataagctgtttgatgttttatttgccctgtatttgggaggctccgtccagtatctttacttagcaaatgcttaacaaacattttcagaataaataaaaaaaaatacctaattgaaagtcaataatagatcagagatgctatcatagaccaaagactaatactgactgccacaacagtaacttttacaacagaaatcataactacaattctaaagattaggggtaggtttatttgattctgtcactggcagctttgctagttgccttgaatagcagaattagcatttggtctcaccagaagatgaggaaggagagggatcaagttagaggtggagagttaacattggcaagtgaaatttaatgtgcaaaatagctgaccaagggcatagtccttttttaaaggggacacaaagtgattttctctgcagacatacacgcaataccaatcataaagggtgacatttattgagcacttactaagtgccagacattgtacatggatcatcacatttaattattcccaagactctatgaactaggaactaatattatcccctactttgtaggtgcaaaaacttgagggcagagaggtcaaggaactggcttatggcagtaagtggcagagctgtgacctaaactcagatcccatgtttttaactgaactatatgcagattatactccaggagtaaagtcactcaacggaagcaacaagcgtgacagggaatgctgggatgggggaaggtaaaaggaactccttagactgggataagtgtgtacagacgtatgtataagactacacatggaaatattgtttaaagagtgaaaaataactaaaatcctcattaataggagtttggttaaactgtgctagagctttacaatgtagcacaaagcagacattaaggggaagacgtagacttctatatagttacgtggaaggtgtttgtgaaaatgcaggtcactgaagagtatgtgtggtgagatatcatgatcccatctacattgaatatatatgtatataaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaaactttgaagaacaccacagagatttaaaccatgtcattgaattcatagagaaactggaatttagaaacattttttccattgcaaaaacaggaggcgtccttgaagcagccagttctagttttccccacagagccccagaaaagccgtacttcagagctatcgggctgggaatggtgataggtggacagtggagagtggaataacacctgggtcatctctctgctggttacagacagcttggccctcatgcttcaggccgtgggaatagagattgaaagaaaaagggggcaagttaataggcattcaatagtaatgggatttaaaaaaccctcccaaaccactagaaggaaaagaaatagacaaaaataataaaccaatccagcaaagtttaggaaaagtgaataaaaaattgaggtaagcacgatacataaaagtacaaattaagtttgaaggaccaagtcaaaatatacagtcacaaactattgtgaatgttaaattatttaaaactttaaataatttatctaaaaataaaaataaaccaaaaagatgactatgtatgttttcaaggatatttgattcactagagaaacagttcatttgcttcctatttatgatgattaaaaactagattgcaaaagttagatgttaatgtaaagaaaactttatgaaaatgataatggatttttatctagtagaaaagataaccccaatgcttatggttttattgctctgtaggacattaacaagttgtgcatcttatttagcaaacttattctaacattagtagatgtgagtgtgtgtgtgtgcgtgtgtgtgtgtgtacgtatacatataggtgtgtgcaggtatgtgtatatgtatgtatgtaggtatatatgtatatactagcaaatgataaagttggttcaaaggacgatgtacagtagtacctccttatccacaattttgctttctggggtttcagttacctgtaggcaactgtagtctgaaaatattaaaaagaaatttctagaaataagaatttactcattttaaattgtgtgccttagtagcgtgatgacatatcatgcccttccgctccataccagcctgggactgaatcatccctttgtccagcgtctccatgctgtctacacttaccctcctgtttagatgcttagtagccctcttggtcatcagattgactgtcatgatatcctagtgtttgtgctcaagtaactcttattttactgaattgttctattttattactagttattgttgttaacctcttactgtgactaattaatgcattttatcataggtaagtgtgtataggaaaaaacatagcatatgtagggttgtgcaatagcatccactggggggagaattttgctgaagttagaacagagaagactgtccagaagaaagaattttctatacttgccaccttttttctgtttggtgtcctcatgtaagtctcagtgttacgatctgtctccccacctcaatcactgccctctgtctctggaaggaaattccccttgggctgaggccagcatggtgccagacaggagagatccagtacccactctggaaaatttcataagataactggttctccaccttcttcagggaccttttatcatatctcatgtgcccatggcatttgtcactgccatctgcacaacactgaactccagcaacatcaactgagaagaaagagagagagagggagaaagagaaagagagagagagaaaagtcgtttgttgattgagccacacaaaattttttttctaattaaattatatatccaggtagctgcaatatgctacaatcccaaatacacatatttattaaatatgattcaaagagcattcattgagtactctgtatcaaggcacaatgtaaaataagtgcaaaattactggtgattgttacgcctttctgtgggactcgactctctctggttggaggtactgtgtgggagcacgtgagctccaatcaggtggtctggagggagcaaaatgcagctgttggaggttaaatatgaagggaaatagcagtaggcatcggatagcatagaatgaaaataaaagtgcatatacttccagtgcctgttttacagattccttgtctttttttttttttttgaagacggagtctccctctgtcgcccaggctggagtgcaatgctgtgatcttggctcactgcaacctccgccttctgggttcaagcgattctcctgcctcagcctgctgagtagctgagattacaggtgcgcaccatcacgcccggctaatttttgtatttttagtagaggcggtgtttcactatgttggtaaggctggtctcgagctcctgacctcgtgatccacctgcctcagcctcccaaagtgctgggattacaggcatgagccagtgcgcctggcctccttgttttttaaaactagttcaaaccctcaactcataatttgggaaattcaggtcataggatgccctgttatttataaggtatccagcaatgcatggaacagaatatttaacttttaaaaaacttatattaggttgttgcaaaagtaattgctgtcattttctcctttctttttctttttctttctttctttctttctttttctttctttctctttcttcttttctttctttttctttctttctctttctttcctttctttcttttctttctctttcttttctttcctttttctttcttgtctttctctttctttctctttctttttctttctttctctttctttcctttctttcttttctttctttctctttctttcctctttcttttctttcccctttctttctttctttctttcttgtctttctttctttcttctttctttctttttttctttccttcttctttccttcctttcctttccttccttcctccctctctccctcccttccttccttttccttccttccttcccttccattcccttcccttccccttccttccttccctccctccctcccttccttccttctctctctctttctttctttcttcctttctttctttctctttcctttcttctttcgttgttgtgttccagaacgatttagtgttacctacagttcccagagaaagaatcctgtcttgaggggtggctggggcagggctactactctccctgctctgtgctctagtggccaggtggatcagctccagctgccaggtcaaatttcctagggaatggaattctgtctttttaacaagaacaaaataggtgcttagtaaatataagatgccttcagcttttagtatatgcataatcataaatataaatttgtttaaaacctgaactattctgatgttctcactggctagccaaacttaaaatgtgtatttggacttgaatttcccaccaagggtgttactagcttctttactgttgcagctgccttttgttttgtttttgaaagtttaaaaaaatacacaagggggcttttgcttcctgaaagatggagtagaattacttttacctatttctctcaagtaaagtaaaaaccccggacattgtacgtaaagcaaacttatgaagactctggaagctggagagaagaaggcagaccagttaggaacattgggacccaaggagcgacccagcagtgcattccacggggtttctttttgcctcatccattccagacttggttctggagaagtttgtcaacccagaaacaccaacaggcccagaaaaacataaagccctaataaaaagctggctctctctagtcaaaggagaaagaaaggggaagcccagtaaaacaattcttaggcagtaacggctctgctccattcaaacacccaacttctccttcctgagtggcaagagaggaaattcgctgagatgagtttaaatgagatccaaagcctcataacacaatactccaaagtccagatttcaaatgaaaaccacacatcccaacaggaaccaggggaaccaggaaaatctcagctttgatgagacagttaagaggcgctaatactgacatgacagagacgttagaattacctgacaagaatgttaaagctgccatcgtaagaacacatcaaactcaacaccaccatcaatgagtaagatcataaatcaacatttctggaaaactccaaccagcaccagcagaattcgcattcttttcaagtgctcatggaacatataccaaaattgccatatactgggccatgtaacaaacctcaacaaatttaatagaactgaaatcacatgaagtgtgttctctgaccacctggaatcaaactggaaatcgataatagaaaaataatgggaaaaatgccaaacccttggaaacaaaacaacacacttctaaacaatccatgggagatttcaaggaaaataaaagattatatattgaatagaataaaactgaagatgtaacatattataatatcaaggatacagtaaaagcccaaagaaatgaaaacttatcccagaaaaatgaaaacttagcacaaaaacgtatacaatacacaactattcatagtggttttatttgtattaaaaaaaaactggaatcagtcaaaatgtcctacaatagattaatggtaaaacaaactgcggtacatccatcccatggaataattagtaataaaaagtagtgagttgggcacggtggttcatacctacaatccatacctacatacctacagcactttgtgaagtagaggtgggagaatcgcttgacctaggagtttgagaccagcgtaggcaacatagtgagaccatgtctctaaaaaaaatttaaaaaaattagctgtgtgttgtgtcccatgcctgtagtcctagctacttgggaggctgaggcaggaggaagcttgagcccaggagttcgaggctgctagagagagttatgatctcgccactgcactccaccctgtgtgacagagtgagactctgtctctaaaaaaaattaaaaaaaaaatagtgagctgttgatacacatgacttgaatggatctgaggggcattatgctgagtataaaggtcacatattgcatgattccatttacataacgtttttgtcttttcaaaaatattgcaaggggtacttggttgcagggtgtgcgcatttttcaatttacaaattggcctcaaattcgtgtattaagtttcattcccacatttgcaatgataagtcctccatggagtttcctcactctacatcctctccaatacttgatattatcaggctttttaatttttttccactcaaatggtcaatacgttgtattttatttttggtttaaaatacatatttgtgttttctgatcactcatgaggttgaccatttaaaaatgtttattggctattggggtctcatctgttgtgaattgcctgtttttaaggtatgcccacttttttattgagtttcttatttttttcactattgcataggagttttcaatctttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttgggtttgggtaaaacttaaccatatgtttaacaggacctggactttgatttaagcaaacttagggtaaaaacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggtttaattaaaaatttacaatgaaattagaaaaataaaaataaaaatcgaaaatcaaatggagataaaataacagtggtaatcaaaatagacccctattttgatctaaaaaagaaaagaaaaaaagataatttggacatcataaaattaaacttctgctcttcacatggcacgttaagaaaataaaaggcgccacacattgggagaacatattcataaaacacaaatgtgagaaaaaaatcatatgcagaatatacaaagaactctcacagtccatagtaacaacaccccaataaaaacttgaccaaaaatttgaaaggatatgtcatcaaagaaggtatatagtgaagttaaaatactaggctcgagcaagtggaaccctcattcactgctgatgggagtgcaaaagagcacagcaactttggaaaacagtttggcagtttcttataaagttcaacatacacctaccagatgactcagcagtcccaaagctaggaatttacccaagtgaaatgaaatcctgagttcacacaaaaacctgcattggaaagcttacagcaactttattcttagcagctaaaaattagaaatgaccaaatggctttaaattgttaactagataaacaatctgtggcatatccacacaatggaatactactcaacaatagacagtgaactagtgctacacgaaacagcaaggatgaatctcaaatgcattctcctaagtgaacaagtgaacaaagccagactcaaaaggcttcacattgcatggctctatttacatgacattcaggaagaggcaaacgattggatcagacaaaaaccagtggttgccaagggctggggtgaaggaaggggcataaaggaactttaaaggatgagggacttgtcctatatcttgaatgtggttgtggttacacagctatgcatttgccaaaacttatagaaatatacacgaaaaggtggcttttattgtaatttatacctcagtaaacctcacttaaaataagcagtttttgattgaacataaaatctggttctgagcttcttggaaaccgactaaatgaagataatgtgttatgttacataactttcatctaggggaaaaatttctagtttctacgtgtgactgaaggttttcctgggataaaagttgaagacaatttctatcttggggcattgcataggagctgctaaatggataatattgggggcactgcatagaaacggcattggataatactctcagtagtaatttcatagagaataaaaaacagaattcgtatgatcttttttttacttgtataaatttaagcaatacaggtgcaattttgctacatagctatactgtgtagtggtgaagtctgggcttttagtgtatctatcgcctgaatcatgtatattgtatccatttagtattttctcatcactcaacctccttccacccttccacccatctcaatctccagtgtttatcataccacactctatgtccatgtgtacacatcatttagctcccacttataagtgagaacatgtgacatttgaccttctgtttttgaattatccacttaagataatggcctccagttccaaccacattgctgcaaaagacatgatttcattcttttctttatagctgaatagtatttcattgtggtatgtgtatacacacacacacacacacacacacaccacgttttctttatccaatcatctgttgatggacatttgggttgattccatatctttgctattgtgaatagtgctgcaataaacaagtgagtgcagatatcttttttatataataatttatttccctttgggtagatacccagttgtggtattgctgaaccacatggtagttctatttctagttctttgagaaatctccatagtgttttccacagaagctgtactagtttacattcccactaataatgtgtaagtattcccttttctctgcatccttgccaacatgttattttttggtgttttaataataggcattctgactgctgtaagataatatctcattgtggttttaacttgcgattctctagtgattagtgatttgagcattttgttttttgtacgcttcttggccatttgtatactgtattagtctgttcttatgctgctaataaagacatacccaagattgggtaatttacaaagaaaaagtggtttaattgactcagttccatatggctggagaggcctcacaatcatggcagaaggcaaaggagaagcaaaggcacatattacatggaggcaggcaagagagtgtgtgcaggggaactcccctttataaaatcatcagatctcataggacttattcagtatcatgagaacagcatgggacaaacctgcccccatgattcaattacctcccaccgggtctctcccatgatatgtggggattattacaatttagggtgagatctgggtggagacacagagccaaaccatatcatataccttcttttgaaaaatgtctattcatgtcctttgcccacttttttggtggggttattttgctgttgttgttgaattgtttgagttccttctaaattctggacattatttccctgtaggatgcatagtttgcaaatattttcacccattctgcagattatctgttcactctattgattatttctcttgctgttcagaagcgttctagtttaattaagtcctgtttgtctatttttgttttggtgcttgtgcttttgatatcttagtcctgagttcttcacctagattaattccagaagcattttccctaggttttcttctagtgtttttgtagttacaggtcttatatgtaagtctttaatctgtcttgagttaacttttgtatttggtgagagatagaggtctagttccattcttctgcatatggcaattcaatttccccagtactgtctattgaaaaggatccatatgactatttcttgtataaatgttgaatgtgaatagagaacatcagatggcaaagctggtatgtggctttaccatctgtaaacagatggtggactgtccatctggtggtctcagagggtggcctcctaggtattcaccttgatgaagttagcagagctgaggccacacttttagacttgtgtgctcacaaacccttggatgcaaattcagagctggatagattcattctattgcaaaccaacatgttgatttattcatctgtgcctagaaatctaaccattctgtaaacttgatgacagcatcctctggccagcatgtttcttcctagttggaggcgtggtgtgtttgatggagcatcaacttagacacagaattagaatcttaactctgcatcttatgaactgggtgtgacattaggtaaattacttaactttccccaagcctcaaatttctcatctgaaatgtggaaataataacgtttctcttataaacttgctgtgaggagtaaataaaatagtgtttatgaattacttagcatagtccctgggcatgtaatttcttagtaagtactaatttttgttggttagatccagttacaggggaagcaaatttacagatatgtggttcatgagcaacagattttctggattattgtcttacacacagtaaccagactgatctttaaaaatcacaaacaagaaacaaatcaaattattcccctgcttaaactctctggaggtttcttattgcacttagaaactcattgtcatgatccctaggccaacacctgtggttcccacccttggctggtgtgcatagaatcttctggagaactttgaaaactactggtgcccaaattgatgcctagagattccgaagagtctggtccatgtggggactgggcactgtgacttttattagctctctagttgtttccagtatgatcttgccctgacccctccctcctgtctgtgtttcttattgggccttctctccttccctgctcctatgactgggacctcccttctaatctttgaatgtgctgagctcttccttcaggaccgaaagcctcttcattactgagccaggtgctaccaccccttctatgtcaagctcacattccatcttcgttatgactctggcctctggtcagaacgtggggtgctctttcccttcaggaagttgggacttggagggctgggacttcaccatcagagtcttttgtgcctggttgtagttggaatctcgtgcattttcatgtagaggttacactgtttgcagggcccatctggtcttcacagtgaagagagaagtcttagctgttcaaaagtcatgttgcttgctattggagcccctgatatgtggcccagattatggtaaggcgagtgagtgaggcattgccttggtcataaattttaaggaggtcccgcaaactcagtagtcaagataaataatattttaatgcaatatttaaacaatcaaaattaatgcaaaaaatccatgatgaaaaaaaaatcagaattcaggtcaattccaggttgatttagtgaataaagagatatcaatagggactgctttatttttttatattttatttacttaatttttttttttttaagatggaagtctcgctctgttgcccaggctggagtgcactggcacaatcttggctcactacaacctccacctcctgggttcaagtgattctcctgcctcagcctcccaagtagctgggattacaactgcctgccacaactcctgaataattttgtatttttaatagggacggggtttcaccatgttggccaggctggtcttgaactcctgagctcaagtaatccacccgccttggcctcccaaagtgctgggattacaggtgtaagccaacacgcccagtcacggactgttttatatttgtggttaagggggatttaagggataatttgagtctgttctgctttcttgggttgtgtttctcaaactggcttatggggatttccagcgatgtaaattttgtgatgaaaatattttatagtaaagcacacatggccatattgtggaaagaaatgccaaaattttatgaaactttaaaataaatcaagctcaactactggagaagctgaggtaggaggatcgcttgagcccgggagttggaggttacagtgagccatgcattcgaaagcagaacagaatcgaattatccctcgaatgcgctacagccacaatataaaacagtcattactgatatctctttattcactagatagatcctgaattgtctcgctctgtctcccaggctggagtgcagtgcgagaccttgtctctaaaacaaataaataaataaatacaaacaaaaacaagctcaagactttgaagaaatgataccccggagctttcagaccagagactcccgagttacacacattttcttctttctgccactaggtggaggcagtggagcaggttgagaatcactgtcataaagcttgtaattaaagaacatcagagtgccagacagtggagctgctataaagtgcagaataactactcctgtcctatacttggtcgcgtatgagcgggaagtgaatggaagggaggctcgaaacaatgggaagagccgtaagaatcaggtctgataaacttacataaacggccttgcacacaacttttctggctgaacctgcacttcccataagtcaaatgcaaatgttggaaggaatatcttgcgaggttctttctagcttgtacagcctgagctattttaaaggagaaaagctgacgagcaatcgtccttggaatttgcagtgcataaacttgaccagcaaagggcagcagtgcacacaccttttaaaaagtaactttccaaattttctactgccatgagagagttctgattctacaaataggagacagtgtttggaccacttaataacaaccaaccataaaagtaaattttctttttattaaaccttttaattttacatttgtaaacagaaaagaaatccttattttgttggctctgggacatcactttcttggttcaactccttcctcctgaccactgcttctaagtctcctgtgctgttttcttctcatctcttcgacctctacttgttgggttacctgccaggtcccagcctgccttcattgatttaactcattgctagtaacctcgccctgtttcccaaatttgcatctccacccggactatttcccgaactccagaatcacgcatattcatccacctgtccaagggatattgccaattagaggtctagcaggcatctcaaatgtctaatatgttcaactctaatccctgattcccgcctgccttccccatctcagaaaatgtccttccaaattctctagttgctcaggttaaacacttgcaaccaccttgatttcacgtttctcccacgcctcacatccaatatgttaacaaattctattttttctacctttgaaacatgaccagaatctgacacttttcaccacagttgccactgagcctcttgactattatcaagaaaggagatgtgttctgttttgtaaagattattaaaagatgttaaattgggactttttttgtatttgttttgtaaggtatctcaaaggccaagaataatataatggatattgtgttctctaatggaacaattcattttctctcctcctccactgcatttttggggatggtggaagtattggaggattttcagaataagaaacaattttattgctgttcaccagatgtcaggagggtatggtgtggtgggcctgggagtggactgtttaaccctagaacttagaaaccagtgtccctgtggagcacaaaccctaataggtcttggtgagtaacagaatagataaaagagagctcagtctggtcataaatcctttggccagttgccattcattgccatgagaaattccccaagaagacacccacctctttttcaggcaattctgtttactagattctggaggattcgttatcatcgaagaaccctgccttctagtcagatggtgcattagtcagaattctttttgcaagtaacataagtcagctgtaacacatacaagtagaaaaggaattagaaaaagaaaagtagttatactaatgtgaaagaaaaaataaacctcaggaccccaaaaatcactaagccaaaagggaaagtcaagctgggaattgcatcaggcaaacctgcctcccattttattcctaaataagatagctacaaagaaaaaaaagctacatacctccctcacaatttgcccacaaggtaattccttgtggacaaagaaaggacagagctcaaagtcatccctctgttcacttcagacaaatgcatatgcaatgcttcttctgccctactgtttcaataagccagactaaggcataaatgactatttctctacctgcctttcacatgtgaaaggctgatcagagactcaaaacaatgcaaccccagcaggaagcccccttccctgccttgagttgtcacacctttccagaccaaagcgatgcacatcttctacatatcgattgatgtttcttgtctccctaaaatgtataacaccaagctgtgccccgacccccttgggcacatatatcaggacctctggagactttatcatgggcttgtccttaatcttgggaaaataaactttctaaattaattgagatctgtctcatactttgagttcacactaggttgttcacaaagacacaaggaaggctatagatccaggatggggctatgcaggtggaaaatgtacctttgatcatgtcaccaaaccagtccagggatacgcccaaaacatgcttggcagcatgaggctgcagtgtgcactgatgacattagtgcttatggacttggtctcactgctagtgagagtcattttcttgattatttttctcaaatttgggtgaggtgaatgtgtagctccacaagatggtgtagagggggcaatgtgaagccatgtaaccttattgaacatctttttggagtgtccattttacttgaatggctcatggaaaaaaattatattaaaatttatacacacataaaaggcacaagttgtagtatttactacgagaagaaaacatgatttaagagataagcttcaaactgcacaaatagcagtaggggagacgaagatagttattcacttccctctgctgcttattgtgaaccatgagaagccccatcttaaagcgtctgaggaagtacatggacttataatagcaaatctatgcatatatcttattttagccttttctgctagactttgggttggagaagtgatgtgagaaggtgtaaagagcacaaaattaggagtcaaaaggcctggttttagcctcagctctgccacgaactaagtgacctgggttaagatatttctatctgtgccctctaagatatttccttacatcaaagaatgcaatagataatttctaaggttctttttggcttttagtctctaggtcattggaatggagacgttaggcgagcattcttctttggagctgtagaacattagtttgatcaccagaaggcacaggatcccatggtgatataggattataggaaatgaacaaaacacagtcttctctcatgcacttctctcacagtcttctctcacttctctctctcttttctgttttgtgtatttatattttccataatagggtaggttataccactgccccaaatctcatggcctagctccaacaaatgcttatatcttgctcatgctacaatcttcaccagggccagaaaggtgctctgctccatgcagccactcaaggatccaggcagacagaggctctaccatcttgtatttgcaccatttggagcacatggcctcttaagttgcttatacagataaaggatagactggaaaattccgtaagatctttttcctgcctcagcctgcaaaggatgtatgtatgcctatttctttggccatagcatttgtaaggagactgggacatataggtgagcaaatggaacatatacaaagtaataatgtctctaagataaatatttacaattcacaaatgtacaaagaattttatagatgcatccataattcacattttgtgtcattatcaccattttctcctaaattacataaaacttattttatttattgacatgtgcttcatatttatcatttatcactgcctgctaattttcatcaggagcatcaatggctattcaatatcctatttatgtaccatagtttataaatgtattgacatttaagtgataatttattatggttttttgctattataacttattgaattgatgaaatgacatacttttattaactgatttttctaatattaatttctagttccatgaggctttccactttggatggtaaaaagggagatagcatttctacttatatgcataaattaattctaggtagtgaattttatttatctgggaataatttttagatatggcaactctcattcattttgacaagaaaaatctaaagctcataaaccctgaatcctatatgcttactctcacaaaaatctctaatgtcctgctgggatttatccacagtttagattagacctggaatacatatggtcatgcaacaatgatcttagaacaggactttaacttggctttaggaactgaggctgagagtaatagaattgatttttttgtgtgtgtgtgaagctcctattataataattagaatactttgattcactcagttaaagttttcccctgatttattgtgtacatacaatgaaggatcaagaaagagaaatttttaaatggaagcattagccagacaagtttgacctcacagttttactaggggatatatcacctagttttggatctatttctaacatcttaacattgtgaaaagagtcttgggaaactggttaaatcccaaagaatgctgcaataggaggttggcccttatgagttatttaatatcttgagctgccttcggaaaatgttgctgagcaggcattgaagagtatcgataaaatttattgagaatttgtttattatgattaacagaggtaaaagccagtatattactgattaatataggtaaaaggcagttaagaaattgggaatgctttctcttctgctttcttctacgatgcacaaggcgtttcacatttatgcccctatgaaaattactaggctgtcctagtcattagatctttcagcagtttgtagttttagagcttctaagttgacttctgtcttttctattcatacaattacacattctgtgatgatatttttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacagtgcttcagcctcgaacacaaacctcctccccatacgctgggccagtaggtctttgctgcagcagctgcttcctctgcacacagcccccaacatgcatgcttcctctgtgtgttggggaggtcactctcttgatttattcgttggagggtttgcagggcccaggattaaattaagagacttgacttttgctggatctctttttgtagaagattattaaagcaaaatgttgtaaagatcccttagagacattgtcaggagtttttgtgttgcaggaacctgcatgtttcacatggacacatcacatgaccgagccaaatagatttatctttactctctagaacagggtccactcagttttacgcacagatgggtcaattctttcctctatgtgcctccttgactctggaaagtttctacttggattcctaattctcttttttctttcttcatctgcaatccttcccaatattaaaccttgatccttcctattcatagcctcccacatagaaggtagtgtccctctgtagctttttccttccagagaccctgtttctttccatcatattaatactttcataggcaattttctaattctttattactctagaaatatgtgacagcatttctcattgccttttacaatagtttgccaactttcttcttatttatcatttttccatttttaattttcatggtatacagtagaaagattatatacacacacacacacacacatatatatatacacatatgtatatatatttatggggtacctgagatgtttagatacaggcatgcaatgtgtaataatcacatcatggagaatggggtctccagccccttaagcatttatcctttgtgttacaaacaatccaattacactcttttagttatttaaaaatgtatagttaagttattattgactaaagtcaccctgttgtactagcaaatagtaggacttattcattctttctaagtattttttgtatggattaactatccccactttccccctactccccacccctgcccactactcttctcagcctctggtcgctatccttctagtctctatgttcataaattctattgttttcatttttagactcttcatatacatgagaataaatgatgtttgtcttcctgtacatggcttatttcactaaacgtaatgacgttcgttagttccatccaaattgttgcaaatgacaggacctcattctattttatggctgaatagtactccattgtgtttatgtactacattttctttttctgttcatctgttgatggacatttaggttgcttccagatcttagctattgcgaacagtgctgcaacaaatatgggagagcagatatctctttgatatactgatttcctttgttttgggtatatacccagcagtggagttgctgaatgatatcgtagctctatttttagctttttgaggaacctccaaactgttctccatagtgggtgtactaatttacattctcaccaacagtgtataagggttcctttttctccacattcttgccagcttttgttatcgcctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaattttttctcctattctgtggttgcctcttcacttttttgattgcttcctttgctgtatagaagcttttaaacttaatgtgatcccatttgtccatttttgctttgattgcctgtgctagtggggtattactcacgaaatctttgcccagactgatgtcatggagagtttcccaaatgttttcttgtagtagtttcatagtttgaggtcttagatttgtctttaatccattttgatttgctttttctatatggtgagagattgaagtctagtttcattctcttgcatatggatagccaatttccccagcattatttattgaagagattcttttccctagtgtaaattgatgacatctttgttgaaaatgaattgactgcaggtatgtggatttgtattgcagggttctctattctttccattggtctatgtgtctcttttttatgccagtgccaccctgttttggttactatagctctgagtataatttgaagtcaggtaatgcaattctttcagttttgttctttttgcttaagatagctttggctattgtgggtcctttgtggtttaatataaatttaagggttgttttttctatttctgtgagaaatgtcattggcgttttgatagggattgcattgaatctgtagattgctttgggtactatggaaattttaacaatgctgatttttccaatccttaagcatgaaatatctttccattttttggtgtcttcttcaatttctttcattggtattttatagttttcattataaagatctttcacttgtttggttaattcttatgaatttaagtatggttattgtaaatgggattatttttaattttttgtcagagtgttcactgttggcatatagaaatactgttgtttttttgtatgttgattttgtgtcctccaactttactgaactggtttatcagttctaagagttttttagtggagtccttaggtttttcaaaatatgagatcatataatcgcctaacaagaataatttgacttcttccattgaatttttgatctccttaatttctttcttttgtctgattgctctagctaggacttccagtaccatgctgaataagagtggtgaaagtgggcatccttgtcatgttccagatctctcaggaaaggctttcacttttcccccattcagtgtgtctgttatatatagtttttattatgttaagatatgtttcttctacatccagtttattaagtggtttttatttatttatttatttttgtttgtttgttttttacacatcacttcttttggccattcctagctccaagagggtctgtgttgatgttgttattgttttctaataaggaaaaagaggaaaactgaggttaggagacaagtagccacctgtgtacagggtcagacataaagtcaaatgatcactgatggagctctggtgataggcctctcttaaaaatcaccaaacttaatgcaaaatcctaaggactccatacctaaaaccccctaaaatgagatcagtgaaaatgagcagtgggcaaaattgggacccatgagaatgtatccagtaggatcatgatcagtcaagcaaatgggtttaacttggctttcctggtttattattatttatttcctggtttattattattatactttaagttctgggatacatgtgcagaacgtgcaggtttgttacataggtatacacatgccatggtggtttgctgcacccatcaactgatcatctacattaggtatttctcctaatgctatccctcccctagcccccgctctccccccgcaggccctgatgtgtgatgctcccctacctgtgtccatgtgttttcattgttcaactcctacttataagtgagaacatgcagtgtttggttttctgttcctgtgttagtttgctgagaatgatggtttccagcttcatccatgtccctgcaaaggacatgaactcatccctttttatggctgcatagtattccatggtatatatgtgccacattttctttatccagtctatcattgctgggcatttgggttggttctaagtctttgctattgtgaatggtgctgcaataaacatacgtgtgcatgtgttttatagtagaatgacttataattctttgggtatatacccagtaatgggattgctgggtgaaatggtatttcttgttctagatccttgaggaattgccacactgtcttctttggtacgtgtaaattgttgaactaatttacacgtaccaaaacagatatatagaccaatggaacagaacagtggcctcagaaataatgccacacatccacaaccatctgatatttgacaaacttgacaaaaacaagcaatgaagaaaggattccctatttaataaatggtgttgggaaaactggctagccatatgcagaaaactgaaactggatcccttccttacaccttatacaaaaattaactcaaggtagattgaagacttaaatgtttaagatctaaaaccataaaaaccctagaagaaaatgtaggcaataccattcaggacataggcatgagcaaagacttcttaagcatttttttgatagagtagcacagataagtatctgtctgttttttttttccaactgtatttccttctgctctatttttttctgtctctgcaacttcaaatatttgtaaattaattattgagaaaataataatagtaataataataattattattatttgagacagggtctcactcagtcacctaggctggagtgcagtggtgcaatctcagttcactgcaacttctgactcatgggttcaagcaattctcctgcctcatcctcctgagtagctaggtctacaggtgtacaccaccaagcctggctaatttttgtatttttagtagagacagagttttaccatgttggccaggctggtctgaaactcctgacctcaagtgatccgcccaccttggcctcccaaagtgctaggattacaggcatgagccaccgcaccctgctgagataatgattttttaatcaaataactaagttttctttctgttctctatatattgatgtatgttgtatattgtcattgaaattttgattatactcaccatgggatatcttactttggaataggtggcatctcaaatacaatttatttcctttggcagaaggggattattttgttgtgaattcaaaccttcattaacttcagtgtaacataataccataagtgatgtttcctgttattaaatcacaaacagtattaggaatgagaggctgaagcaggagaatggcttgagctcacagatttgaggccagtttgagtgacatagtgagaccccttgtgaaaaaaaagagaaaattttaaatgcggtatatttaaaacacatatttctagacatttattactggtatatggaaatcatgtttattatctaatatcataaactctgacatgatcactatcatttctttagtttttaataaattttcagcatttgtgtatgtcatatgtatttattgattgacatagaccttaatgtcttataatataatacagaagtggacatgagcatattataatttaattaaaaaaatgaaagaatttccacttagaagaccaccatagctgttgctataaatgcagaaataaacacaaacttaactaaaaattcatgtgtatgatgacatcggagagctacagaagacacaaaggttagatgacctaaaattctagagaagaaatagacctctgtaggtgaggtaaatctgagctctcatttagttctttttttgtgtgtgtggtttccatggaatctatttaatcaaaactgcagaaggttctagaaaaacacatttttaaccaaggactgccgatgattctaagttttgagtaaaactgtggttgggggaaacaattttctgctttattgtgtgtccgagtacatacatgataaaagtaaaagccagggaatggaataaaacatagctttatataatatattagtagatacctaaatacaatatggtcttaaaaatgaagtcatatgtatatagttgtattcctaagtatgttagtcccccctcatccacaaatctcctttctgtggcttcagttacttatagtcaaccacagtctaaaacacatgagtactgtaaaagaagatattttgagagcgagagggaccaaccaaattcacataacttttcatattagatcttagtgatgcaaattagatcttactcatacaaatgagacattgaattaagtctttctctcagtctgacccttagaattgtcttttgtaagattttaaaatgcatcaagtaatacttacatatgtaacagctgacccctgagccatcactgacacagatggtaccaggactgctgtgcacagacaggctttcgactctgagtagtagacacaagtttgctgtatttgcagcctccacttgagggcttgggggttccctggcctggctacactgatagcacaactggctttgactctatccccaattccccttcctccctatcccctatgcaaatcccagtaattctccaggtgatatcctggggatttccttgggatattcttggtcttcatcctgccttagagaaaactgatcctcagaggcctcacctgatccagagttttaggtttatcctgacccagactctaattccagggttatcctcttgagttggaggaagaaatggtgatttttaaaagataatcatctataggatcagtagtcagaggcttcatgctgatgagctgtaggaaataagatcaaatggcagcaaaagggtggaatacggaagtttccaaaataataataaggtatagcccatttggttcactggaaattaaagagacccatggccttgaacaatgatgtatgtgtgagttacacacccttcaaagaaacatggtgttatctttgtgtgtctgcactgaatagcttggtcatataacggtaataagaatggcagcaaaatgcccagtcatcgcccaatgggctcatgaacaaagtgatcgcagtggcaggaatggagcttatgcatggcctcagtaaaatggactttcactccctacagctgatctggctgtggccacagctgagtgtccaatctgtcagatgcagagacctacactaattctctaatatggcaccattcccctgggtgacaagcagctacgtggtggcaggttgattacattagaccacttccatcatgtaagaaacagcatttcattcctactaaaatagatgcctactctggatatgaatttaccttccctgaacacagtgcttttgcctgaactatgatccataaacgtacagaaagccaatagtcctaagcaagtttatattctctggacacagtttttagctgctgcaatcaaacatgatttaattaacttaccatgggtaagtggcttctcttccttagctaacaaatgtgccactcaaaaacttagttttgcggcagcctcattttcattttttaattttgtgaataaattctgttatgaacagctattgtgttttaaatttttctaatttttacaaatcatgaataggtattggattttgacaaatgctttttctgcacgtaatgatataatcatatgaaatttctttcctctcaatctgtgtatctttaatttccattatttgtcttattatattggcagaacttgtagtactctgtggaaaaggaagtaagagggaacatcctttccacatcttagcaggaaagcttctaatttctcaccattaaatatggtgttacatgcagatttttgtagatggacttcatgacttgcatctacaagaggaagttctcttctattcttagtttactgagagttttttctttataattaatgagtatgggatttctttaaattctttttctgcgtttattgatatgattatgtatttcttcttaatctgttaatatgatggattacattaattggtttactaatattgaaccagccttgcagatgtggaataaatcccaattgcttatagtatataattctttttagatattgttgggttcgatttactaatattttattgaggaatattgcatctattttcatgagcaatattggtctgtagatttttttagtaatttcttttttttggtttggcattctgattatgccagtctcatagaaacaggaagtattctctcttgcttttctcttctggaatatattgtagagaagtggtataatttcttccttaaatattagatagaattcacccataaatccatctaggcctggtgttttctgttttgaaagcttattaattattgattctacttcttcaatagatacaggtcttttctgattttactatttcttcagtgtgagcttttgtagattgcatttttcaaaaagttggtttatttcatctaggttatcaagtaagtgggcacaaagttatctatagtattcttttactatttttttttagcatacataaaatctataatgatgtcctctttttaattccttgatacttttccttgctctgaagtctggtctgtctgaaattattctggttttcttttgataagtgttagcatggtatatctttctccatccctttacttttaatctatatgtctttatatttacaatggatttcttgtagactacatatagttgggtgttttttataatgtggctgacaatctcttttaattggtgtaacaatccactgatgtctaaagtgattattagtacatttggattgatgaataatgtttgttatttcatatttggtgctctggttctttttgctcatttgtctccacactttttttctgtcttttgtgatttcaattgagcattttgtatgattccattttctttcttttcttagcatatcagtgatggtgatctttttttttgtttttgttttttactttttaagtagttgtactagggattgcaataaatgtacaattaatccaagtcaggttttatttacttttttatgctaatttttttattagaatgaaagctataaataaacacattacatagagaaaacttttaatatatattcctatgtgtagattatacaagtgatgtttgcatacattcttgttattaagaaactacaatgaagtatttagattaaaaagtaaaagtcactcttcatacaccactagtggtctttctactgttccagtgatttaataaaataatttttaattgtttttccaaaatattttattattaaataataatttttcatatttatggggtacctgtgatattttgatatatgtgtgtgtgataaacaaatcaaatgtgtaataaacaaatcaagatatttaagacatccatcacttcaaacattcataatttctatgtgttgagaatattcaaaatcttctcttttagctacttttaaatgtacaatgttattgatagctattgtcaccctatgatgctatcaaaaacttatgccttttctctaactgcatgtctgtacccatcaaccaacctctctttattccccccttcccagcttctggtaactattctactctctagctccataagatccactactttagctcttacatatgagtgagaacatgaaatatttggctttctgtgtctggcttatttctaagtgcacttttaattaacattaaatgtttcatgggtagtgcaaatatgttatgataatagtagctattaatcaaaattctatgtattactgctgttatataattgtgtggcttaataaatcgaaattaaattgaagtataattaattttaactctccagcctgagtattaaaacaggaactactgatgcttaggcagtaagcactgtgagtaaatcattacaaaataaaagcatactcataaacattgtaacaaaacatatcaaggagttattataattctcccaagagtttagaatctccatgtttgaaaattgctgtaataatgcaaagcaattttccacagtattagaagtaaaaactaagtttaaatattgttatatttgatagaaaagaacattattctcatatgaagattcaaattatcaattattattgagaaaaacaatttaaaaattattttttccttgtaatggaggatccagtgatatgatagaatgcataagcagacattttgaattatatgaaagctgatcttgctattcatgttactattatattttcaaagtaataaaatatttttgagaaaattctcttcctgttttaagaagcagccctgcatttttattttgcactggggctcacaaattatgttgttggttctgttttccagtaatacatatcagataccagcaatgctgaagtttggaaactttctagaatgctttttgtttcattaggaagagtcctccacctccatgattccctttgccttctagaagaataaaatgggaaaaacagaattttattattaaaaaaaaaaacccagaagagtaacatcactttccactcaaactgactacactaatctaatttctcattctttatctcttttacactaaggtatacctgtaattttcagagttccattttcaaagactgcttatagtttttaaaaatgtgcatttatggtatagaaagaaaatcattttacgactaccaggttccactgaaaagtaattaatatactgtagtcaaaataaaataaaaattttaatacatgaaaacaactaccgaaatgttatgaaattatagtttagtagaactaacaagtgcattaatgcaaaagaaaagtagggctcagtaatcagggaaccaagtgtgcattgtaaaagtgcagcctctctaacactgggtttcatcacaagtaacagaacaggatgcctgatgcagggaaaaaagaaaggcaattgttggcaatgtcaggaatattgccatggcgtctaccactggtgggttactgagcatcagaaccacagaagaggtaacactgaagcctgcagaataatgagtcttgttgcagaaatgcaaagaaaaagaaagatgataaatgcacacccaggaggttacgttaattttaaccttctgagtgtgcacagctgtgaagataaaactatgcacagctcatgggttaggtttcacacagtctgccatttaaacactccctatgtcaccatcatgtaccatataatttgcatatttgtcctttatataaccctataatatgtttgtggccataaaatctgtgctgtcaaactgattaggaactgactaccacctgcaggtcagggccaaggttatggggtcccaggttcacctcctcagcttcctcctcctttggatctctggtaagagaaacacttcctctcctctgtgccaccaagtcccctgcatatccacaaaaataatatattttcataaggaattgattttcctcattctctgcaaatatgatgcatttgatttatgttttttactttgctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctcacagtgatacaccctgttacaaaaacctccaagttctctcagtgggattgcctcagctgctgctgaaaatgttcagaatgtggaactgggtggccctgtggtgtttataaggcttctccatgcccatgcaactcacttcctttttctttttgtttctgtagtttctgctgcccccatgctgtgcctgacacacttgatatggcaaaaaccaggacagcctttctcacgttgtccagctgtgccaacaatttcacttccaagcagaggtaaattctcatggccaactccctgtcttttgccacactcatcatttccacctccaagaaaaacaaaaccaaaaaccaaaatgcatctagcttagattccaaatagtagcattaaaggaaattgtccctccctataagcattctcaccctcatccacacagtcatcgtgactcttccctaacccactgagtgctcaccagtcctcttcagtcctccctccagtgatggggaaaagcgagtgatagttatgagagcaacatgtaacctgggtgcagactcttactagtcaggtttgcctcagatttcaagtatttatctttcttttattttccattttttttcttaattatatggatcagtaagatgtctcatttcttttttttaagttacttgttcttttaacacaattcaattctataattccaaatttaaagagataccctgtatgtctttggcatgtgttatatctggacaagttttgggttatccccttcatgccactgctcaaatcttacctgaaaccccacatatttttccaaaaacctgaaaactgtgtagcggttgaggaaattaaatttggcaaatcacaatacttgaggaaacatgtatctttttatcttcactctctaatgttcaggtgatgctgtttaattgagcatttgctatttagaatcacccctctgaaacttgtgggaaaacagcaccagcaaggcagtcttcatgttttgacctcattattcctggattatgctagccttcttgctattgttctactacagccactacctgaagaaacctcatgtaggattgtttcctaatgaaatattaagatttatctgcaattatccctaactctgcaaacttaactgacttctcaggttagtatttaatagccatcaaataaggagtggctgaaataatattaccaaggaaggaaataattggatcatagaaatgagggctttgtggttattgcatggtgaagaccaacaaaggccattgcaaccagtaataatatgcacaatgatgagctcgtagttaagagcaatttctgtcttagttttactgtcactgaactgggctggaaccctggagggcagggtagatgaatgataatcaaaaacatgatttcatatgttaagttctttggaaggctcaatttcggagatttctcccactttctataagagcagacatcaaagaatctgattctggaatctcgttttttctcttacagctctctttttttctactctaatctcttttccgcttccaaggacatacattgataaatatggtcaacagaatattaaggtgatgtcaatattagtgactaccctataagagggaacagaaacattcgtgtttgtaagcttttagtcctcacttaagcttctttcttgagtaatgtaatcgctccccttaatgtctggagcagacattagtaagaataataaatagtatgtttagtctcaaagatggtgaatacagaaagtggtcagaatgtgaacaacactattaagtatttagctaaaaataaaactattgagttttgtaaattcttatcaagtcttctctaagattgaagctccaggttttagtgaaaatcctgtccaggaaatattacattataatccctttctctctgttcccatctaccttaggctcatagtgacatgaaagcaaatttccatcctctgggaatatataaacccggattatttctttttatatagatgctctatcccttgcctgtgtgctattttcttactgagtcactaccttgcaccatgtacacaacccccagtggtttatgataggatgaacctattgaagcagctagcagagaaaaggttatttatgtgggtaactgtgtatgcttgttggacattccctgggtctctcacactgttaccacagcagcattataaaaacatcatctatctatctctctatctatcaattgatctatctgtcaatctatctattgtctatctccataaacacacaaacatactcacatttgtgtgtgtgtgtgtgtgtgtgtgtgtatgtatacagaagaaatgataaaagttatatatgtcttatgtcccaaactttagaaaggatatgtaacatgttagcaatctttgaacacacttgctggaatatagagtaaaatactttgttgctggtatatcaaactgtagtagataatccttctgatttccaaacagggtatacaaatgcacctttccaccagcaatgtatgagggtttctattgttctacatgtccaccaatacttggtattgtaaaactttttaatttaagcctttcttctacatgtgtagtagtatcactccataattacgatctgtgtttgtgggattatatatggattatatatgcttgtagggcatttgaccatcctctgggttaaaatttctgtcaaattctgcccattttactaatgcattttctgatttagttgaacagatatgtatgaaaatatatatataacatatgcgtgatatatatcagcgtgtatctgcctatcatccatccatctatctatccatcaatctgaatgtttgtgctctgccaaaattcatatgttgaaatcttaatctcaatatgttgatcaagattgagccttggcaggtaattaggctgttagggtaaagccctcatgaatggaattaatgtctttataagaagaagtgaagagaccagagggctagctagctctctgctcttagccacatgaggatgcaaggagaaggtcctctacaaacctggagtcgggcttcactatacaccagattggctggcaccttgatcttgaacttctcagcttccagaattgaaaaagtttctgctgtttaaccctgtccatcccccagtttatggtagtctgatatagcagcctgaactaacatctgtatctatatttatacaattatagatatagatagaaccagtattttttcgcatttgtctctgtctctggtttacctttttactcacttaagtctgtaaatggaatcattttcttaatttgtttttcagattgtttattgttattgtagaaatgcaacttttttattttctttcctgaaactatatttaatttatttattagttctaatattttttgataagttttttaaaaaaatttattttgttttaagttccaggatatatgtatggatgtacaggatgtgcaggtttgctacataggtaaacgtgtgccacggtggtttgctgcacctatcaacccatcacctaggtattaagccttatgtacataagctatttatcatgatgctcttcccctatcccccagtgtgtgttgtccctccctgtgtccatgcattctcattgtttagctcccacttgtaagtgaggacatgagatgtttggttttctgttcctgtgttagtttgctgaagacaatggcttccagctccatccatttccatgcaaaggacatgatctcattactttttatggctgtataatattccatcgtatatgtaccacgttttctttatccaatctatcattgatgggcatttgggtggattccatgtctttgctattatgaatagtgctgcaatgaatgtacataagcatgtatctttgtaatatgatgatttacattcctttgggtatatacccagtaattggattgctgggccaaatggtatttctggttctaggtctttgaggaattgccacactgtcttccacaatggtggaactaatttatattccaacagtttaaaagtgtttctatttctccacagcgtcaccagtgtctgctgtttcttgactttttaataattgccattctgactatcatgagatggtatctcactggggttttgatttgcatttatctaatgatcagtgatgttgggcttttcttcatatattttttggccacatatattttgagaagtgtctgttcctgtcatttgtccacttttaatggagttgtttgtttttttcttgtaaatttgtttaaattcctggtagattctggatattagacctttgtcagatggatagagtgcaaacattttctcccattctgtagttgtctgttcagtctgatgatagtttcttttgctgtacagaagctctttagtttaattaagtcacatttgtcaatttttgcttttgtttcaattgctttcgatgtttttgtcatgaaatatttttatctgggtatgctgaagaatagttttcctaaaagttatatattaataaacaaagagttagtgagagcactagaatcagagaatatatgtaagagtttgttcaaagcagggtcttaaattttagtctcattgcaaatttggattctattcctcttgaatggactactgaagagatataaagaccatgaggaagcacgaaaatatctgctttgctgcctcaaggatgtttaattgccccattgattctcttgggaaagaattctcccattgttgctcactgattctcaaagattagaagtaaaaataacttaggggatttgtgactaaagttcccatgcctagagatactgacctcctacgtggtgttgagtttaccttaattcttgaaggatgcttaactttgaagggaactctagctatatggctactttttcttatcattttaaggaaattttatggtctctgcttttcctgatttatgtttagaggttagctattaatcttattcttgtttcttcaaaatgagagaattttttctgattaagatttttttgtttgatcagtagatagtaaagtgtgacattatttatacaacgtaacactacacaacaaaaaagattaataaattgcaacaacttgaatttttacagtaaaattaaaatgacacatatctattacctaaaacacatctgagaagctaatttatagaaatagaagtatgcatgtgtaaagatataggtaaaattgtattaacaaatccattgattatattagcaaaacctgaacataatttaattgcccttcagtagaaatgtttgaataaagtataggttttctacacaatccaaaatgtgatgataaagaataggttatatttttcatctcttgatctggagataatctctttagaaatgttaaacataaattcccaaaaatgttaatttatgagccaatatttgaaaacatagaagcagaattatgaaaagtagtaatttgtcttttctatctttacaaatatggaatcattttacatcttgtggggttacaatgaagaaaaaaagcagttatgacaatgggaaaaatgtatgcgtaacatacagcaatgttcacagagatgaatgaagttatagtgacaaatgaaaaatgtaaaaggcaatttgatttatattgaatatatatatgtcaggaatatggaatgagaggagacaggtaaacacaataaaaactctgaccaatgcctgaaataaggatattacagaaataaaacaatgctatttaaacatctaaaaacagcataataatcaccagaattaaaaaagatcctgtagatgtgtgttcattcatagaaagatggaagtccctacattattattaatattttcaccatcagagaaatagggtgctactcagaaaaatattttttaaacaattgacctaaatcatatcaagtaatgagatatttcttgagtccaggcatgatcatgtaaatgcatgttggttaaatccttggacttgtaatgcacattacaactttcagaactcctctctgtttagcatttataggagaccttctgactacatcaaacttcatctaatcacattttacctgcactgagaacttttggtgggaagtgagatggaacgccatagtgtcattgcatattcagaccccaagagggagctgagagatcatgccttgaggaagtgattctgaaagagtccccacagtggaggattccagagctctgtgtgataacattgcctatccactgacccacgccctccccaaatgtgcaaagaaagtccagctgccagaagcccttatcagtgtgcagattccccataatcaacactcctttgcatccaccatatctgtaggggaagtgcagttccaggctcagctcctcaggtgtcttctacccaggtgaaagtccaaggtagatcagtcacaaaatcagtgcaattttaaaattgctttattaaagtacagtgtcaaaccatgaaaagcacctattttaagtgtgcaaatcactgacttatggtaaatttgcaaagttgcagataaccacagtttaatcttacaacattttaatcatcccctgaaggatcccttatgcagaccggcagctatttttatttccactcccagtctcaggcatgtattaatcgactttccctctattgattgcttgatatgaacattctatataaatggaataatgcatgcatggtcgtttctatctggtttctttccattaaacgaagtttaggttcatccctgttttagcatgtatcagtaggccattcctttttatttttggatagtattccgctgtacggatatatcacattttatttatctattcacaggttgaggaacattgaggtcctttgcactttttggttatatgatgatcaacaatgctgctatgaatatttgcctgtaagtctttgtgtggacaccggttttgatttttctcagacagacctctacaagtggaaatgctgagccatatgataaatttctgtttattttttaaaaactgccaaactgttttcaagagtgtgcagcatttaacacttgcaccaacagtgtatgaagccttcttttctgtcacattctcaccaacttttgttattgtctgttttttaaattattaaaatcattatagtgtatatggaatggtgcctattgtgaatttaatttgatttttgttaatgactaataatgttgagcaccttttcatgtgattactgtctgttcatatatcttcttccataacatctatactaaaatattttgttcatttttaaattgggttgtcttatgacttatatattctggaaatatggcgtgtatcagataaatggtttataaataatttctctggtctgtggtttgtcttttcattttcttaatggtatcctttgaaatgcaaatgttttgaacattaatgaaacctaatatattagcattttctttcataagttgagcttttgatgttgtaactaagaaatatttggtgaacccagaaatggaaaagttttaacctaaagtttttataatttcagattttaggaatgggcagaagctggaaacattccccttaaaaactgacacaagacaaggatgtcatctctcaccactccttttcaactgagtattggaagttctggccagggcaatcaggcaagaaaaagaaataaagtgcattcaaataggaagaaaggaagtcaaactatccctgtttgcagatgacatgatcctatatcttgaaaaccccatcatttcagccccaaagctttttaagctggataagcaactacggcaaagtctcaggatacaaaattaatgtgcaaaaatcactagcattcctatacaccattcatacattcctatacaccattcatacattcatacagcattcctatacaccaacaacagttattccgagagccaaatcacgaactcccattcacaattggcacagaaagaataaaatacctagaaatacagctgacaagggaagtgaaagatctctacaaggagaactacaaaccactactcaaagaaatcagaaacaacacagacaaatggaaaaacattccatattcactgataggagtaatcagtaacattaaatggtggctatactgtccaaagcaatttatagattcaatgctattcccattaaagtaccactgacattcttcataaaactagaaaaaaacaattttaaagttcatacggaacaacaacaacaaaaaagtcctgaataaccaaggcaatcgtaagcaaaaagaacaaagctggaggcatcacactacccaatttcaaattatgctacagggctacagttatcaaaaccacatggtactggtacaagaacagacacatagaccaatggaatagaatagagagcccagaaatatgtcctcacacctataaccatctgatctgtaataaagttaacaaaaacaaaaaatggggaaaggacttcctattcaataaatggtgctgggataactggctagccatgtgcagaagattgaaactggacgcctttccttaagccagatacaaaaatcaactcaagatggataaagtatttaaatttaaaacccaaaactataaaaaccctgaaagacaacctaggcaataccattcaggacacaggcacaggcaaagatttcatgacgaagatgccaaaagcaattgcaaccaaagcaaaaattgacaaatgggatctaattaaactaaagagcttctgcacaccaaaagaacctatcaacagaatgaatagatccctacagaatgagagaaaaatttttcaagctatgcatctgacaaaggtctaatatgcagcatctataaggaacttaaacaaatttacaagaaaacaatcaaccccattaaaaagtgggcaaaggatgtgaacagacacttctcaaaagaagacatacaagcagtcaatagtcatatgaaaaaaagctcaacatcactgatcattagagaaatgcaaatgaaaaccacaatgagataccatcgcacactagtcagaatggctgttatcaaaaagacaaaaaataacagatgctgatgaggttgtggagaaaaaggaatgcttatacaccattgatgggagtgtgaattagttcaaccattgtagaagagagtgtggtggttcctcaaagacttaaagtcagaaatacaatttgacccagcaatcccattactgggtatatactcaaaggaatgtaaatcattctattctaaaggctcatgtatgagtactttcattgcagcaccattcgcaatagcaaagacattgaatcaacccaaatgcccatcaatgatagactggataaagaaaatgtggtacatacacaccataggatactatgcaagcataaaaatggacgagatcatgtcctttgcagggacatggatggagctggaggccattatcttctgcaaactaacacaggaacagaaaaacaaacactgcatgttctcacttataaatgagagttaatgatgagaacacatggacacacaagggggaaaaacacacacttgggcctataggagggtggagggtgggagaagggagagaatcaggaaagataactaatggatactaggcttaatacctgggtgatgaaataatctgtacatcaaacccccatgacacatgtatacctatgtaacaaacctgaacatcctgcatatgcacccttgaacttaaaagttaaaaaataaaataagatctctgatctattttgatctagtgtgcatggcaagagatcagggcctaaattcgtcttttcacctatagataccaattgaaaatctatccttcctcccatttaatttcctaggcattattttaaaaaataacttaccaaaaatgtaaaggtttatttctagattctcaattccatcctactgatctataagttcatttttgtgccagcaccatcttgtcctggaaactgtagtttatagttgttctctgctttatagtataggcgatccttggacaacactgatataagctgtgcaggttcactcatacatggattttctgccacatctgaaataacaagaccaatctctcctctccctcctcctcagcctactcaatgtgaatacgataaggatgaagacatttataatgatccattttcacttaatgactagtaaacatatgttctcttctttataattttcttaaaaacattttcttttctctacattacttgattgtaaaatacagtatataatacatataacagtcaaaatatgagctaatcagctgtttatacaattggtaaggcctccagtctacaacaggctatcagtagttagatttttggggattcaaacattatacatacattttctattgtgcacggcgtctgtgcccttaactcccacattgttagagggtcaactgtacattttgaaactggaaattttatgccctccaacttcaattttcttgaaaaattgttttggttatttgaagtcttctgaattttcatataaattttagaatcagttcaccaaattctatagcctactgggattttgactcaaattgtgttgaatctgtagatcacactggagagaattatcatcttaataatactgaatcttccagtccatgaacatgaaatgtctcttcacttatttggatcttctttaatgtctctcagtaatgttttatagttttcagcatatctcttacttttttgttaaatatattcagaagtattttcttcttatcaatgtttgttcattgtctttatgctttattttcaagttagtgatccacagtagtcaatcttatttgtgtattctgtatttgtgaatttgcctgcctgctaaaatttaatacaatcccaaagtcaatacatagagtgcttttattctcatttgtggacatgcacagagtggcaaaaaaattgagccactgaacactcatgttcccaactgaggtttaacaaagccacactcttccatcttgtttcacttctcatactgtaaacaagtgtccttttgctcaattttgctctttatgttggtaattttgtggttataaatgttccccaaatataataatgctgaattgctgtttaatgttcctaagcacaagtctgccatgtgtcttacgaagaaaatatgtgtgttagataagctttgttcaggcacaagtcatagtgcttttggccatgagttcaatgttaataaatcgtgtgtgtatgtgtgtgtgtgtatgtgtgtgtgtataggaaaatgccttgttttattgcacttcactttgttgctctttgaagatactgttttttacaaattgaaggtttgtaacagccttgggttaagcaggtctatcatcaccattttcccaaaagaatatgttcactttgtgtctctgtatcacgttttgctaattttcacaatattttaaatttttcattattatatctgttagggtgatctgtatttagtgatctttgatgttactattataattgctttggggaaccacaaaacacacaaaccacacttactcgataaatgtatgtgtggtgactgctccagtaactggccgttccttgttttcctcttgtcgggcctccctatttcctgagacacgataatatgaagattaggctaattaagaactttataatgatctgtaagtgttaaagtgaaagaaagtcacatgtctctcactatcaatcaaaagctaggaatgattaggcttagtgagcaaagcatgtcaaaagcttagatagaccaaaagctagacctctcgccccagttagccaagttgtgaatgcgaagaaaaagttcttgaagaaagttaacagtgctactccagtgaacacatcacaaatgtctaaaaagcaacatagccttattgctgatatggagacagttttagtgatctggatagaagctcaaaccagccacaacattcccttaatccaaagcctaatccagaggaaggcccaaactcatagaatttatgaaggctgaaagagatgaggaagctgcggaagaaaactttgaagcagcagaagttggttcatgatgtttaaagaaaaaaagccatctccatgacatacaagtggaaggtgaagcagcaaagtgctgatggagaacctgcagcaagttatctagaagatctagctagaagtattaatgaaagtggctacacttaacaacagattttcaatgtagatgaaacagtcttatgttggaagatgatgccatctaagactttcatagctagagaggttcctggcttaaaagtttccaaggacaggcagactctgttattaagataatgcagctgatgacctatgttaagtcgaagccaatgctcatttaccattctgaaaatcctagggcccttaagaattatactaagtctatttttcctgtgctgtatacatggaaccacaaaacctagatgacagcacatccgtttagagcatggtttaccaaatatttgttgagacctactgctcagtaaaaaaagatttctttcaaatattactgctcattgatttacaatgcacctagtcactgaagggctctgaaggagatacacaaggagatgaatgttgttttcatgcctgctaacacaacattaattcttcagctcatgcatcaaagagtaattttgacttccaagctttattgcttaaaaaatacatttcataaggctagaactgctgtagatagtgattcctctgatagatctgggcgaagtaaattaaaaaccttctggaaaggagtcactattttagatgccattaagaaaatttgtgattcatgggagctggccaaaagatcagtattaacagaagtttgaaaaaagttgattccaaccctcatggatgatttcgaggggttcaagacttcagtggagtaagtaaatgaagatgtgtaaaattaaaagagaactagaattagaagtataactatgtaacaaacctgcatgttctgcacatgtgtcccatttttaagaagaaataaagaaaaagaaaagaagcggagcttgaagatgtaactgaattgctgcaatatgacagtaaaacattaatggatgaggagttacttcatacggatgagcaaataaaatagtttcttgagatggaatctactgctgtgaagatgctgtgagcaaggttacaatgacaacaaaggatttataatagtataaaaaaatttagttgataaagcagcagtagggctcgaggattgactccaattttgaaggaagtactactatgggtaaagtgctatcaaaaagtatgtcatgctacagagaaacctttaattaaaggaagattcaatcaatgcggaaaactttattgctgtcttattttaagaaattgccacaatctccccaactatcaacaaccaccaccctaatcagccagtagccaacagcattgagataaaattctcaaccagcaaaaagattactcactgaaggctcagatgattattaccattttttagtaatgaagtattttaaatgatgtacattgtttttaaaacgtaatgctattgcacacttaatagactacagtatagtataaacataacttttatatatatgcagaaacccaaaagtttgtgtgattcactttattgtgatatttgctttattgcagtggtctggaaccaaatctacaggtatgcctatatgtatatgcctatatttaagactttatgagatatatataatctgtttaagatactcatacaaaaagttacctattgatcagttaatgaaaatgtgaccataggctcataggaacataaaccagtactaccactaggaccaatggttcaatatttgttaattcagcgtttgtgactttacagatatctgttgaaacataacaaaatgtaactgtacatggagataaaatttatttctgcatattgcatatcttattgtgtgactttgccaaagttgtttattactagtagattgtatgtgtagtggtgggggacatgtattccttatcatttaatatacatacaggattatattttctgtaattaaaatacttttactcttcttttaaatattgatatactttatttttcatttttttcttgcttgattgcttgacaagaacatccagtgcagtgttgaattgagtagcaagagtgaatatccttgtcttgtttatgacattagaaagaaggcattctgtcaactttaagtagatgttaactgtaagtttttcatatatatcctttataaggtaaaggaagtttccttctattacaagtttgttgagagcttttgtcataaaagagttttgaattttatcaaatatctttctccgtttattgagatgattacattttttatatttactctatgtggcatattactttattgattttcagatgttaatctatcttgcattgtttaataaatcccatttgtattatggtgcataatcatttctatatgctactggattctatttagttatatcttttgataattttttcacatgcattagtaggggatattggtctatggttttctttccttggaatgtctttgcttggctttggtattggggtaacactggcttcatagaatgagttgggaagtattcttttctcctatgtatactgaaagaatttaatgaagattggtaatatttattctttaaattcttgatagaactcaccagtgacgccatgtagtctcagtttttctttattggaaactttttaatttcttcacttgttatggttctattcatattttctatttgtttttgaattagttttgggttatctcatctaaattgcctaatttaatgacttattattgttcatcatattctcttacagtatttttaaagtttctgtaggataggcagttgtaccccttatttcaatcctgattttaataatcttggccttctctttttttcttcaagagtcataaagatttttaattttgccaatctttccagaaacacaacttttgctttcaatgattttcgtcttttacttcattgatttatactctatttttaaaattattttcttccttctgcttgctgtgaatctcgctggttcttctttttctagtctcttaaaatagaaactaccccattggtttttagatattctttctttctttactatacaggtaattacaggccaatatttataaaattatttatttatttcaaatcttccactctatagatgaaaccttcaccacttcgtcactcaggaagcaacaggagaaacatgagaagctgggatgaaaacaccattttgaggaatctgtttgtctgatgctggtcagaacctattaccagaggaagcttccttatttaatccccttaggacaggggccatttgagagaaagagaataaaaacaaacaaaacacttaggcaatatgacagttttagtggacaaccctaggttggccccatgatacagaaccactggtgttcctaactgtgtaattccctcttcttgagtctgggcagaatttttgacttccttctagcatacacaatattgcaaaggtgaaagtattttgcagatgcagtagtcccaaatcagttgggtttgagttaatcataagggagattattgtgagtggatctgacttaagcaggtcaaagccattaaaagaggaactgagctctccttgttaccaagaaattatcctagctggtttgattattagtagcccatgtggcaggaaacttaagatgttctctaggagcttagggtgatctccagccaacagccagcaaaaagccaggaccctcagccttagagttactatgaaaacaattctgtcaacaacttgaatgatcatggaagcagactctttaagtccctggatgagaatgcagcctggtcaacaccttgactgcagcctgtgagaccttgaagagaggacccagataaactctgcccaggctcccgactcatagaaactgcatgtgaattataaacgtgtattattttaagccactaagtgtgtgataatttgcatgggccaacagccaactaataataaaattttatatgtagtgagatagggttacaagggttacaaatttagaaaccaatgtaaatcttattagactgaaatgctgcaaaagcctattttgccagagtttctctgcttgctttgtggaggatgcagaagactgacggaggccaaggtagggatggaggggcacataatcactaatctttccatgattgtgactatgcacacctgcatttctggagtccactctgcctgtagtgttagagcaattagaaaagcaaaaagagaagatgagaaaaaaaaccttaacaatggacatggaaaatatcatagaaaaaggacatgacctgtaatcccagcactttgggaggccaaggcaggtggatcatgaggtcaggagttcgtgaccaggctggccaacatggtgaaaccccatctctactaaaaatacagaaattagctgggcgtggtggcaggcacctgtaatcccagctacttgagacattgaggcaggagaatcacttcaacctgggaggtggagactgccgtgagccaagattgtgccattgccctccagcctgggtgacagagtgagactctgtttaaaaaaaaaaaaaaagaaaagaaaaaggacatgaacactgcatgaagagtaaaggacaatttattaaaactagagctgagaatctaacttttgggaaagtcaccgagatagagacatctaaattaaataagcagagataactacctcacaagtcttaggtttctaaataactagaaaagccttttcatgtgggttcagcaaataaaagtggagaaaagtcaaaattcaggtgagaaggtcacctatatctgaaagatatagagctaataattttgactattcagagcattttttaaaatgactacaaagttttcttaatgtttaaaattcttctattggtaagggtctttgacataaaaaatatacattgagaagtagaaaacttctgagaggtcctgatacagtaaagaaattattaaattataaaactggctgtgacacacatgcatgcacacacacacacacacatcaatttaaggattttctctttgataatttgacccctttgttcaaacaagcctatgacagcaggctgatggacctgcataaaaagccacatctgagggatttgagcctcagggagcagctgcctggggaggtttttgtttagacctaaagcactgtgggaggaaaattcttactctgcagacagtaataatttgcagtatcattagcttccacaggattaattgtgagggtgaaatcggtcccagacccactgccgctgaacctggctgggaccccagtgtctttattggatgcttggtaaatcaggagtttaggaggttgtcctggtttctgctgataccagtgaattaagtttattcccaagaaactgacactctcactggctctgcaggtgatggtggccctctgtcctggagacacggccaaggaggctggagactgggtcagcacaatgtccccattgcagcctgaaatgataaagacagataaattatatcagatatactgagactgtccccatgtaggcccatgcattggtgacacttgtaaccacagtcatatgcaacatcttgagtaaccagaaaacaaaagataactggggaacttacaacctacaatgagtgccctaaatccaacaaccaagaatccagagacacaaaaaacaatgatggccacatgagtttgcccgatgtttccctataccccctcacttggagcccagagcaggaggatccacagcaaaggagccccggaccctatctctgagagctgaactagaggctgctcctcaggggccctgacaagctgtctttaaggatgctctgagaagcttggaccgttgtctaatggcccaacatgcaaatcagctcagaaaagtttgagttgatgctcaaaggggacacctgctcttatttcacccagtgggagttggggctaacaaaacatttcctagggtagctcaagcatgtcccaagggatttggtgaccttttctattggatctttgcctgccagtctacttgagatgccatgtggaggagtgtactggggctgccctgccatttggatataagttatttcagaaatacttttgatttttcaaaattcatattttatatcattatcaataataatgcattttaagttatcattgtcagaaagagaaagcaagttgggtgggttttatgaaactggttcatatgggaaggagaagtttgttccactgagtaagtggtatttaaaacaagtctataaatgttatcatgatctggaaaggatgaagggggtgagcatgaaaccttgatgaagactggtaacctaaactaatcaaggaacttgcctcattgtggataaggcagggtctctccatctgcttagtcctgaaaccaatgctgtatccaccagaggccctcagaggcagaagagtcattgtagtggatcctattcagagtggagaataaccatcccccaactcccactggttccatctgccttgccactggaagctggggctaaggaagtccatcttctcctacagcaagatatggtgtccacaccagtcagctggcactctcacccatccataggtgaaggttttcccccaacaaaaccaacttaaaatgtctggaagaagggactgcatcttcaaatgtgcagacaccaacacaaggctacaaggaacatgaaaagtcagggaacatgatgccaaccatcacttctctatgagctccactccaggactctattctgttacttgtgatggagttcagggccagagaggtcccactatactgcttccaactgtgcgcttgggtccctgattactcagttatatttttcattgatgttaacatgcatattagctctagttaactaaaagttttcttttatcactctgggaattgtttttatgcttttaaatttttattttatttgatttcaactaaaataaactagtggcttcccaaaggatctaggtagaactaaaataatggtctttctacaccttaaatctacatttttataaacagctgaaaatgaacagctgagaattacagctacaccttagggcaaaggagatgaagagcgggaacttagattagtgtggtgagtttgagtggaaagtactataccctcttgtttttcctaaatgattaaattctgcttacctagctctattcccctagaagaaagcaggaataatggaatttgagtattccttgaaaaaacaaagaacattttcaagaaatttaagaagttttcaaactttaacctttcagatgtctagtagatatctctggaaaacagggcaagcatcaatttgtggattgagaagaaagataaaatatttcagaggagccaatatgccatgagaaaagtcctgaaaaactccccctgaacccttggaacttttgtgccatgattagggttgggacaatccctgagctttgccccctcctacaactctgggtggaggaggacagaagtagaggtgggaagtaaaaggggtgaaatttgcatttttttattaggccacctagatgaccgatcattaagaaggctctagaaaatagagacaaacttgaccactttaagttgttcactgtcccatcctctgtcttctactctttctccagcaaccaagtgataactactacacacaacctgcaaggatacagtcctcagactcagatctggggtggaggtagggaaggtaataataaaatgcacccacatgtgtttggagcaatcaagaaatattgaactataccatattttggcaaataaaagacttgggtaaagcaaccccatcaaggataagtaatttgaaatgaaataatactgaaaattacaaatataccatgggagagggctatatgactgacaaaaatacatagcaagtaaataataaattagataactcttctgaaaatgatgtactctagtaaaacaaaagtattttctgcagcaaatgattgtaaatttagaagacacaccaaaaaaaaaaaaaaaaaagaaaaacacttaaatttattttcaaggatgagatagcaagaaaataataggtaaaataaatgtgtctggttacaggtacaggattaaaaaagtaaagcagaactagtaattttaacatagaaaaaatgtaataaggcaaagaaataaatggagtcaaagacacataaggtaagcttagtaaagggataaagttcagaaaaaaaggcaaaaaaaattacagataattatagaaaggatagaaaataggcacccaatatacatggataattgatgtgttttaattatggaatttaataaaatggcatatgaaataaaatgtaataacataatgaccagaatgtcaatatgtttaagtgaagatatgttaaaacaccccaccataacatatatgtgaattacatatttattaaatacagaaatattaaaagataaatctataacaaagaatttatatgaatatatatctgactttgtatttaaagagactatttataagccagaagaaaaaggaattctaaaagaaacaaaaaaatataaaaagaaagcaacagaagcctaatataaagtttctaagtagaagttttaaatcaatgtcaaacacaaaattatacactgaagaaaatcaatacatgtaaaaataaaagtaaactataacaatcaaagacatctcacaaaatgatgaagaaagcaaatttaaattagaaaaataatccataaaatgaaaaattaataaattggacctcatctaaattgaagtttttgatctgaaaaaaaatctctattaaagggatgtaataaattgaaagtggacttgtgtaatttagcaaatgaactcttgagcaattatctcagagaaataaaacattattatacagaaacttgtacacaaatgttcacagaagctttatttatagtagctaaatcaaggaaattacccaaatgtctttcagtaagtaaacagttaaataaactggggtaatccgtattatagaatacattcagaaataaaaagcaataaacaattgatatacccaactttgatgagcctgaagggtattacgccagtgaaataagccaatctcgaaatggtacttattgcatgatgtcttttatgtggtgtttgccaagggttaaggatggggtagagaaggtgagtgcggctataaaagggtaacaccaggagtcgtgtggtgatgatttagctgaatttcttgattacagtggtggttatagaaggtcacataaatgattcattcacatcgagctacacacacataaacacaatcacataaacaaacaaaaattgtgtgcgtgcgtaacttgtgaaaactgaataagttctatggatgacaccaatgttaatttcctgtctttggtattgtactatagtttgaaagatgtcaacactggaggaagttgccaagatgtatgagacttctgtatatttctttgcaacttcctgtgaacctataactatgttatagttaaaaaataaaaagtaaaaaaaatcttaagctttattacttgaaaaccttgaaaaaaatgaattgccctttttctatcaaatgattggcaaaaaaacttaaagccttatgcctccctctgctggtgggaatggagagggattgaaaagccatactttggtggttgcaatgtggatttctactgtttcctaagtaatctctgctcactattggagtgaaatttaaaatacgtacacttgttggcccaaacttactactaagaaaattgcctatagaactaataactccgtgttgtctaaggaaacatctgaatgcctatcagtaagagatggctaaatatattgtgctattttcatattatgaaaaattatggctgcctctgcctctgcccctctgcccctctgcccctctgcccctctgcctctctgcctctgcctctctgcctctgcctctctgcctctctgcctctctgcctctctgcctcactgcctctgcctctgcctctgcctctgcctctgcctctcgctctccctctctgtacggtgtccctctgatgcccagccgaggctggactgtactgccgccatctcggctcactgcaacctccctgcctgattctcctgcctcagcctgcctagtgcctgggattgcaggcgcgcgccgccacgcctgactggttttcgtattttttggtggagacggggtttcaccgtgttggccgggctggtctccagctcctgaccacgagtgatctgccagcctcggcctcctgaggtgccaggattgcagccggagtctcgctcactcagtgctcaatgttgcccaggctggagtgcagtggcatgatctcggctggctacaacctccacctcccagccgcctgccttggcctcccaaagtgccgagattgcagcctctgcccggctgccaccacgtctaggaagtgaggagcgtctctgcctggccgcccatcatctgggatgtgaggagccccctctgcctggccgcccagtctgggaagtgaggagcgcctcttcccggccgtcatcctgtctaggaagtgaggagtctctgctcggccgcccattgtctgggatgtggggagcgcctctgccccgccgccccatctgagatgtaaagagctcctctgcccggccgtgaccccgtctgggaactgaggagtgtctctgccccgccgccaccccgtctgggaggtgaggagcgtctctgaccggccgccccgtctaagtgaggagcccctccgcccggtagccgcccagtctgggaagtgaggagagtctccgccctgcagctgccccgtccgggaggtggggggcagcccccgcccggccagccgccccgtctgggaggtggggggcgcctctgcccggccgccaccccgtctgggaggtgtacccaacagctcattgagaacgggccatgatgatgatggcagttttgtcgaatagagaagggggaaatgtggggaaaagaaagagagatcagattgttactgtgtctgtgtagaaagaagtagacatagaagactccattttgttctgtactaagaaaaattcttctgccttgaaaaaaaaaaaacagaaaaattatgcaatttttgaaagaaagggttaatttcatacaattgatctgtttattatacaatatcaagtgtaaaagcagaaatacaaaaatgtttttataacacgtaatccagtgtttgagaacctacaataataaccacagaactatagcatacacaatatagtaaatttttttcatatattaaatatgattcacgtttcttggggtgactatagttttctcactaatagaagaacagtaagttgattaaaccaaaaatcatgacacaattatatagggaggaagtcagagcactctgttcttaagctctgctctagggagaaactatttaaccagcctaatgtgctatatacagttttattattatctaactgactggggaaagagaaatactcaactccatccagcactagcatccagtcccacctacatgggtggagaaagaagcaaagagacacttgtgatgtttacagtccacagacataagctcactaaagcactgaaccctaagcatagaagtatagaatgtttctcttcccctacaccttacccccatattattaaaggcctatttctagcacttcccttcacccaatatattttatctggctatcaagtaaaaattataaggcataataaaaggcaaaaagacatggtttgaagataacaagcaagcttcggaaccagacatggcagggatgttgtaatttttaatagaggagcaatgtaaactgaaagatgaagatcccaagaaaaagcaaaaaaaagaaaatgctagagattaaaaaacaaaactaaacagaacactgtaacagaaaggactgggtatggctggaaaaacaaagtctgatcttgagagtatattaatagaaatctccaaaactgaagagaaaagagaataaagactgaaaaccaaaggcccaagaactgtgagacatatacaaaaggtgttacattgtttaactctttttctctttagaaaaaaaaaaaagtgcagtttgctgccagcattcatataattttacataaacacactctttgaggctgaagcaaatctgactgattttcaatgtgaaataaaatataaaatccgttcttggaattatttctaaacagaacttgtctctaatcctaatataacagaaatgtatatgataatcagtatttaataattttttgtgtggtaaatttcaaagcacagaacaacataaagcggaatatcacattccacacaaaaatatcacgtttctcttcagattgtcttgctaggctcgtctttgcacaagcagcaaactttgcagtgaccagttggatttcgctcccctgatgttggtgatatctcttggggaaaggtcttccatacaggtgaagaggtatgacatcttcagagcaaggatgacctggaagactttgctgccctggcctgtgatgctttaagagcattttttcaatcaacgtcagtctgaagtttatatggctaattgtgtgctcaggattgtccttcttgaacagggtgtagaggttcattcagcactgtaatgtttagaaggtggtgaaagaatttcttagaccgaatcttgtgccctttgaagaagtgagcatcaaatcagctgagtccactgctcccatcttctcactatagtccacagtggcatatgacttcttagttttctctccatttctgttgtctacttcaatcacagtatcattgtggaatgttgaccacattctcaccttcttctttttgaggtaaacactgtagctgcaagtgctgccagcaagtattcttgggcaaaaggtaaatgggttaatggacatgaagaaaaaggaggaggacggggtggaggcgtggtaaacaaaaccatattgagtgaaaatttttctaaattaatgtcagatatcgaaccacagatccaagaagatcaggaaacaccaagcagtataactgccaaaataagcaaataagcaaaacaaacaaacaaacaaaaacaaaaaacacttgagcatataatttttaaactataggaagtcaaaaacaaagaaaaagtattgaaaaggagacagagagagagagagagcatgaacataagagaaacaaacctttcatgtagaggagcaaatataaatattgcatccaacttcttctgtgaaacaggaagcattcttcacttcaatgcaagcaagaggagagtagagtgaagtatgtcgtgttgagagaagaaaaccaccaacctaggattctgttttctatgaaatcatccttcaaaaggaaatgataaatgatggctttctcagacaaacaaaaattcagaaaaatttgttgccagtaaacatgctttgtaataaatagaaaaagaaaagttcttttgagagaaggaatatagtataggtcagaaatttgaatttacataaaagaagagcatcaagaagaaataagtgagggaaaaattaaggaacatatttttcttattcttaactgatataatttttttcaaaataatagtaatgtgattattatgcatgctgatgtatacatttacatatataaatacacacgtatgcacatatatgcatacttatttatacttacatataagtgaaatgaatgacaataatgcaacaaatggaaaaaattaggaatactttgttattatcaggtactcacatgacctatgaaatggtataggagtatttgaaagtaggcttggattagttgtaaatgtatattgaaaacttcagagcaacactaaaagaggttaaaaaatctaatatgctaataaaggagagaaaatagaagcgcataagatgctaaattaaaaccataaaaaagcagaaacaagtagaagataaacatagaaaaaaaacacaccaaacaataaatcgaaaacagtgaaagtgtggtagacattaatccaaggcattgataattagttggagcatcaagtgtctaaatgtacaaattaaaagatatgttattagagtgtatcaaaaaggaagattcaactatatggtgtctataagaaacctaattaaaatattaaagcacatatagattgaaaagtatatgaatggagaaagatataccatgctaatattaatcaaaagaaagcacaagtagctatattaattttggaaaagaagatctcaaagcaaggaaatttatcatggacagaaagagcattacatatgaaaaaggggccaattcttcaagaagacaaagcagtgcttaacatatgcgagcttaacagcagactgtcaaaataaatgtggcaaaaactgatagaactacaagaaggtacagctgagtccacgattacagttaaagactttaacacttcactatcagaaatgggtagatccagcgggctgaaaacccataaaaacagtcaaactcaacaacactatcaatgaactatgtataattgccatgtgtacactattttgtccaaacacatattttttcaagatcacatggaatattctctgtgataaacttaatgccaggtcataaaacacacagtaacgtattttaaaaaaatagaaatcattcagtgccttctctcaaaccacaatggtattaaaatacaaatcaataccaaaatgtagacaatacccaaatatgtggagattaaacagcacacttccaaataacaaaagagttaaagaagaaatctcaggagaaatttaagaagattttgaactaaatggaaataaaaacatgactcatcaatatttgtggaatacagcgaaagaggtgctgagagggaaatttatattatcaaatgtataaattagaaagaagaaaaatctaaaatcaataatctaagctttcactgtatgaaagtagaaaaagaagataaaattaaatctaaattaggcagaagaaaggaaataaatattagagcagatatcaaaaaaattgaaagcaggaagtcaacagaaaaaaaaacattaaaagctaatactataaaaatacaaataacattgataagcctcaagccaagctaaggaaacacagaaagcacacacattgctaacagcagaactgaaagaggggacatcactacagatcctatgaagcttaaaaggatactgtacgactattataaacaatgctatgatccaaacttgataactttgatgaaatggatgaagtccttgaaagaagcaatctaccaaaactaactaaaagaaatagacagtataaactgccctatatatattttatatatttaataaactgaataaataactaacaacctttttaaaaataaagcaccagattcagatggattcaatggtgaattctaccaaatatatgaggaagaaattcttcaaattctccatctatttcacaagatagaagcaaagggcatacctcctaagtcattctgtgagggaaatactagtctactaacagaaccaggcaaagacattacaagaaaatagaactacaaatatttctcatgaacatagatgcaaaaatcctccaaaaagtattagcaaatcgactatgacaatgtataaaaaaacactatacagtatagtatgccaagttggatttatgctaggtatgaaaggctgattcagtagtcaaaaattaattgatttaatccaatgttaattcttgtgcatccaacacaattgagtatccagagaatgggatattatttatagcctaaataaacaagctatcaaaccacgaaagaacatggaggaaatttaaatgcatattactaagtgaaaaagtcaatctgagaagactgcatattatattatttcaactatatgatgttctgtaaaagacaaaatcatagagacagtgaaaggatcagtggtagttagggatttgggagggtgggggatgaatgggggaggtgaacagagaatttttagggcagtgaaactgttatgtctgatactacaaagatggatatttcctattatacatttttcaaaacctataacatgtatgacatcataagtgaaccctaatgtaaactaagaagccctaatctaaactctgggtgataatgttgtgtcaatgtaggttcactatggtgggggatgttgataactggggaagctttgcctgtgtcagagaaagatacgagaatctgcactttcttctcaattttgctgtgaacccaaaactactctaaaaatgagctctttaaaaacataacttcctcccctgcccggccagccgccccgtccgggaggtggggggcagcccccgcccggcagccacccagtctgggaggtggggggcgcctccgcccggccgccccatctgggaagtgaggagcccctctgcccggctgccaccccgtctgggaggcctaccgaacagctcattgagaaccggccatgatgacgatggcggttttgtcgaatagaaaggggggaaatgtggggagaagagggagagatcggtttgttactgtgtctgtgtggaaggaggtagacattagagactccattttgttctgtactaggaaaaattcttctgccttgggatgctgttaatctataaccttacccccaaccccgtgctctctgaaacatgtgctgtgtccactcagggttaaaatgattaagggcggtgcaagatgtgctttgttaaacagatgcttgaaggcagcatgctcgttaagagtcatcaccactccctaatctcaaatacccagggacacaaacactgtggaaggccgcagggtcctctgcctaggaaaaccagagacctttgttcacatgtttatctgctgaccttccctccactattgtcctatgaccctgccaaatccccctctctgagaaacacccaagaatgatcaataaatactaaaaaaattaaaaaacaaaaaaacaagaaaaacataacttcttaaaaaataattagttatttccactatctaatacagcaacttgaattgtgggagaatgagtaacagtgaaagatttgtcatattttcttttattataaatcaattattaaaaatattattcttacaaaataatcttttttgaatttcagagtattgctattgccagtaaaagttaatgataaacctttaaaaagtctgccttgtaattggttattttgtctcaaaatctgttgcccttaagtatccagaccatgtaaacttttgtaagaattcttctttcatcagaaaaaggctttgaaattttcttatactatctgggagtataatattcttaattctaaatgggaacctcccctttctgtatgttaacataccgtgccaaaatgttgacaacagcagctagagtggatcactccacactggacaaagataagaattgataaagtttgtaagaacagcctatgtttagatctaggtgggaagcaggccactgtgtgtctccaatcttggtcacattcaactgcatgaggacagacttatataggtcagttttcttgtagttcaactttcttgccaaatcctgtttgggggtccataagtgtaaaagcacatgtaatatatatacatatataatatgtatgtgtgtgtgtaataatatatatattacatgtatacatgtatatatacatgtaatatatataccttatatatattctctctctctctctctctctctctctctctctctctatatatatatatatatatatatatatatatatgacttgggaaagaggagtcttggaagtggaattgcttgtgtccattaagctggattcagtgttcgtagggtggagtttgaccctatttgtaggggatttgggggcttatcaaggaaaaagaggtgaccacagagtagcagtagcacacacatttattgggtgaaactttgaggggctcacagggacaagtccttcacagcaggagtctttgcagatgtgaaggtgccaggttgctattcagaaaggaagggaaacaagaaaacacctgaggaaagggacactggagaaaggggcttatgtgtctaggtgatgtcacacagcagcatgatggagagcctctgggttagaaagctcaagaggacagttgcagtttgggggttttattgcctgaatcttactttatttattggcagcaggtgaggtttcctggcatatgcaaagcaagcagtgtctaaatggcaaaataataataataataaaatttgagggctatttttgaaataattagttgtgtaaaatttgaacttgatgatagtagtttaaaaataaacctgcagtttagcaatacacaactttgagggcagtaaacagagctttgattcatttatataacactgttgcacatcctataatgtttgttctgttgactttatcaacccaaactgtccaaacctataatgctttgcactagaatacatacccagatgtgtggttccttcccatacccaaatggaggttccttatggcattgattgtggtgatggattcatgggtgtgtactaattttcaaactcatgaaattgtgtacattaaatatgtacaattttttggtatgtcaattatctcaataaaatggttttaaaaatctcaactagcagagggatattccccaaatgcagattgtctagagtggattcctggcttcaagacacttgtaatgaaagctggttgtctcttctaaataactataaattgtcacccagaagaagtaaaattcatggctaaccattctgttttacaggttcagagcaggctttgtggatgtgtttatcctccgaatttatatattctctctaaacactgggagacgttagtatgtttacatgtctgacttctctgggttgtcaagatcccatttttgatctacctaatatgaatttgtatccaaatgtttaaattcttttctttccttttacttgaagtaaatactaaaaaatcctacagagatactcaacccaaccataaaaatgagtttgagaatcatgtgttggcgatgaaggctttttatctgtaaatgctaaactttctgctgagcccagctcacccatggactaactggataaagtgagacaataattccattgtctacctgagcattccccaccttaaaatttttaactgcctctaacatctctgctctaggcttactcttgaagacagggtcctctatcttgaaaagaagtttttctcaaaagccagagcttgtttaataattttcagtttttttaatgtgagatttgtctattccaccttgtaagaaaatttgatttgccagacaaatgaaaagtggaaaactcaagaagagtttagagatagaatcaaggacaatagcattttaaactgtgggtacatctgtctttgaaataatttgtataaatatacggaaatgacaaagtaaataatttttttgtatttttaatttagataagatagtttacttgcagaaaaatggagactatgaacctggaattctcaaattcaatgttttttcttccggtttaaataatttcaagaatctataaaatacttacataaactttaaatacagaaattttaagagcttcagaaaaaatcgaccaaattaaatcccttacactagtttctgaaatcaaccaaaattgtgttttaactactgtgttttatttccaatgaacaacaatcaaaaacattagataaagtaagatgcaataggtgaatgaattgtttggtggtcactcttagttataatgagataataatgagacaatatcttcatcagaaagtggaaatggtgactttctgccttaagggagcaggggactcacagttgtaaacttcccctccgtcttgatctttcttgtgcaggagccgagggtaatccactgtttcagtggtctttgagcagcaacagtcctcatctttctgtaattctagaaatgctcatactgggctcttctaaaacactttttatgctaaatagaaaaataaagatcagtaataaaataaaaagaaataaaataaaataacttatgaactcctggaagtagttgtgggataaaattataaagtttaacaaaaaactagaacctagaacaacttactaaaaactaatttagtcaaattttactcttattttgtattcttgccctcacaaattaggaattttctcaacccaaagaatgattgcctttcttatattctggaatcttaacagccataggagaaatttgaaactatgagaatttatactaaccagttatcctaggaaatctggttacacaaaaattaactatttagagtaaaataaaaggaaaaatttgttgatcccatggaaataattaactgaatatttgctggtcaataaagctaatcctaagtatgcccctaaataacagcgacatcgttgtttctggattaatgctaagttttcaagatccattaaaagtaatttgccttggattcagactcatagtattggtcataactgtaattcaactaccaccagaacttgtagaagacaacaacaaaaaagaaggggtaatgagaaatatgttatgaaatgtatcccaatgttaacatttatgaaggagagggaggtgttttatgaatatctattctcatagcactgatatcttcaatttgataagcaaatacaaatctttaaaccagaatttggaacagggtaaatatggctctcatgaatttgacttgactgcgtcctggggttgtattgacataaggactagatggaggtacatacagcagaagtaatgaaaattataatgtcaaattttagagcctcctaactaaagcactagctcagatactgtataaagatgaaaaaaaagttatgtgaaaatgccctggaactgtttctggactgcctagtaacatcctggctgtggttggatggctgatttaccccagctggaagtatcagtattgtacagctgaaatttgtgggcactctcctctgcagttgtcaccaaatggcttatacttttattttcaaaatccacttgcaattctaagagctctccttttctctcacaaaaggcagttgaggcaaatcaaagacttttgggataaaatgttatctccactatgaattgacaaagtctatttagatgtttgcaaactaaacattttcactaattgctgtgagtcacactccccctgagtatagcttgtgtagaatgcaatcacaggtatgtaagtggaggtttggtataaccactaatggagaggtaggaagttagaaagtgggaaaataccaatttctgaatattaccaaacgttatcgtgttaaaaatataacaaaacctgctaatcctaacatatacccaacctttgtagccatgagtaggcctcaattttcttgctgttatgctgactaaatctcattgacaaatgcaggaaacacagggaggatcagaatgcactttccaggtagctctctcttctgtcatgtctagttgctcagagagcactttgatcaccttcattcttctgcttgagccatgtgaaataaggctgttacagtgatggggccagaacagtctggatcttcctgcaaattattccctgcagtcatctaacatctacctgtgaagccaactcagaatctgccatgcagacagtccacgtgcaaacacttgtggatggctgggccatcccaagtagggaggtttgtgttcagggttttaccactgtgtgaggaccttgcagaccctgttcacagcaataaaccccaacatcctcagcctccactttgctgaatttaagtgtgaaacctgtccctgacctgctgccactgaacttgtttgggactccatagaatttgttagaaattgtgtagataagaagctgtggagactggcctggcttctgcaggtaccaatccaaataggtgtttccatcactatgcaggaggctctgactagacctgcaggagatggaggccggctctcccagagggatgggcagggagagcagatgctgggtcatcacaatatccccactggatcctaaaataataacagtgagaagtacaaggttacatacaaacaatgtgagacatttttataatttagttttattgtatacgttaggctacttttttgtgtttgattagattcatacactacatttatccaatatccaaaaataatccaataattaaaggcacaaagtggcctctttgtttttgaagttctcgacagtgaagttctttttccttgtggctcgttcttagttcttacaggtctgaatattaaattccctttgctggaggacaagaaatctgcatctgacatgtagacagaacaacaaatgggaggctgcagattccacagagctcaccctccagtcccattctcctctcttctgtccttaccagggacccagagcattagcagccccaggagctgagcagggagcctcactgtgagaaggtgaactgaggagtcctgatcagtcaaggcaaggttagagctgagcttttatctcagactcacaagggaaggtcttccctaggggacaacatgcaaatcccctggtgagtgaagcagtgaagaaatatccagttggggtcgaagagtgggcttcttatgtaagcaaagtgacacagaatatcttttgtgttgatgaaaccaaaataaaatattggtgttgcctggcttagaagggtgacattctgaaataccatgaatcaatgtggaagacactgtgactgcagcctgtcactcttcattgctgatgcaatggagattgtgatgatgaagatgtgtatcaatctttaggtggtgaataggctttcttcttggctccacccagctaattctgaggaggaactagctctcactaactctggtgctcattgatagaatgtctctaagtatcaggatgaacttgaaacagttccagggttatttggctgtggttgcaaggctgatttccctcagcttgtatttcactgtagctggtatttctgggcacttggctctacagctgccattaaatggcactaaatgatgccccagtgaataagctagctgtaatgtgtgcttcgtaaacaaggagaaaattagagttcacgggaagaggaatgcatattccattccattgtatctaatgcatgtcgttgtctttgaagggaggaaggccttggtaggcctctttggattctagaggcaagaaattctgtaccttggaatactgtactggctcactgaccgactgatacacgagtcagccagccttgagtgggacccggggcaaaaaaagggctctgcagcaggttcagcctgtagcacaagcagtcctgcctctcaggccagtgcagatgcagatgaattggacagcacaatcaaccatctggacataattgacacttcgagaacactccaccagcacagcagattgcataatcttttcaaaaaatttactaaaatagaccatattgttaccagaaaaggggattttgattcaaactccaagagaggattcttggatttcatgcaggaagaaattcaaggaaagttggaaagtgcagtgataagagagaatttattgaaaattactccattacagagtaaggcatcctcagaaagcaagcagaggaacataccgtctttaagtttttcttatataggagtgtcgtctatgtaaagactaaactaagctgtgcctacatgcggatgagcagacattacgacaaaatttattattctgttgatttaagggaaactattcttgacattctagtgtgttatcttggaaataaggactgtgtcttgcaaagaaacatattcattggggcaatgtgttatcaaaaaaaagattttatctacttatgatccaataatttagactgacttcaacagatttttttaatgacaaaaagcagaagatggtataagaggaaaatacaatacaacagaaaacacaagctattataactcttgcttcatggatttttacatatctattagacatatgctgggtatatgtgtgcaatgataatctaaaaactggatgctaactagcttaaggaatgcctgcattacactgagtcttgcccacttttccaattataaacagaaagctacagtactatttgtatgagtatcaaaacttttagctgcctgagatagaggtaaagaagatttactgagataaaagccttggaagtagtagagatttgtcctatgatgttatggctgttgctgtggttgccgttgttaggaaatacagtgggagtgaaagcaagattgacaagctctgctcttcctcatactcacaaccccctctagagatggacagatggtggtacaggaatctctgacacctcttagaagtcttttgctctttccagaatgtttcctgacaagtattgttttgagtcacagattaggtgaaactgggtgtagaagaaaggactagagcaagggaagaagttttccatcccagatagttgttgtaggaacagggaaatggaatttttcatagatttatgccacatttctatcatgttggggagagaggcatcaaaccaggctcattcctgaaagaatcattacattattttagagagaaagaactacaaatttcttgtcaaatagatgtttaaaattcaaagctactgatttttttttttttttttttgagatagagtctcgctctgtcatctgggatggagtgcagtggcacgatcttggctcaccacaacctctgtctctctgattgaagcaattctcctgcctcagcctcccaagtagctgggattacaggtgcaggccaacatacctggctaattttcgtatttttagtagagacggggttttgccatattggccaggctggtctgaaactcctgacctcaggtgatctgtctgcctcagcctcccaaagtgttgggattacaggcttgagccactgcaccaggccctgctgatgtattaatattattcatcttcttgaatacaccaaatggtaaagtgcaaatccacactttaaacttgagatttctactcctatgtaaattatactagtgaggaacaaaaaaattctctattggttgggagatgatgtttgacagtggtcagtttgtgaagtggaggcttacgtcacagtactttttacagtattgcatataaacatgaatgtcctcatacccagaagaatcagcatttctcatgagccatattaccaccaagaaagaagtgaattgaagcctgtgactacttgatgaagggtgtatagaagagggaaagaaaaaggacacaaaacacaatattgtaagtggaaaggagaaagtcattacacagcctataagagtaaaaaaataaagagaggatattatgagtaattttatgtcaactgacttgacaaaagtggtgcagggcaggttcttggcttcactaggaaggaatgcagcgtaagctggtggtagaagaaaacagctttactgaggtggcagtgttacacctctgtgactgctcttgtggagcagagctaccccataggcagtgtgccaagagcagtagcatagggcagttttgcagtcatatttatcactgcttttaatgacgtgctaattaaggagtgggttattcagaaataactagaaaatgggcagtaactttcaggttttgccatggcaatggtaaactgatacggcactggtgggcatgtgttatggacaggtgcttccagtgtctcttccttgtgtcacccactcttcaatctggtccagagttgagtcccacctacctcctacctcattgccccttggagattagatactcctccttaatcttaaggggactgcagaagagcagagtcccttttctgtgagtgcttccttctgactttatgggggcaggccttccctagcatttgaagagtaaaaatctttggtatctgaactaaggggcccagtggcaggatgctttcatttgtggggtcagaagacagaatggattgaaagacttatgacggaccgtatcatttttacatgaaatttagaagatataaactttactaggaggttaaacaagaaaattataattggaagagagagaaaaattaatgctcctatgtccacccacagaaccaagttgttaatctatgtgtttgcaaaacaacagccttaagttttctaggttttataaatggaggttgtggtgtccaccttttgtgcctgcaggatctcataagaaacaggtttaatcctggacagctagtggcttcctgaagcctaacagtagttggaataattaagaatatctggtaagggcccctttattctgattattattgattcttgggggatcattttgttgttgttgttttttaagacagagtctcgctctgttgcccaggctggagtgcagtgacacaatctcggctgggctcactgcaacctctgcctcctggtttcaagctattttcatgcctcagccttctgagtggctgggattacaggcatgtacccccatgcctaggtaattttttgtaattttagtagagatatggttttgctatgttggcaaggctggttttgaactcctggcctcaagtgatccacccacctcagtctcccaaagtgctgagattataggcgtgagccactgcacccagccagttccttctttttaagtttttcataagactaagtcttttggttaaacagaggagctattattttgttttgtggaaaagggcactattttattttcataattttaaaagcccttttgaatctggcctacatttcaaacaggggtggagcaaggtgtgtctgactccctgtttcccaccatggcttgagttagattttttttaggtttctttggtagttcctttggccacagagcttggaatgaaaacatttatagccaattaaatattttaggccagacagcatggaggtgggcaggcactcattagcccttaagcaggcagatcatgaggtcaggagatacaggccatcctggctaacatggtgaaaccccatctctactaaaaataaaaaaaattagctgggcatggtggcatgtgtctgtagtcccagctactcgggaggctgaggcaggagaatcccttgaacccaggaggcaggggttgcagtgagccgaggtcgcaccactgcactgcagcttgggtgacagagtgagactccatctcaaagaagaatatatgtatttttaaagctgtataaaaataaaaaagtaaggccccaaataaggttatatatgttaaaaaaccaagtacgtagaataatactatactgggggaaaacattgcttccagagacgcctaagacaaaacactttagcatcaagtccgcaacaacagtcagaaccggaggtgaaaaagccacaggagctgatgaagaagcaaaaggagacagcaatgatctcaggcctttttaaagggagaataagctgaaagcagcaaaacaccacagttgaatctctaagacactaatctcagaagttttaaaagaaactcattattgcatcaaaggcaaaattttctgttttactttttgtttgtttgtttttcgagatagtctcactctgtcactcaggctgcagtgcaatagcacaatcttggctcaccacaagttctgcctcccgggttccagccattctcctgcctcagcctcccaagttgctaggattacaggtacgtaccactgtgcctagctaatttttgtatttttagtagagatggggttttaccatgttggccaggctggtcttgtactcctgacctcaaatggtccacccgcctcagcctcccaaagtgccgggattacaggcatgagccactgcacctggcctgtataattttcaataatgtagcaaattaataacttaagaaaacccagtttcaatatgcagacgattttctagaaagtgactgggccatcattgttctcatctcagatttccacttcctgtatagaaggtgtaagaagaggtagcaagacattatgaaactaaattgtaagcatttgttagtgaacaaaatatgactaaagcgctactttttttaaaaaatttttatttattgttattattttttgatacagggtgtcactcttttaccaggctggagtgtagttgtgccatcttggctcactgcaaccttcgcctcctgggtttaagcaattctcatgcctcagcctcccaagtagctggaattacaggcatgcatcactatgtccagtctatttttagtagagacaacacttcacagtgttggctaggttggtcttgaactcctgacctcaaatgatctacccacctcggcctcccaaagtgttgggattacaggcgtgagccaccatgcccggccttaaagcagtatttttattaaataaagtgtagaagaaaaagtgtaaataaagtgacaaaaagaaaacacaaggccgttatggaaaatgataactttagggaagaaaacaagaaaaggcaaaccaagattcccatagggtgagtctccaatccacaatcctcagacaaatgtcaatgctggaaaccctggagcatccagggagtgaccgaaaataccaaatgctgaaaacccagagtacccgcgtatcagcctatgagtgtcccacaccaaatgccaggaaaccctggagtatccaggggctgaccagtgcagaaaatcctggagcctcagtggggtggccaacagtgagccccaaaggcctggttggggccacagaacaatgtgactctggcttcttagagtcaacagaacaggagaattcttacatccaagtgtcctgccttaaacaattgcacaaacataattagtagggacccaaagaaaaaactgcaaagcaaacacatatatcagggtagaaaataagataaattggctaatggatagataaaatggcattagaggagaaatgactaagagaaggagcaatgaggatgtagtcaggtgtgctatgggggacttcaaatggactatttagccaaaggccttatttcctggatcatctgacatagggcaggtgggtagatgggacacttacaggtgtgcaggagccaaaatggtgccaagcagtgtctaacgtggggcctgtgtgaagatctctccaggccccccagcttgggtgggttgagctcccgtgggtgaactggtgcatgcagcagctggcctgcatgaagcagtggctctgtggccacttacctaactgctcagctccaccgcctgtcaggaaagatgatggctcttaaaacagcctttggctagtgttaacagctctgcaatgttagcaactctgtagctttgctcgctgtagtgctgatccccatcacaccctctctcactgatcactgtcttgccacttctccaatagctgtcttgcccattgctgatcgctatgtccatcttctcacaaaatgccatctcttgctgtctcttgctgtcttgcttctccgctgtttccactgactcactggcacatcaaacgctgcctctcaccatgtcacatttatcctccctcctcattaaacatccatcttcatgtccagcccttgcatcaccaggctgatgtctctgtactgggccaggtactggagagtattgttcctccatcttcaccattaagccatggttctctcaaatcaaaccttctcactgcaccaattttgccaagaaggtttgctgtgcactggttgccaacttacccaaatccggtgacacacagcacccatgcacaaccagttacatgaagtggattactacttacagagagtcagccagagagagcacaaagctgcggggacctgattgacactagactgtgtgtaccccacaaggactgcagctgagggaccctggaatacagcccaccctgggttttatgtcttagaatcacatgacacactgggctagagtgttgaaggaattcctgtttctagtagggacagaaacggaacccaggctgttctggccaatcatgccctatctcagaatgttacatttccagaacattctacagttattccagaaaactacaatcaagaaagggaaggggactgggttgattcaagacaaaatgaaaactattctgcaaataccatagtgaaatcacagctcagtaatctttttgtgactggcttatttcatttagcgtaatgtcctctagtttcatccatgttatagcatgtgtgagaatttccctttttaaagctaaataatatgctattgtatgtatatatcacatttggattaccagttcactcctttgtgaacatttgagttgctctacctgttggctactatgaataattcggttctgaatgtgggtatacaaatatctcctcaagttaatgtcttcaattacttgggtatatgtccaaaagtggaattgctggattatatagtatttccattattaattcttcgaggaattgccatctggtttcccacagcaggtgggccatttacatcaccacgacagtgtccacaggagttccagttccctaagttctcaccatgactggtcattttctgttggaaaaaaaaatcctaataggtgtgaggtgggttttgtttttatttttctaaggattaataatattaagcatcttttcctatgctagttatctaattatctctaaagaatattctccagagaaatgtcgattcatatacttttctcgtttttaatcaggtattttattttaatgttgacatgtaggacttatttttatgtactagatattattaaccccttatcagatatacgatttacaaatattttcttctattccacatgttgcattttcactgtgttggttatgtcttttgatgcccattttacatttttatgtagtccaatttatcttcttttctacttttgcctgtattatggtattaaaggtgttagtattcaaatgtctataaatactgacttactatgctgagaaggtcactctagaccatctctctgatggtggagctaagaattttacactctctcattttgtaccagggcacagtgcagctaggtgagaacacagtggctttctcgagcttatttgtcttgcatttttggcgacaaggattgttgttcacattggcctcctctggcaggtccacctggaaagcattatatttagcaagaaaaaaggaggctgtgaatgatgtcaactgtgtatattccctgttgcaagtgtcaaatccatgaagcataaaaggatttactagaggatattaaattccttgcaaagtgttgaaaaacctgaaggaataggctccaggcaaagcctctagaacaattccaagaatggcactgctggcgcaggctggggaggagctcctgctgcctgagactccacattcaagctgtctcctgcaggaaagagagcagctcttctcactactgccccctgaaggacagcagctctgctatcaactactagagacctgacccctttccctgcagccctgcctgtgttgattatatcttcatgtcagactcatgtagattcatctgttttcaagggtacaggggttatttctgcccaagtccacactgtggctttctatcataaatacacgtttctacacttgaatttccaggaattactagtatcaacagcaaaatgctacaacccaacataaagatttcctttacaaagaacatcatgctccccatgtagcattgtgctccccaaaatgtggggaaactccaatctgttcatcccaacaccatctaggaaaaaatgttcttctctcatgagccattaatctgtctacttattgtttaatttttggcctaaattgtaaaggtggctaaaaatagcactttgaatttttttaaagaaagggtatatagaaaatattaaattatttaaaatacatatatgcatgacacatttagttattgtcaccagcttctttcacatttattttattctgtagtttctggcaatactttctctatggtagagtctggaaatgctactcctcatgtccttggcttcctaagtcccagatgtggtgaagaatgcacatcagctgtgttactacagaatgcttttggattgagatgggggaggggacgtgcttgatctcactcaaatgtgctcaatttcctggtctgggtcacagccaggcagcccagtcctatgggcacaatatcttcactcgccaggtttctatcaaaatgagagtgtccttcttgactgtggaaaacacggggcagggagaggatcaagaaatagcaaaaggagtatttggacttgcctgagctgccactctggtttccccaaatgttttcattccatttcattcatgataataaacacctttctgcctaaccagccataatcacttttcttagatccagctgattcagtgataaaactaaagggaaaaaataaatacagttttcaacgtttaagctgaccaggtggctgtctctggtgtttatacctccatatcccactatgcatttcatcttccctttgcctcactggagatccaagtgcagggaatgcttcacgtgactgtgatccctagaacttcatcttcatgactgttgaaatcttctctgagttttaccagtggaaatggcaataaatagaaagattccagaaggtcccctagggtccatattttctgtacttcttctctaaaataagtaaaatcaattccatttgctcttgctttatattggctacatctatgtgcccaggacacaccctaaagccctgtgttgacaacttatccagtattgtattaagtctaaatggtcacatgcttatcatatcatttcttccaatttcatggaataattgtcatgtcaactctttggattaagaaccatcaaccagataaccacagccctgaataaatagaaacagaatatttcaagctgttcagttggcataacagtgatgagtctatagctcattttcaagatataaatattctatttatgggagtaaaagcacgaatcatggttagtgtttcagagcctccaccacatctgacagcatagcaattcaacagcacaaggtttgtgtgccagctgtgcctgactaataatgtttttttcccctgtctatagggaaatctgcacctgtgcacatgacaagagcatgagctacacttttttcactttttctgaggtaaatacattgcttgatccaaaaccgtattatggaataatttcctgactctgatgaaagcatttggaaaatcctcaaataatatttgtgcagaaatacaaccaaaaagaaaggcaaattcatatataggaaaataaccagtgctctcctcatgttacatgaggtccactagtatcacctgaccccagctgttcatctgatccctgatgtgttgtacaatgttaggggttcaggaggggtcattcttcttggcaaatgaggtgttcagaagagccagtagccctttaagtctcagttagttgaaattcataattgagtccccaaagggacctccataacattggttcatgagactccctggtaaagctgggaaaggtgactgactgaagtccatgtgttgaatcatcctcattattaaaagcccctgctcattaatagcattttgattaatattcactgggaaagcattttttttttattttggctcatctttgaaaagtctagtcatagcttttcaatcactttgtctgcaatcgttttgttgcatttctttgaaggcctgatgatctgtcaaaaccaacagccaatattattacattgccgttatgttgggaaaagctgaatgttgggagaagctgaggcagggcttgcatgtctgacgtaatgtaaaagagtcttggaacacgtccggggtccagggtctaaaaccccttgtggcctttagtacaccaagctctgtgctaaagggtggaaggctaccctgacgcaccataatctaagcccagggcataaaatcccttgtgacttggatagaatccaggactcgtggctctggagtgtgtctacacttgctggctcctttctctttgctctccaaggatcgattgtatcttgagttaaaagaacctgctctccattatctcaagtagtagagcaaatgctaaaccatcacaggtgtaaatcatgtgcttaatgcaatgcatccttttggcctccacattcttaccacgtgtttctttgttggattaccaataaatagcatgggatcccagggctcagggccttcttagcctccatacactacgatggtccctggtgcccacatttctctctcaaactgtctttttctcaatctttgactccaccagactttgtcacccccacgacctggtgttgggtctgatcaccccaaaactgttatcgttgcaatgtgatcatcagatataacccttgcagtttactcattgttatgatttttacatttgcagggcttccttgacaatggcactaatgtgacgccatccagcatccattattgtgagaactctatttggaatatcaccattgtgggcatgaacagaatggagactttcataggatgcaatgtttaatattcaacattagtcaaaatttgttctagtcctacccttggagctccattgagttggaaaaatataaataaatttattttaaatataatataaatgtaaatataaacaaatttaaatataatataaatataatataaatatacataaatttaaacataatataaatataaatataaataaataaataaacaaaaaaattttctgtagcaagagtaagaactacatgtggtccagaataccattattttatggaaggttacaaaaaattttaaatgtatttaattcagataagaattttataaatatgcatatattgcatatatgatagaataaatgtacttaaatatgaatactatatatatttgtagccaacattttatcaaaaacatatatattcacttctatgtatcttatatacatgtatgcatacttttccgtaagataaattttaattttttattgaaatactaattagttttaattttgtctttaattttcttttaataacttcataatttgattactggatattcacatttaaatcaccaatttaagaaaaaatacatgtgtgtacatataggtagaggtgtaaatactgtatcaggaagcttttatgcattactgattggtaactggttaaatacacaactcagtgactgataacagtaaacatttgttttcatgttcacggatgctcatgttcacaatcctctgactgatcaaggaagggctcagctgagtggatcctctgaaggacacagacctcatcttcagcctatagatatcaattgtctgaggactaagctgaacaccagtgactacacatgatacaagattcttgtggcaggtcacaggagtgaacatcccaaaccaaactggacagttgaatttaagtccaataatttctaacatagcttcagatatttaaaatatattcctttatttcagtgagtacaaattttcaagaaaatgtttactccatttaattatagaggtgtttgatcattccatggacaaataattatgttttcatcctttacaatcttgaaaatatttgcaaatgtaaatttgcattaataagaaaataaagctggatgtgttttcaacatgtggctttaaatataattttttaaaatggcctcattgggggaaaatcattttaacttatatgaatatccttttttgcctctcttgtgttctatagagtggcccaataagaggtcctcccatgagatttggaatcaggaaaggatggctcaatattctccattggtacctaggacagacacagggacagagatgaggactggagaaacacctggaaagatgctgtaggaagctgagagcatcagcacccccacccctaagcttccagacaggactgaggaccacatggttagatagcccatacttcaggggaagatgcattcagttttctgagggagcaacagagattcctgcttctaatatcaactttcctgactactatatccttggctttgaaaggttgtagtgggaaagttaatcgtaggaattgggtcattcttgtcatacccaacagagccaagaaaccaggagggaaagacactcagggtgcaaaatattgtctgaagaatgtaattgaaataggccctattatcccatggaactaatgtttatggttttttgaaggaacatagaaattgactcctccagtcttaaaaactcaagatagttatatttttcttatctgaggagttcttttgtcaggaaaccaaccatcaggcctccagatactatcaaaaggagctgaaacttacatatcactgaatcgggacagtgagacatcagactcttcacccattgtgattgcctaactgacctcctgcttcctgttgaccaaatcatcttccttacccctccctaattcctgttttcccacatttcttccctgatatatatacccctcattttagtagttcagggagatacatttgagaatggtgtcccatctcctcggctgcagcacctgattaaagcctgttccttggcaatacttgtcttagtgattgtttttctgtgtggtgagcagcaggatctacactgaatccctggcatttcagtaacaaaattctctgcaagcttcactgcctttggcttattgtaacctgaaatcaaatttatccacaacttctgatataacttgatataactgtaggattcactttgtccaccactgcttcccagtctgagcttgccagctcccaacccttcctagtgcccatgaactttctcaaagagccataggtaacatgttccctttttcgtaaaactctaaccttctctttgttcttccaacatattgaagaccactgagttttcctgtatgccccatttggcaaatatttctttgcacgtaaaacattaaatttagagattcatctctacattttatttagacttcagtagtttagactctaattgtctgtattaagacaattcctgctttgaatatctatagtggcctcttctctgttatataaagtccagctgaagccataaactagactcttcaggtgtcatgatctctgtctttattaaatcaggagaggcattgctagatctgtgcagttggggctgagaaagagaaaagaattagggtgcagaggtgactccatgtccccctctaccaacaccatcagagtgtggctgcatctgaggaccactctcagctgatagaggcatcaggaggagcagctggggcagccctgcctcacacatctgcttccctgggggtttatgttcgggtgtgtaacactgtgggagaataactattatactgttggcagtaataagttgcaaaatcatcaggctgcaggctgctgatggtgagagtgaattctgtcccagatccactgccgctgaaccttgatgggaccccactttctaaactagacgccttatagatcaggagcttaggggctttccctggtttctgctgataccaggccaaccagctactaatactctgactggcccggcaagtgatggtgactctgtctcctacagatgcagacagggtggaaggagactgggtcatctggatgtcacatttggcacctgagattggaaatagaaacacaaatattcatactattgatcatattataggaagacttccctgaataaccaggcagtactgagcacactgggctgagtaaattcctagtgttctccttccttacctgggagccagagcagcaggagccccaggagctgagcggggaccctcatgtccatgctgtgtcctgactgggtctgactcctgcacaaagtgtgaccagcctattaataaggcttcagggcaggaggttgtgctctgggaacatgcaaatgagcaggggatggggcaggctgggcacagctgcagagctggctcatctcagtaactcagcaccagctcagtgtccccaggtgtcccaggtaagaccagggtagcacaaatttgtctgcagagaatgtgtttctactggggactattttattatgagaaacaatttttaggtatttttttgagaattttaaatattcctcaggagccgatagagtaatgtatttcattggtgtatcaggattatttaggagaatattcttgtttgtaggaaacacatagtaaaatgttagatggtaggattctcaagtcttcaaaagactctcataagattccgggtagggaagggggtaattgtgctatacctgcaacatttctgtgagtttaacattgttcctttctaaaaaaaattaaaaataaaatgtatcggcatgatgctatatatttgtaagtattaggtaatggtgttatgcctttgttcttactagtattagatcaagcaatttattacagatatacaaagatgataccgtgttgtctccatgcatgcagcactcacagatccaccactatcaagaactgcaggtctctttaatacccagagactaaatgaggtgcaccttattcttgttttgggtaccttcatagtctaccttcttttctgccattgggtattatttcccaaagttcatctgtcttagtgagggtggccactgcacggagcatgtccctgccatgcaccatcaatgacactttcttcttatactttttatcagtgcatggggacatcatcctgacccagacaccagcctccctgttaacacctttaggaaaaacatactcaatctcttatcaagcaattgtctatgtacatggagaaatcagttggatccagatgaaactggacatggatttgcattcattatatctcatatctctaatgtaccctgaacgtcccagcctgactcagtagcaggggaagtggatgtaaccacatcagcatcagtgggctgcagcctcgggctccacaaaattttactgatgcctgactaggggagcaaaatcacagtgctgcagcccatgcacaaacatttctgctgctttgtaagcagcctgaattttaagggaacttgcttatattggaagaaaggaagaaagttccatttgtcctctaaatgtttgctgaaaatgaaccgacaaaagaataatgaataagagaaaaggcaaacaaaattcacttagagtgcggtgggatatcatagtggggtgattacccagataactcaatgagatccagttgttcatatttcctttctagggaagagggaattgggaagtgtaggcaacctggagagaatagatgaaaaaagaaatgcatcctcaaaagaacaggcaatagcctgcctggataaagcatcaacttgcagtctcttctatttttgattcatgttttgtgttaatcttccctgatataaaatttcccaggaagaatttccttgacaattgtttttcttctggagaatttgcttttaggcagataagggatatttaggaaaagacttcttgtgcatttgctgctttctaaatgcctttggctttacataatcatcataccaatgcagcatagtttgagatgttattttctggattcctttacttgcagccacctgccaagatcctgtttcagagagatgcagctgcagattgagtgagcagttgacccctgaacaacatggaggttggggcactgaccacaggtgcagatgaaaacctgtgtagaagttttgcatttctaacttaagtactaatagcttacttttgactggaagccttagtgataaaataaatagttgattacacttttttacattttatatatattttatactctattcttccaataaagtatggtaaagaaaaaaatgttcttaagaaaaccataaaaatgagaaaatatatttactactgattaagtacttgctttcaggtgacacagaagaaaatataagtgtatctgcaaacttcaaacccaagttattcaagggttaactgtaccatgatgaatgtagcagtccccatctgtagtctagggctttctcctttgctgtacctctgctcacttccaatggccatatatatgtcttatgttctttatgatcttgggcagagaggtctgcctacatgcattgctggccagatgtcctggaatgtgtatctctgaggaaagtgctatggtttgactgtgtcctccaaaatccatctgttgtaaagttcattctcagtgaaatggtttttgccaggtgggccctattgggatgtgtttaggtcatgagggtggagccctctagtggaatacattaatgccagtataaacagggtttatagggctggaatctttctctctcttctgctggtctgtcctgataagacatggccttccttccattgaaggactcaatgccccaggcatcgtcttgaaagcagagaaagctgaccttaacctgcccatgccttgatctcaaactttccgtactccagaagtgtgagaaaatatatttctgttttttatgaattacacagcgacaaggaacctgttatagcagcttgaaagagaacaggagagacagctcacaatcagtgaggataagatgaggtatatacatatcccagctttctcatctctcaggtggaatagcccagaggaatttagtccatgtttccacatgtggttgatcttcagttatcctgagtcaggtgggtggttgatgtgtcttttaccattcatcttctgctcctgcctcactttcttcctttcctcccagtgtaaatttgctgcctaaacaggaatactcattgctggtggacccaaaataagacagaaaaaaaaaatcattgtacttttgtatgagggatatttctcatctgaattcttatcacttctctttctttgacatctaggaatattcagaaaacacttttttttaaccaatctattttagattgaatttattgattttttttcctgtgtgttttgtgaaccaaaaattaagttgtaagccaccaacgagctaaatggactccccttttggcagagagaacttcaaagaaatctgaaaaactaggttaggccatgactggcaggtgggtttggatgtgtctcattatgctctcttccctttggagttcaggcacaactgaccagcattatcattataacagagatctttggactgaggaaacagatgcttgtagcaataagataccatactccaacatgacagataataggccctgaagaaaatctaaaaattttactctaaaaatatttctttttctttttcttttttttgtttttttttgagatggagtcgcgctctgtgcccaggctggagagcagtggcgcaatcttggctcactgcaagctccgcctcctgagttcatgccattctcctgcctcagccttccaagcagctggaactacaggtgcccaccaccatgcccgactaattttttttgtatttttagtagagatggggtttcaccctgttagccaggatggtctcgatctcctgacctcgtgatctacccacctcggcctcccaaagtgctgagattacaggagtgagccaccgcacccaacctatttctctgaaatattctgaagtggccctgcaaagctgcgcgttgtgggagaaatttgcattctgtagagaatctcctatgcttactaatcattttccaaaggtctgactttttttttttaaggtctgacaagcaacgtctactttttctgctacccataggattcatctacacgaaaagaaccttggcttatctaaactcaagcacaccccgttatctaaactcaagcatttctttatggtgaattcaactctttaggcagagcttaactctttcaaccagttgccaatcaggaaaactttgaagccacctgtgacctggaagcccctgcttcaagatatcccacctttccagtacaaactaatgtatatcttatatgtattgatttatgtctttgcctgtaatttctgtgtctccctaaaatgtataaaaccaacgtgtaatccaaccaccttgggcacatgtttacaggaccccctaaggctgtgtcacaggccataatccttatctttggcaaaataaatctataacttgattgagacctgtctcagatactgttttgcttacactgggtcacaaaatttaaaaatcctctaaaactatctacacatccataaatctacattagaggcagtggagtgagcacactccaacagtcaaaactcacaagttagaggaacctgagtctaagattttgtccagctctcttgcttcataaaaataatttgtgatttttttaaattttactctagagaaggacaattttggggaatatgtttatggtcagtggaatgaataatgtccccaccccaaaagatgtccatatcctcgtctctggaacccatgttatacgagttattaagaaactattttaggcatatagagaggaaacagggtccttgggaaggttttgtttcttttaaagcagctccagaaatgtttcttgtttagcaggaaagccctggctcttagagctggtccggcaagcttttttttcttttttagagagggagtctcgctctgtagcccaggctggagtgcagtggcacgatctcggctcactgcaagctccgccctctggtttcctcatgcctcagcctcccaagtagctgggactacaggcgcccgccaccacggccggctaattttttgtatttttcagtagagacggggtttcactgtgttagccaggatggtctcgatctcctcacctcctgatctgcccgcctcggcctcccaaagtgctgggattacaggcggcaagctttgatatacaaatactggccattagaaactgggtccagccaaacatggagattcccacattcttcttctttttttttttttttttttgagatggagtctcgctctgtcgcccaggctggagtgcagtggaacgatctcggctgactgcaacctctgcctcctgggttcaagcgattcttctgcctcagtctcctgagtagctgggattacaggcacatgccaccacgcccagctactttttgtgtttttagtagagacggggtttcaccatattggccaggatggtctccatctcttgacctcatgatccaccttccttggcctcccaaagtgctgagattacaggtgtgagccacggcgtccagctcccacggtcttcttccttgccccgacatttgcctgacaacatggctgcccccacatatccccatgtgtgtagaactttatggcaccctgcatttgcatattaaaacactagggtgggagggccagttttttctcaagctacatgaatgacatgcttggtaaaaccaatcccctaagccctatgcaaatcagacaccacctccttcagcctcctcatataagcagccacttttccaccgcacatggagttttctcttagttctaatctcccctctctctgtctctgtacggtggagctgttttcttcttccttccttcttgcgtattaaacttttcgctccttaaaacaaccccacgcatgtccgtttctttttaaacaaacccgcgtgagactaagaacggtggtggtcctccagtcatcagagccctatcataaggattctaccttacatagcaaaagaagaacttgacaggtgtaagttaacgactttgagaataagcaacctggttatccagatgaaaccaatataatcacaaaggtcattaaaatagaggaggaggcttgcagagaggagctgggacaatatggaaggatgtggtttgaggagggaaggggccatagagccagaaatgtgggagcacctggaagataaaagcagaggattcagttctttcctctggagcctccagaaggaatgcagccctactgacaccttaacattagctcagtgagaatgctgacctccagaactacagggtaatacatttatgttgtgtgaagccaataagactgtggcgatttaaacagcagcattggaaactaatgcaaggggaagaaatgtctttcagctcactgagcgcgtgcttgtcttctgttcttggaaatatttccaccttgttttctggtgtcagttatgacaagagacagagaaaatttttccgagagaagagctaccacgagaattcgtttttagctagaaaatctcctgggtaaaatctcatgattatctgttatacgatctgggtatcacagagtttggggtcagatctcacaacatgtgataggaggaagagggttttgttagtttgttttcatattgcgagggaaaattagattttcaggacacaatctgagaaggacagacagagtcagagatattgtaagagaaagaggagatgtggaaggagtcagggcaatgaaacacgtgtcccagctcccaaatctaaaataaagtcattgattttacaaggtgaagaaaagctcttcaccttccatcttcttaggaaggatcaaattcttcccagagtccctgcccctccttcacccccctgacattgcattgtggagctaatcacatgtgcccttaatccctgctcctgtcccaggctgggagaggctcactgtcctcaccatgcccagcaggctagagctggtgccctaagcaccaaaggagaagaggatgatttctgtgcaggcaataagagctttaccgcattttacatttccctaaaattctaagcaaagttctgtggagagaagagaacatggggcaactttatctggtggggctggaagagaccaggctctgagaatgacaattaattcacatttctacttttccagatgccaaatgctagctttatcaattgtggaaatgtggactttgagtttaagaacaggtttcaggtactgcaataattgaggagacatttggaatagagtccttagtctagggctaaagtcagactggcagtgcctgagagcttccaggcgctggccctgggctgtgagggaagcagcagttctcctgagccacagggctgaggacctgggagcaaccacaggccttggccacagggctgcctggcaggggcttgagggaaggaaactgctcacaaattcacaggagctgcattaagcatatatcccgcagcctggcaagagtgaaagtctcagagacccagaccttagggctggggctgggattctgggctggctgctgtcggctctgccctcccttgtcctgaatgactggcaccctgctggagccaaaaatggagggtcggccaatgtcctcaaagtctttactcagccagaccctgttctgcttggaaagaaaatgaacacatggtatacaaataaacataaaatcatgtgtatctgtaataagaatttctaatataaattttacatattgaatacatatattttagaaataagttgtacttatacatttgcctatactatgtgtctatttatggataaatatgtggtacatgtttatatataaagatatataactttggttgctagtataaggtatagttttaaactttaataaagtaaacacgaacattgaaaatgagcactgggtgcaccacttcatggccctcctcactccagggcctaagggtgataaagctcaggaccctcttccatgtcccccggcatggacagcagtgaactacccattgctgaggatcatgagtgacctgagggggatctgcagaatcacagagcagcagatgcccagaagattgatagtttggaccctgaatggagggacattttgatcacagggctcagcatagacaagtactcttctggtcatttctgtcaaacaaaacagcacatgtagctcagaggctgcatgatcacaggatgaagcacctccatgagtcattgccagcttcccctctgactggggtgatgtgggatctctctgccccactttcatggctcaccagctgctgggactctgttgacagtggtctacatctgtcccacgcacaaacttctcaatagttgtcattttacttactggtctccaataaccacaaattgccagccatgacccttccacaaaaattgatggagtggggttggaactatgggttcagcaatgtgccagggcatgtatataagagaaacaaggtgtggccagcccatgtctgaagtgaggatgaattttcaccatgaattcggagtaggaggtggaagaaaacatcctgacatgctccaggcagtgatgcccacaagatacactagaagcgcccacagaggaggtgggaagggggtgtgagaaaaagagggagtgtgaatttacaggtgtctccagactgttcacctgaaaagagatcagacccttaacaacacctgggaccccaggcagagctgttgctatggaagatttgtgcaggacagggataggaggagggagcacctacctgtgatggcatcttggttgctgttggccagaatgacatcttttcaggcctactgtccctgacccaggcagggatcatgtccaggagggcagcaggagctcagagccaggccctggttctgctagtgccaggctaggatgttcttcatactctggccagctctacaggtgacagtgaccctctcccctgagacacaaggaggaggacaacgatggcatccacataacatgctcactgtcatccaagtgggggaacaaacatgcagatccccaaatattaataccgagtttgtagttcctccaacttggtgcaattctgatcagaaggaaaaacaggctaacaacttcatcagcagggaaagttcatgtttaatacaaactatctgaggctgaagcctgagtttcccttcctcaccaggcagtcaggacagcaggagcaaaaggagaaaagctgggtcccaaagtccacaaggtgcctcctgagactgatcctgcttagagaaggtggtgacagtggatgagtcttctgggactcccacaccaacataccctgagctggatggcttgagccatagacatttattgctaatttattaaacgtttattgtgaatgtattagaaccctggaaagttcaagatcaaagtccagaaggatttgctttctggtgagaaccctgcttcttgttttcagatgtcacccctggatacatcctcacgtgtgttcagcaatgtgccgggcatgtgtaagtaggagaagcaagtacatgctttcttcagtgcatgcttggaggctggtgaggggttaaggaacagatcgatgatgtttatttttactaggacacaaatcctattaaatcagagccccaaggttttcacttcatttcaccctaattaccccttcataacctctatgtctaaatacagtaattttgcaggttggagattcaaaatatgaatttgtgaaacacaattcagttcatagcaggtgtgctttgaggacatgcccaaggcagtaggaagggcaaggcgaggcttccagtctcagagcacagaaggcgttttcccaccactcagcacactggcagctcctcttaggtgatccaggtcacacatgagacgccattcccgccttgggggctgcctgctgataatggaacaatatcacccttaattttcactatttctaagatcagacttctattttatgtttattatggagtttgtccaatggccaggtttgtaacataacctccaatgtttggtttgtgacataacatcttatagaattttagatgctggtttccagtgagacttgatggagttttttcatgggttttcatggagttgatcttattacatccaccattatgctgcattctgtagggaacacaaaatgattcctctcctcaataaaccagtcacctagttgaagataaagggtgttcagaaaagatggtcacaaaacaattaggggctagattctgtgatccatgtgagatgccaatgatgtgattctggaaagcagaaggtgaggttgtgagataccctgcagcacataatgcccaaggctagggtggcgagtagagggcccctggtctggatctgtctacccagcttcattcctcccattcgtgaaacagtggctgcaccagccaggaagcatctgagaccacctgattctctggaataatagctgctgaggtttgtgctgtgagctataacactgtgagtctctaactgtaaccatttagattagcactaatgaaaataatttttaagatggtgaaaatgtctatatctatgctttgcaagtgtagccgttatatgtcatatgtgactcctgaacacttgaaatgtagtgaaaacaactaaggaactatattgttaattttaattaattccaatatacatgtttgtggctgggtactgctaatgttggccatgtgagtcagggaagttttagatggtaataaacagcaatgtcatcaggacaaccaatctgctaaatgttaagcaaagatgatcccaggaccattgcaccaagctggagtggacaaggtggaaagagcacgtaggtggatctttggaacccagattctgcttcctccaggtgaatgatgtaaactctctgtcttgaagacactgacattgaagctagcgactggggagctgagtgtttctcctggaagctgcagtggaaacagaacatagatcttccttagtattactcatgtccctctccataggcttcccagcagagaggtgctgtctgatcaagtgggaggtgaatgctgtgctccctaatcaatagtctttctcagtcccatgggacatatgaaccctgtcacatgcagcccacgcagttgaagccagagccccatgtccagtgtccagtgttgcctctgccttcggtgatcccaccctacaggacccagtgatgaaggcttgagtggcagggaagagctttggggagcctgccaactagcaataagggtgcagacttgggcttccagcttctgagcaagggaacattgtatgtcctaggtgtgatccaggtcaaggtgtttgataaaagatattacaataaattattttcttaagaaaataaaaacacagaaggcatctgattattataggactgtttgggttttataccactaaagtggtaaaaataaatttttcaatgcgcagtggtttatcaggaatctcccagcccctgcccttcccgtgatgattctgtagtctttgcaggttgtatggtcacttggtggcctccttaccgatcagatgcatctacagcacaaccctaagatcttccccgattaacatagatgagcaacttcaacctccagataccacataccattggctgatttttatgcaatttatcaacactgaaagtattctattccatttcattatgtagttattattctgtgcatggctcattcccctactgagtatcagtatttgcgatcaaaaattgttttatttacttacatgcactaaaccttaaatgatagcatttattagttctgaaaactctgacattaagttaaaatcccttaaaagcaactatatgcttctttttttaattagaataaatatggtgcaatcacctcaactaaggatactaaactacttttacagttgaaaatgattaattggacatggggaaacatattgacaaaagtaacaagcattattatgatgttgaataaacacagtttgcatgtaaagtgtacagttatgattaattgtattaaaacacaggaggaagaaaggtggggattgctggattggttggtgattcagtccttagaagcaagggggagctgatgagtgatctcaggcaggcatccaatataaggtccaaatatgattaattacaatgttcttttccttaaggtttgatattttaagctggtcctgctggggaagttttgagcacattcatggaatatgtggaataaagattaaaaacagtatatttcaaaatactcttaaaaagctcagaaacacccaaagaaaactattttataaaatatcatgccttcctcgcccattcttgatatttgtgtttaaccaagcatgactcacaattcaacttttctccacattgttgcctagagtgttgaagaaattcctctaataggacagaaatggagtcaatcttgcaatatctggccaatcgtgttctggccagtcttgctttatctcagaatgttacatttccagaaacttctacagttattcctgaaaactacaagcaagaaagggaaggagactgggatcattcaaggcaaaatggaacctgttctgcaaatactgtagtgaaatcataactcagtaatcgttttgtgactggcttatttcacttagtgtaatgtcctctagtttcatccaagttgtagcatgtgtcagaatttccctttttaaagctaattttgcctttttaaagctacaatatgctactgtatgtatataccacatttggattaccagttccctcctttgtgaacatttgagttgcttctaccttttggctattgtgaataattcggttctgaatgtggatatacaaatatatcctcaagttaatgtcttcagttacttgggtatatgtccaaaagtggaattgctgaattatatagtatttctatttttaattcttcgaggaattgccatctggtttcccacagcaggtgggccatttacatcaccacgacagtgtccacaggagttccagttccctaagttctcaccaagactggtcattttctgttggaaaaaaaatcctaataggtgtgaggtgggttttgtttttatttttctaaggattaataatgttgaccatgttttcctatgctagttttctaattatctctatagaatcttctttagagaaatgtcgattcatgtactttcctcatttttaatcaggtattttattttaaggttcacatataagacttatttttgtatagtagatattattaaccccttatcaaatataagatttacaaatgttttcttctattccacatgttgcattttcactgtgttgattatgtcttttgatgcccattttacatttttatgaagtccaatttatcttcttttctacttttgcctgtattttggtattaaagttgttagtatttaaatgtctataaatactgacttactatgctgagaaggtcacactgcaccatctctctgatggtggagctaagagttttacactctcccattttgtaccgggggacagtgcagctatgtgagaacccagtggctttacccagcttatttgtcttgcatttttggtgacatggattgttattcacattggcttcctctggcaggtccacctggaaagcattatatttagcaagaaaaaaggaggcagtgaatgatgtcactgtggactgtgtatattccctgttgcaaatgtcaaattcgtgaagcataaagggatttactagaggatattaaattccttgcaaattgttgaaaagccttaaggaacaggctccaggcaaagcctctagaacaattccaagaatggcactgctggcacaggctggggaggagctcctcctgcctgagactccacaacattcaagctgtctcctgcagaaaagagagcagctcttctcactactgcccccagaaggacagccgctctgctatcaactacgagagatctgacccctttctctgactgcccatcagatgtgttactacagagtgcttttggattgagatgagggagggaaaatgcctgatctcactcaaatgtgctcattttcctggtctgggtctcagccaggcagcacagtcctgtgggcacagtatcttcacttgccaggttcctataaaatgagagtatctttcttgactgtggaaaatatggggatggtaagggtcaaggaataggaaaaggagtacttggagttgcctgagctgccactctggtttccccaaatgttttcaatccattaaattcatgataataaacacctttctgcctaaccagccataatcgcttttcttagatccaaatgattctgtgataaaactaaagagaaaaaataaatacacttttcaacgtttaagctgaccaggaggctgtctctggtgtttacatgtccatatcccactatgcatttcgtcttccctttgcctcactggagatccaagtgcagggaatgcttcatatgactgtgatccctagaacttcatcctcatgactgttgaaatcttctctgagttttaccagtggaaatggcaataaatagaaagattccagaaggtcccctagggtccatattttctgtacttcctctctaaaatatgtaaaatcaattatatttgctcttgctttatatgggctacatctgtgtccccagcacacaccctaacgccctgcgttgacaacttatccagtattgtattaagtctaaataggcacatgtttatcatattatttcttccaatttaatgagataattgtcatgtcaaatctttggattaagaaccatcagccagaaaaccacagccctgagaaaatagaaatagagtatttcaagctgttcagtttgcacaacaatgatgattctatagctcatttacaagatataaatattctgtttatgggagtaagagcaacattcacggtgagtgttgtagaccctccgccacatctgacagcatagcaattcaatagcacaagggtttgtgtgccagcagtgcttgactaataatgggttttttttctatagggaaagctgcacctgtgcacatgacaggatcatgagctacactttacttcactttttttgaagtcaattaccttcttgatccaaagccacagtatggaagaacttcctgactctgatgaaggcatttggaaaatcctcaaataatattttatgcagtaacataaccaaagacaaaggaaaattcatatataggataataaccactgctctcctcatgttacatgaagtgcacttgaatcacctgacatcagctgttagtatgagccctgatgtgtggtagaatgttaggggctcaggaagggtcaattttcttggcaaattagtgttcaagagagccagtagccctgtacatctcagttagttgaaactcatattattgagtccccacagggacctccgtaacagtggttcatgaggttacctgggaaagtgggcaaaggtgactgactgaagtccatgtgttcaatcatcctcattatgaaaagccccctgctcattaatggcatttggattaatattcactgagaaagcatgtttttcgattatggctcatttttgaaacatctagtcatagctcttccaaaatgactttgtctgcaatcatcctgttgtgtttcttttaaggcctgatgatctgtcaaaaccaacaaccaatattattaaattgctgttctctttgcaatgtggcaatgtgatcatcagatgtaggccttgcagtttacccacggttaggatttttacatttccagggattccttgacaatggcactaatgtgacgccatctagcatccattgttgtgagaactctatttggaatatcatcattgtgggcatgaacataatggagactttcataggatgcaatgattaatattcaacattagtcaaaatctgctgtagtcctacccttggagatctactggtttggaaaaatattttaggtaaggacaacaatttggtaaagttttaaaaataaaggctaaaaagaaattttctttagcaagagtatgaactatctgtggtccagaataccatttttttacagatgcaagaaaaaattatttaaatgtatataatttagataataattttgtaaatttgtatatattgcatatataatagaataaacataattaaatatgaatactatatatacttatagccaacattttatcaaataaatatatattaacttctatgtatcttatatatatgcacatttttccataaataaggtaaattttaattttttaatgaaatactaattagttttaatttcatctttaattttctcttaataacttcataatttgattacttaatgttcacatttataccaccaatttaagaaaaaacacatgtatctatatataggcagaggtgtaaatactgtatcagtaagcttttatgcattaatgattgataatcggttaaatatacaactcagtggctgataactgtaaatatttgttttcatcttcatggatgctcatgttcacaatcatctggctgattaaggaagggctcagctgattgattcctccgcagggcactgagcttgtctttagcctacagataccaattttctgaggacgaggctgaacagcagtgactacacgtgacacaagattcttgtgacaggtcacaggagtgaacaacatcccaaaccgaactgcacagttgaatttaagtccaataatttctaacatagcttcacacattttaaatatattttttgatttcagtgagtacaaattttcaagaaaatgtttactccaattaattatagaggtgtttgatcattccatggacaagtaattatgttttcaacctttacaatcctgaaaatatttgcaaacgtaaatttgcattaataagaaaataaagctggatgtgttttcaacatgtgcttttaaatataatttttgaaatgacctcaaagggggaaaatcattttaacttatgtaactatccctttttacctctcttgtgtcctatagagttgcccaataagaggtcctcccatgagatttggaatcagaaaaggatgactcaatattctccattggtacctaaggcagacacaggaacagaggtgaggactagagaaacacctgaaaagatgctgtaggaagctgagagcatcagcacccccacccctaagcttccagacaggactgaggaccacatggttagaaagcccttacttcagggacagatgcattctgttttctgagggagcaccagagattcctgcttctaatatcagctttcctgactactatatccttggctttgaaaggtcatagtgggaaagttaatcataggaattcggtcattcttgtgatacccgacagagccaagaaaccaggagggaaaggcactcagggtgaaaaatactgtttctagaatgcaattgaaataggccctattatcccatggaactaaagtttatggttttttgaataaacagaaatcgactcctccagtcttaaaactcaagatagcaacatttatcttacctttcttttttttttttttttttttttaaatttcaggaaagcaaccatcaggcctcccagatactatcaatttgctgaaacttatatatcactgaatcgggacagtgagacatcagacccttcacccattatgattgcctaactgacctcctgcttcctgttgacccaattatctttcttaaccctccctaactcctgtttttccacatttcttccttgttatataaacccctaatttcagttggtcagagagatacatttgagaatggcatcccatctcctcagctgcagcacctgattaaagcctggggcttgaaaatacttgtcttagtgattggctttctgtgtgacgagctgcaggatctacaccgaatccctggcatttcagtaacaaaattctctgcaagcttcaccgttttggtttattgtaacctgaaatcaaatttatccaaaacttctgagataacttgatataattctaggattcactttgtccaccactgcttaccagtctgagcttgccagctcccaacccttcctagtgccaatgagctttctcaaaagagccataggtaacattttccctttttcataaaatgctaaatttctctttgttcttccaacatattgaagaccactgagttttcctgtatgccccatttggcaaatatttctttgcaaataaaacattaaatttagagattcatctctacattttatttagacttcagtagtttactctaattctctgtattaagactatatctgcttcaaatatctatagtggcttcttctctgttatacgaattccaactgaagccataaactagactcttcaggtgtcatgatctctgtctttattaaatcaagagaggcattgctagaactgtgcagttggggctgagaaagagaaaagaattagggtgcagaggtgacttcgtgtccccctctaccaacaccatcagagtgtggctgcatctgaggaacaatctcagccaatggaggcatcaggaggagcagctggggcagcccagtctcacacatctgcttccctgggggtttctgttcgggtgtgtaacactgtgggagggtaattgtaatcttgtagacagtaataagttgcaaaatcttcaggctgcaggctgctgatggtgagagtgaaatctgtgccagatccactgccgctgaaccttgatgggaccccactttgtaaactggatgcagcatagatcaggagcttaggggctttccctggtttctgctgataccagcctaaatcatttctaatgccctgacttgcccggcaagtgatggtgactctgtctcctacagatgcagacagggaggatggagactgggtcatctggatggcacatctggcacctgagattggaaacacaaaaacaaatggtccacacaattaatcatgtagtaagagaatttccctgaatagccaggctgtgctgagcaccctgggctgagtaaactgccagtgttctccatccttacctgggagccagagcagcaggagccccaggagctgagcggggaccctcatgtccatgctgtgtcctgagtgggtctgactcctgcacagggtgtgatcagcctgttaataagtcttcaggtcaggagactgtgctctgggaacatgcaaatgagcaggggaaggggcaggctgggcacagctgcagggctggctcatctcagtaactcagcaccggctcagtgtccccaggtgtcccaggtaagaccagggtagcacaaatttgtctgcagagaatgtgtttctactggggactattttgttatgagaaacattttaaagatattttttgacaatattcctcgagagtcaatggggtaatatatttcattggtgtatggggattattttggagaatattcttgtttgtaggaaacacagtacatattagatggtacgattctcaggtcttcaaaagactgttataagattccatttagggaagggggtaattgtgctatacttgaaacatttctgtgagtttaacattgttcctttctaaaaaattaaaaataaaatttattgacatgatgctatatatatttgtaagtattaggtaatggtgttatgccattgttcttaccagtataagatcaaacaatttactacagatacacacccctgatgccgtgcttcttcaatgcatgtggcactaacagccccaccattatcaagagctacaggtctttttaatacccagagactaaatgggctgcacctgtgtagaatttttgcatccctaacttaagtactaatagattgcttttgattggaagccttagcaataaaataaatagttgattaacatgttttttaatgttatatatattatatactctattattccaataaagtatgctaaagaaaaaaatgttattaaggaaaccataaaatagagaaaatatatttactacttattaagcatttgcttacaggtgacacacacagaacaaaatataagtgtatctgcaaatttcaaacccaagttattcaagggttaactgtaccatgatgaacgtagcagtccccatctgtaatctagggctttcccctttgctgtacctctactcatttccaatgaccatatatatgtcttatgttctttatgatcttgggcagagaactctgcctggatgcattgctggccagatggcctggaatgtgtatctcttaggaaagtgctatggtttgactgtgtcctccagaatccatctattgtaaagttaattctcagtgtaatggtttttgccaggtggggcctattgggatgtgtttaggtcatgaggctggagccctctagcggaatacattaatgccactataaacaggaattacagggctgagatctctctcctgctcctctgacatgttaagacatggccttccttcctttgaagaactcaacgctccaggcatcatcttgaaagcggagaaagcagaccatgtggttgatcttcagttatcctgagtcaggtaggttgttgatgtgtcttttaccattcattttctgttccctccctcactttcctcctttcctcccagtataaatttgctacctaacaggaatccttattgctggtggatccaaactgagagagtaaaaaagaaaagtcattaatcttttgtatgaggggtatttctcatctgaaatcttaccatttctctttctttgatatgtacaaatattcaggaagcacctaatttttttttttttaccaatgtatcttagattgaatttacgctgtgattttttttctgtgtgttaaaacaaaaaatcaagttgtaagccaccaacctactcaatgggcttctcttttggcagagagaacgtcaaagaaatctgaaaaactaggttaggccatgactggcaggtgggtttagatgtaactcattatactctcctccctttggagttcagacaaaactgaccagtgttatcattacaacagagatctttagactgacaaatcaaatgctttgtagcaataagataccatactccaacatgacagataataggccctgaagaaaatctaaatattgtaccctaaaaatattttttttgatgtattctgaagtggccctgcaaagctgcctgttatgggggaaatttgcattctgcagagcatctcctcctcttactatgtcttttccaaagagttggacatttctttaaaggtctgataagcaacattcaccatctactttactgttacctgcaaggttcatctaagtgacaagaaccttgacttccacacccccttatctaaactcaaggatttctttatgatgaattcaactctttaggcagagcttaactctttcaaccagttgccaatcaggaaaactttgaagccacctgtgacctggaagcccctgcttcaagatatcccacctttccaggacaaactaatgtatatcttatatgtactgacttaggtctttccctgtaatttttgtgtctccctaaaatgtataaaaccaacgtgtaatccagccaccttgggcacatatttgcagggcctcctaaagctgtgtcacaggccataagccttatctttggcaaaataaacctatacattgattgagacctgtctcagatactgttttgtttacactgggtcacaaaagttaaaaatcctctaaaactctctacacatctataaatctacattagagacagtggagtgagtatacctcaactcaagtcatactttgagtttaagaaccagacagattttcaggtacttcgataaatgaggagacatttggaatagggtccttagcccagagctaaggtcaggctggcagtgcctgagcgcttccaggccctggccctggtctgtggaggaagccactgttctcctgagccacagggctgagaacctgggatgagccacaggccttggccgcagggctgcctggcagggtcttcagggagggaaactgctcacaaattcgcgggagctgcattaagcatatatccccccagcctggcaagagtgaaagtctcaggacacagaccttagggctggggctgggatcctgggctggctgctgtcagctgtgtcctcccttgtcctgaatgactgggaccctgctggagccaaagagggagggtcagcaaatgtcctcaaggtcttcactcagccagactctgttctgcttggaaagaaaaggaacacatgctacaaaaataaacataaaattatgtgtatttgtaatatgaatttctagtataaactttacatattaaatacatacattttagaaataagttatatttatatatttgtatatactatgtatctgtggataaatatgtgatgcatgtttatgtataaagagatgcaagtttcattgctagtataaggtatagttttaaactttaataaattgaacgtgaacattgaaaacaagcactgggtgcaccacctcatggcccctcctcactccagggcctgagggtcataaagctcgggactctcttccatgtgccccctgggccgatagcagtgagctacccattgctgaggatcatgagtgacctgagggggatctgcagaatcacagggcagcagatgcccaggagatggatagtgaatttggaccctgaatggagggacgttttgtccacagggctcagcacagacaagtccttttctggtcatttctgtcaagcaaagcagcacacatggctcagaggctgcatggtcagaggaataagcccctccatggctcattcccagcttcccctctgactggggtgatgtgggatctctctgcccagctttcatgactgaccagctgctgggaccctgttaacaatggcctatgtcagtgccatgcacaagcttcttgatagttaccattttactttctggtctccaataaccacaaattgccaaccatgaccgtttcacaaagattcatggagaggggtcagaattatgggttgagcaacgtgccggggcatgtatgtaagagaaacaaggtgtggccagcccatgtggaagtgaggatgaattttcatcatgaattcagagaaggaggtgggagaaagcatctgacatgcttcaggcagtgatggccacaagatacattagagatgttcatagaagaggtggcaagtgggtttgagatgaaaagggaatgtgaattcagaggtgtcccccagcctgttcccctgagaagatttcagacccttagcaacccctgggcccccaggtagagctgttgctagggaagatttgtacatgataggggacaggaagagggatcacctacctctgaaggcatcttggttggtagtggccagagtgacatctgttcaggcccattattatccctgacccaggcagggatcatgtccaggagggcagtaggagccagcaggagctcagagccatgccccagttctgctggtgccaggctaggatgttcttcatactctggccagccctgcaggtgacagtgaccctctaacctgagagacaaggaagaggatgaagatggcatccacataacatgctcactgtcatccaagtgggggaacaagcatgcagattcccaaatattaataccaagcttttatttcatccaacttgatgaaattctgatcagaaggagaaacagtctaacaaattcatcatcaaggaaagttcatgtttaatacaaactatctgaggctgaaacctgacttccccttcctcaccaggcagtcaggacagcaggagcaaaaggagaaaagctgggtcccaaagtccacaaggtgactcctggggctgatcctgctcagagaacgtggcaacagtggataagtctgccgagaatgccacaccatcatactctgagctggagggcttcaaccacagacatttattgctaatttattagacatttattgcgaatatattagaaccatggaaggttcaagatcaaagtccagaaggatttgctttctggtgagaaccctgtttgtttccagatgtcctctctggatacatcctcatgtgtgttcagcaatgtgccaggcatgtgtaagagaagcaagtgcatgctttactcagtacacgcttggaggctggtgaggggttcagtaacagctcaatgatatttctttttattaggacacaaatcctattaaatcagaaccccgatgttttcacctcatttcaccctaattacctcttcataacctctatgtctaaatgcagtaatattggaggttggagattcaaaatatgaatttgtgaaacaccattcagttcatagcaggtgcactttgaggatatggccaaggcagtaggaagggcaaggcaaggcttccagtctcagagcacagagggcattttcccaccactcagcacactggcagctcctcccaggtgatccaggtcacacatgagaccccattcctgccttgggggctgcctgctgataatgaaacaacatcacccttaatttcactatttctaagatcaggcttctattttgtgtttattatggggtttgtccaatggccaggtttgtgacataccacccaatggcaggtttgtgacataacatcttatagaattttagatgctggtttccagtgagacttgatggagttttttcatgggttttcatggagttgatcttattacatccatcaataggctgcattctgtagggaatacaaaacgattcctctcctcaataaaccagtcacctagttgaagataaagagttgagaaaagatggtcacaaaacaatcaggtgttaaattctgtgatccatgtgagatgccaacaatgtggttctgggaaagagagagtgaggttgtgaggggccctgcagagcacaatgtccagggctagggtcgggagtagagggcccctggtctggatctgtctactcagcttcattcctcccattgttgaaacagtggctgcaccagccagcaagcatctgagaccacctgattctctggactaacagctgctgaggtttgtgctctgagctataacactgtgagggtctaactgtaaccatttagatcagcactaatgaaaataattttttaatatggtgaaaatgtctgcaaatttctaacagaaaaattgatgaaaagatggtttttcttaggcccccacagcagtctctgcctgggacctgactttgtctttgagccagtggaatctatgctgagattgtaagctgggcagggaaatcacagcagggcaggctgtgctctgggtgctgaggaggacaggaggacactccttcagggttagtgatgctgggagttcgaggggagagactgcatggagctgcctgtgaatcgccctagcaatgccctctggacactgctcatctcacaagtgtactcggatgccagtggatggcccaaacatgggctcaggttggacaaggacaaagatttagggatgaatatatggggctcatttgatactctgaagtttcagcacaagcataacgaattatatggggagagaaagaagtcacaaggttgtgatttttcatttggtattaaaatatatcccctctgctcatttttccctgcagaatgtaactactgatacatatttaagcaaagtcactgtttttaattgttttagtaactgacagcctgtgtgcacagttcctaagtaactgggtagccagaccatcattcctatggtaaagccaggaagtgactgtggatgtgaacaaatgtgagtttaatgtacatgtctccaaagccacgggccactgatctagggagaacctgcagtcagtttgctttcccatgcccagatgagaggacaccttgatctgtgttcttctgatgaactctaaaaactctaaaaactgatgaactctaaaaactaatattctgaaggtctagttcatacttcttttctttgctagagggactctctcactcacatgtattgtactctctgcatagaacagtatgtgatacatacaacttgttttctgctaaatacccatcaatcatgtcattcatgagtcttccatagatgttacctgccctatgaatctgggctcttccaaaagaatgggccagaggtggagctgtgctttcacattctcttgtgcttccctcgtggacaacctttgctagttgtcacccttcccacccagcaaaagtaactgtctttctgacatctacacaatcatttaggttttcctgtcttaaacttcatataaatagcattatgtgtatttttatctttttagtcttggtattattccttactacttttgaggccttcatttcttccagtggactcaaggtcctgtctgatgtcatttcctgtgattctgaaggattttctctcaaatgttttataagacatagctgctatgaatgaatgtattttgtttaccaaaatttttttttttgcctttttgttagatttgaaggatattttcactggatagatttcctggctgccttcttttttttccttttcagcatttaaatatgtcattttactgcttctagcctctattggtcccgatgaaaacttagccaatggctacgttgttgtgtctctgtatatagtgtctgcttttattctgatgcaatgaagattttttctttgtctttcaacattttaatatagtgtgttcacttattaatttctattgactatctaaaagggttttattgaattatttcatctaagaatattttttattacttttgaaaagtttttgtcattgtatctccaaatattttttcagccactttctctgtctctccttctttgtgactctcattatacatttgttggtatccttcactctgagctataaatctctgacatttcttcctttttttctaaacattttctttaggctcaaacatttccattcctctattttcaagttaactgattgttctgtcatctcaatttgctattagacctagctaataaatatttaaattgtattatggtacttttcatttctagagttcccatttggtcattttttatactttccatttcttttcttgaggtcctacttgctgaatcttctttttaaaaatattttcgtttttatgtcaatgatcatagttttaaaaataattatttgaacatctgcatattaactgctttgtagtctttgctaaagccaataatgaggacaagttagaatcagctttcattggctattttctgttgtcattattgtagttgctttactttgttccttcaatataaatcatactcctctgtttttttttcaggattttttaaaactgaaagctgcacacttttgataatatattatagtacctctctttagattgtggggtttttattttaattttaatttttttagaaacagggtctcactctgtcacccaggctggagtgtggtggtgtgatcatagctcgctgcagcgtcaacctcttgggctccagtgatcctccagcttcatcctcctgagtagctgggactataggtgcatgccaccactctctgctatttaaaaaaaaaaatttgtagagataagggtgtcactattttggccagcctggtcttgaactcctggcttcatgtaatccttctgcatcaggctctaaagtagtgggattacaggcttgagctaccatgtcaggcctggaactggtttcatttttctgagcattttaaaatttttttcttagttacttgtcagaacttacttctggtacctgacttatgatagttggagttatcattttttgactttcagatggtgtgaaagtgatatgcattcaagtagaaatagtacttctagtatttatacaactattctatcttctctttcaatagagtattcaataaattgcatgagatattcaacactttgttgtaagataaggtttgtgttagataatgttgccctactgtaaactaatgtaagtgtactgagcacatttaggatagaataggctgagctagtggattacatatattaaatgtattttcaatgcatgatattgaaaaatctatatctcatatggtgtttgaccactgatatctctgctttttattcttaatatttagtttgaatttatagaaactgcacatgtatctgcacagcttagtggtcaccaatgatttgagaagaagttttgctcaaatatctggaggttataaatctatcttctgtcaatccatctgtgtgtagtttaaaaagctcctgcaaaatgcagctagttcttacctccctctggttttactttgcaccgggcacttctgggtctcatcactcatatctatagcttctaagtcaccaggaatgtgtgtagagattgtttcagcaatatggctctatcttacccaggaatctgctatttactgttagcaggtgtactacttgccccaaacagggcatcatctttgactaacaaagctgtgggctttttctgttcattccctatggagttctgcatgtttagctggaaacactgaagaattttacttcattccttggctttactcaagttcacccgctttggcagcaagctgctagctttatttgctatcctcatattggtaaaactccagttctgtatttcatgctgactgagctgggggtagaagggtgctgtcacaggcaaaaggctacagactttttctgtccttactcaaagcactagtacttttttttctataaagaatatacatctttaattattttatgcttcaccaattttcagagtgctgaaatagttttgatattttagctttatatgtgtgtttgttatttatttttgcacagaagatttattaaactctttgtgatgccataaacagagatgccttctaaaatgcatttaaatgaacataatagccatgctgaaatggaatgaggttatttactaacataagtaattttggacttgagaacttgaactcttcaccctcagtttaaagagaaaccaaggacttaaaaaatagagaatcctggtccctggatttcacattcatgaagaaatgcacagtcaatttttaagatgccttctttgtattctagaactgagcaaattagtgattacactctacataatgggagctatgattgtctttaatagagataagaattagaaataggaaaaggtagctgggtgcggtggctcatgcctataatcccagcactttgggaggctgagacgggtggatcacgaggtcaggagatcgagaccatcctggctaacatggtgaaaccccgtctctactaaaaaaatacaaaaaaattagtcaggcgtggtggcgggtgcctgtagtcccagccacttgggaggctgaggcaggagaatggcgtgaacctgggaggcagaggttgcagtgagccgagatcatcataccactgcactccagcctgggtgatagagcaagattccatctgaaaaaaaaaaaaaaaagaaagaaagaaataggaaagtgcaaaataggaggaaacttgtggaattgtttaaaaactacctttttcttattttttagttacttgtgtgtgtgttttaagtttatgtggaaatacttttagacctaaaatttgaaaaatatggtaaaaatgattcccatatgcgcctctttcagcttgctctaatgtcagcatcataaataaccacagtataagtatcacaaccatgaaatgaacatagatataatgttatttgttaactcatttaaaataccatatggatttcactgatttttcctgttgatgactttttttatgttacaagataaaattcaggtttctgtattttatttggttatcctgtcctcaatatctttaaatctgtgatagtttttcacttttgtttctctttcatggccttcaaacatttgaagtttactgtccaggtatgttgaagaatgtcctcctagttgggtttgtatatggtgtttactactgattcaattcacaccattaatttttggcaagaataatacagacaggatgtatcctcagtgcttcacatcagatgttacataatgtcaacatgtcttataggtggtaataaacgaatatgatcaatgaaatcccatttggaaggaagttttggacaaaaataatgaaaacaactgcttctatcactctttctactaggtcattgcagacgtcattaggaataatctatttcttccttatcgaatatgtactttattttaacaaactttaatctttttacagtctactgcatcacagagaaaattgaagaaataatttagttaacttttaaatggcaaatgtttccataataaccatttgccactgaaatgttgatagcctgaagaaagaaaaagaatgggatttattcagccatggtagtatcttcacatgaacagcttttaccgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaacagagtccaagaatcaaagtccaaattgttcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgctagtggccctggtggatgcaccatagatgaggagcctgggcgcctggccaggtttctgctgataccaggttaagtagctgctgctaacactctgactggccctgcaggagagggtgactctttcccctggagacaaagacagggtgggtggagactgtgtcattacaatttctctggtggtatccaagattggaaataaaacagaaatgcactcatgtaatctagatcaaaccagctgtctttgagtagagccaaaattgttgatctacattgaattttaattatatttcttgctgagcagaggtggcaggagttttcactgatgtgcaaaaccacctcatgttcccctcacctgggagccagagtagcaggaggaagagaagctgagctggggcttccatggttccgtctgggtcctaactgagcagttccttcccagggctctgacccaggcattgatatgggctctggaaggtagggcagctgggagggacatgcaaagcagctgggtgggagctgagcttccagctgcagagaccacctgcttcttcctctctgcactgagcgtcctgtgcctccctggttgtcaggccagaaaagtctgttggctcagtctgagtgtagaactcctcccttgtgctcacataatttcactcctgtgcctttcttctcttcaatcacctaaatacacccgtatgatatttggcacaagtctgttaagaacaatataaaaggctgtgttttcatttctctcttcctgtcctcagtatgcccagtcatctccctaagtgcattattggatctatggaaatgaagagtctgttagaacttaatcttccagatagacattttttttttttttttctgagacggagtctcgctctgtcttccaggctagagggcagtggtgcgatctccactcactgcaagctctgcctcccgggttcatgccattctcctgcctcagcctcccaagtgcctgggattacaagcgcctgccaccacgcccagctaattttttgtatttttagtagagacggggtttcaccatgttagccaggatggtctcgatctcctgacctggtgatccacccgccttggcctcccaaagtgctgggattacaggcatgagccaccgcgcccggcccagatacacctttcatttgcttattagtaatgttttctgagggtcctgaagctttccattaacccagacacataccctctttgagttaaaaacttctgtttacagtcacatgtcctggcagccctgacatagatgctccatggcttgccgattgcttgaaattaatcaagtaacttaacttccctgtgtctcggtttccatatctgtgtaactgtgacaatagtggtacctgccttacagtgctgtagacagtttaaagaaaataagataaaacatttacaatagtattcaggacattatgtatgtggcaattaattttgttttcattgtttaaatattcagcactacagtcatcatcattataaatatacttagcatggaaaatagtcttaaatctaatccaagaatgttttatccacagtcaaattaaattctaaggcattttcttcagtaactgtacacaactcttaaaatcctaatgatttgatcttaatctgtgctaaagtactcagaccttccatcattcccatccatccctgtctaacgcattacttctcatcatccattatttaaatgttaccctataaacggtccccatgtcctgttgctgtccttctttcttatgtaatctttattctaccttgttatcttttatgttattcttgccccaggactgacaataaggaaaagctaccatcatttcttgtagacttgctccagtataattttttcaggcttgttgtcttggaaatgaggattgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacgcttgcttcatggatttttacatgtatattagacatatgctgggtatatgtgcgcaacgacaatctaaaaactgaatgataactagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggctgtggttgccgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgttgtaggaacagggaaattgaatttttcatagatttatgtgacacttgtatcatgttggggagagaggcatcaaaccaggctcattactgaaagaattattacgttatttaagagagaaagaactgtgaatttcttgtcaaatagatgtttaaaattcaaaactactattttttttttggagatagaatctcactctgtcacccaggctggagtgcagtggcacaatcttggctcgctgcaacctccctctctccatttaaagcaattctcctgcctcagactcccaagtagctgggattacaggtgtgtgccaacatacccagctaattttcatatttttagtagagacgggattttgccatgttggcccggctggtctcaaactcctgacctcaggtgatctgcctgcctcggcctcccaaagtgctggaattgtaggattgagccactgtgcctggccctactgatgtattaatattattcatcttcttgaatacaccaagtggtaaagtgcaaatccacactttaaacttgagatttctcctcctatgtgaattatactagtgaggaacaaaaaaattctctgttggtggggagatgatgtttgacagcggtcagtttgtgaagcagaggcttatgtcacaggactttttacagtattacatataaacatggtgaatggcctcaaacacagaagaatcagcttttttcatgagccatactaccaccaagaaagaactgaattgaaacctgtgactacttgatgaagggtgtataaagaagagggaaagatttgggaggccaaggcgggtggaccacgaggtcaggagatcaaaaccatcctggctaacatggtgaaaccccatctctattaaaaatacaaaaaaattagctgggcgtggtggagtcccagctactcgggaggctgaggcaggagaatggcatgaactggggagtcggaggttgcagtgagccaagattgcaccactgcactccagcctgggtgacagaacaagaatctgtctcaaaaaaaaagaagagggaaagaaaaatgacacaaaacacaatgtcataaatggaaaggaagaagtcattacacagcctacaggagtaaaaaaataaagagaggatattatgagtaattttatgtcaactaacttgacaaaagtggtgcagggcaggttcttggctacactcaggaaggaatgcagcgtaagctggtggtagaagaaaacagctttactgaggtggcagtgttacagctttgtgtctgttcttgtgaaacagagctaccacataggcattgtgccaagagcagtagcgtaggggcagttttgcagtcatatttatccccacttttaatgacatgctaataaaggagtgggttattcaggaatagctagaaaatgggcagtaactttcaggttttgccatggcaatggtaaactgatatggcactggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacggaaccatgttattaatccatgtgtttgcaaaacaacaaccttaagttttctgttttataaatggaggttgtggtgtcccccttttgtggctgtaggaccttgtaagaaacaggtttaatcctgggcagctgtacccaactagtggcttcctgaagcctaacagtaattaagagtaataaagaatatctgataatggctccttattctggttattattgattcttgggggatcattttgttgttgttgttgttgttgttgttgttttttgagatggagtctcgctctgttgcccaggctagagtgcagtggcacaatcttggctgggctcactggaacctctgcctccagttttcaagctattttcatgcctcagcctcctgagtggctgggattacaggcatgtaccaccatgcccagctaattttgtaatattagtaaagatatggttttgctatgttggcaaggctgatttcgaactcctggcctaagtgatccgcccatctcagcctcccaaagtgttgagatgaaaacgtcacaggagctgatgaaaaaggaaaaggagacagcaatgatcccaggcctttttaaagggagaacaagctgaaagcagcaaaatacaacagttaaatctctaagacactaatctcagaagttttaaaagaaactcattatcgtatcacaggcaaaattttttgttttacttgttttttttttttttttttttttttcttttttttgagatagagtctcgctttgtcacccaggctggagtgcaatagcgtgatcttggttcactgcaacctccacctcccaggtttcagccattctcctgcctcagcctcctgagttgctagggttacaggtacatgccactgtgcctggctaatttttgtatttttagtagagacaaggttttactatgtttgccaggctggtcttgaactcctgacctcaaatgatcctcccaccttgggattacaggcatgtaatcccaaagtgctgggattacaggcatgggccaccatgctcagccttaaagctgtatttttattaagtaaagtgtagaagaaaaagtgtaaataaagtgacagaaggaaaacacaaggctgttatggaaaatgataaccttagggcagaaaacaagaaaaggcaaaccaagatttccatagggtgaggctccaatccacaatcctcggatgaatgtcaatgctaaaaaccctggagcctccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattccgcggatcncacgtangtantanatgtanatgtanangatgatanangatgatanangatgngtanangatggtangancgttanaatanatgtanatgtanatggtanatgtanatggttangtnatgattagtgaanangtaanangnnntnatanangattnatananggntnanangnangatanangatanangntnccanggncanaaanagatgaangggntnaaangntcgttggtngan

SEQ ID NO: 5 - DNA, 54840 bp, Artificial Sequence
  Description of Artificial Sequence: Synthetic polynucleotide
  RP11-344F17
ttaattaagcctgtaattttaatgcagttgaatatgtcaatcgtttattgactatgttttttataaagtttaagaaattcttctctattttgggagtcatgaagatattcttgcattccagattttcctcctgacataatttactttcttcctgaagtgcaccctttagtagtctctttagtgaaggtcagtggctagtagtcagtttgatttactagaaaatgtccttaaatttcccctgacaattattttctctccacacttccaagatatatttccactgtgttgtatattttttcatatgattctgttgtattcttgcttccattgttgccgttgaaaggtcagctgtcagttgaactcttattttgtaggaatctgtcttccttacttggctatatttagtcttcactctgtctttggcattctgcagtttgtgaaacagtgataccatgtgttgagatgtggatttttttttattactcctgcttggtattcattctatattcaatatctgaaaattccattcacttgacctcaatagcttgattctgcaatttgtcacttccattaacttccattcttgttcacttgtttcctcttatgtttagtgaattttgattggaagctcatgtctgtgggggtaactcagttctgaatgatgtattagaaactttctataccaaacaacttcactcacttttttttttttcttgagagagtctctctctgtcactcaggctggagtgcagagagaggttcaatcatggctcactgcagactccaactcctgagatcaaatgatcctcccacctcagcctcctaagtagttaggactacaggcacacactaccacacctggccaatttttgttttattttttgtagagaccaggtcttgctgtgttgcccaggctagtgttaaattcccagcctcaagaaatgttcctgccttggcctcccaaagtgctgagattacaggcattagccactgtgccctgccttcacgcccttctgtatagctcagccaaaagatatacaacttcagttctgctttccaaaatatatccctagctttctggaaccagcagttcttatcttacaactggccaatacatagacatagatatgtcaccctttcccttctgaggcttccacttgctgttgtctggctgttgtctttgaatttatggagtattcatggtctcttaaggagaaaaaagaaaagggagatgagaagccagaagagaacaggaagttgaccacaaggcagagactcctcagcaaggagcacaatcacagctttacagggccagaaaacaactccagcagcgtggctgcctcttaaagcgccagttctggaagcaaattcccccttaacaatcaatatctaagtgaattttggaagtcctaggctggtctgagactgccggagaatgagtcaaggccggcttgtcctagggagggggtggtgagggatggaagccgctgtcctctggctccccgtcaactgtgcatgtcaatcccagtgacaagggctgctgatgcttcagaaaggtaccaggcctcagctttaaggcgcttgccaagaagccatgagaagtgcattaagatgctggcacatgaacagcacccaaacaatgctggttattagtggttcaccaggtgctttacagtttataaaatacattcactcagactgcctggtttagtccacacaacaattctaactcccttggaaagaccagagaactgccatttgataccttccactgcttactgcaagctcacctgcgccaggcatggggacagcaagggaacctcagccccatcttgccagtcagtgcctgcagaggggtcccggtgcccctcttgccatcagaagcttccctggccagacacagccatatgcatgttacttacatttgcacatttaatctttgccacagtccatgagatagtctgtaccagagggaactggggcctgaggtcacacaggcagtgcgtggtgggactcaggcatggtgtaggacacttgtggttcttgccccgaaaccagatttcaaggccaagggcaaggccagatagaggctcctagaatgtgccagagggtggcctgctacagcctcagccaaggtctgcctggggcattaggggccttgatggggatatcacgcctgcagtctcagggagcccatcagcggcctcctctctctggattccagctatggcttagggatccctgtcctacctttcacaacaggccaggggcctctgagtatttgggaatctgctcaaacattgtgggaaccttcctgcaatggcttcagtgttgcagaatcaatgttctgccaaagaaagtcactcacttcttatttctacacccctctacctcctaaacagtaggagggaccagagccaagggctgcaggtggctttacacccagtagacttagtgatctcatttctgtctccagtagtctaggttggatttcttatagttgtgaaaactttgagtatttgtttttactttttcttaaagctcgtatggtggccccaaactgctttcccattttaatgcttatttttgtatctcatcagagctggagatatttttcaatggttgaggctggccctcaaagtggagaaatatttgattacagtgagccatttacagcaagtagatttcaagcacaacactggcaaaatccttttctataagaaacactgtcttatatagattttccaaaaggctgaactgaaactggaaaggatgtcttaaggaaagatggatattaacaataggtttttaaaacctattcttctctagaacatggagaagagctccttcatgtttagaaagttggttaagaactagaatataagaactggggtaacaacacccagattcagcttccaatctggaatctggaagtccaggaagaaagggctggtgccaggtttggagagggaggttgaacctggatgttaccacaccagatagagagaaaacttccaaaggctcctcaggtccagtcaaaaggactcggcaggctcctgttggccaaagatgggaccgcttgggcttcttatagctacaatggattggaatgcaccaactaaggtgaaatccacgagttcaaaatgatacttaaaacaaaaacttctttggtcactcttggaggatgcttattattttgaaactgctttaaaagaaaaagaagccggcaaaaaatgtgttgtgggggcaaagagcttctgaaatacgcacatacctgagcactaccctctgggcagcactccaagtcctgctactcctagaaccctttggggacttcaagaaagccccagggtctgcgtcctgccccagagagtctgcttgaacaggtaagggaggctgcattgttgagagttccccaggcagggtggccagggctgagaaagcctgaggccagctctctgcttctactctcacctccagtccatgcaccatgcagcgccattcctcctgggtttgaatcccagctctgcctggtgggtaggtcatttagcttgtctgtgcctctgtgtgcctgtctatcaaatagaagaggtgggggtctcactggcccctctatcatctggcccttgtgagggtttgatgagtctgtctggcacatggtgaatgttggctgtagtagccataaccatttggaatggcacagagggcaggaagagacgttccatgagaaagatacaggggagggaatgtctaagagaggcctctctaaaggatgggaaattcacttttggaaaggagagatgggagatcaatcagctgggtgggcgagataacatttagagggcacagacccttcttatgagttgatgatggctttggttaccaagaaaaatgtacctatacacacacacaacttttgcctacaaatctaaggactcacagaccccccaatgtccgtctgcaaccccaacagttgaagtccattgccacctccaggttaaataactgtcatcaacgactctattattttgacaatattgatcaaaacattaaatgcccatactcttcaactaaataatttcacttgatggaatttgtcctacaaatgatgcatgtgaggaaaataacaactataaaagttgtttattgcagcctgttgattacagaaaagctaggaaatgatctcttcatccacaggggaccagttaaatcaattgtatctacagagtgaaacactctgcaatcttcaaaaaaaaaaaaaaaaaaaaagagaaaattctatatcccaaaatggaacaagaacaatctccaataatttgtaaaggcacagaccagtgtactcagtgtgctatgatttgtgcagaaaaataagaaaatgcatgtgtgagtgtctgtgtatatgtgcatttgttgaaggtgaacagaatatttccagaatgagaccctatcagccagtcagtgccttggtctcggggaagcagaacctcttgtcttggagacagttttgaatgtaggaccatattcatgtttacattaatccaaaacaaataacaggtacatttaaaaagaaaagaaagccacgtgggcattggaggctcacagagaattctgaatgggaagagataaggaggatggcctttggggagagtggatctgctcacctgaacagagcatctggaagcccctcatgggtgggagaggggctgctgcaggggccgggatcacacgctgaggttctgagacagttgctgcctgagtaatgacgccctgggaaccgtgaaggatatgtcaaaaagatgcatggtctcaggtctgtgtggccagggctccaggccatggctgggaggtgtgggtttggggtggggcagacaagttgctgagaagcaaagaggtgtgccaggggtgggtacccggtggcaggtttttctgcatagctgggcattgcttcagcatggcaggtttcatgtactgccaaccccaaattccttttcttactgctcgtcttaattttcatgacagctttgcctctccttctcttccctggcgcttaggtgaccacaggcttcataaagcctaaaaaacttcagactgagaggaaaagaccccagtcaagatgggtgcggctgttgtcatcagcacacaggtgagccggggtctcctggtcccaccacgggccaggcagtaatgggctctgtaaaggacacacaagggcgttgcccacggcgggaacctggatgtcccaaaggctccctctgccattgtgatgtttcaggatgaaggaaacgattgtccttctcattcaggtgtgcagagtgcacgttgtttaagtccaggctctcttgtctactatatacctctctctctttttaaaaattgtggttaaacatatataacaaaatcaaccatcttaaccatttttcagtatacagttgagtggcattcgtgttcattcacactgttgtgcacccgtcaccaccatccatctccagagtgctttccatcttgcagatctgaaactctgcacccattaaacaacaactccccactcttccctccccgcagtccctggcaaccaccattctactttctgtctacactgggtacctgatatgaatggaatcatgccgtatttgtccttttgtgactgccttttctcgcttagcataatgtcctcaaagttcatctgtgttgtagcatgtgtcagaatttccttctttttcaagtgctgaataatattccattgcatatgtgtgtcacagttggtttatccactcatctgcttatacacactagcgttgcttccaccttttggctattgtgaataatgctgctatgaacacgggtgtccaattagctcttggatgcacactcccgaaaaagaaaaaacagctgggtgcagtggctcacacctgtaatcccagaactctgggaggccaaggtggggatcacttgagcccaagggttcaaaagcagcctgggcaacatggcaaaaccctgtctctaaaaaaatacaaacattacccagacatggtggcacatgcctgtagtccccactactcgggaggctgagatgggaggaccacttgagcccgggaggcagacagccttgattttgccactgcacttcagcatgggtgacagagagagaccctgtctcaaaaaaaagggaaaaaacaagacaaggtttctcctggggctgtgcttcagaccccattaggcagttgctctgcaaaatgcctcatgagtcacagctctgtcaaacagatgtgcacatgttcctaccactgtagcatcccttgggggtttggttctgttcacccaaaatgagtgggagtttggttctgaacacgcagcactaaggggacctcaaaaaggacaccttatagtacgagaactcaaaaaggaaggcagagtgtcaccttgcttgacctcagctgggaatgtgtgttcatgtctggcaactcaagtttttcgctgctctgagcatgtcaatggctgtgaaagtgccaagtgtattaatttgggggttacaaatacatcttagcaagtaggtgaacttgcaaatacagaatccaggagttatgagggtccactgtattttcagtgtcgaaattatcttccatcaagttgataaaacctcatttactcaattaggccctagtcagggtatgtgaagtgttctagctttttcctattacaaatgatgctgcagtgaataccttgctgcaaagagagttctctcattataaactgtttctgtggcgtgagttccccaactgggctctcaccagtaaggggatgtcgctgcccatgccattaggctcaccacattccctactagggacacatatttggctttgtcctggtcaacgagacagagggaaagtctacctggtgcctaagaagggggtacagggcacaatggtccctttcttgctctggccattactgtgcagtggtgaacctggagctgtgaaatggaggaggagaaagaggaaaggagcctgcatcccagatgacacgaccgagctgctgacccagatcgcaggacacgagatagtgcatttcccttctgttaaggtcagtcccagccagcgacagcccctccacagcactgctgaggagcccctggtcacccatacccctcaccctctcttcagacactccactgccccccacgactcccaggccaaactcaggacacccaccctctgccattatgccgggctccccaagcctccaccacttcccccagtcctgggactggcaaactatgagtgagactcattcacagattgtgacttcatttagtggattatcaaccagcattaagaactgaagccaactgggcataatggctcacacttgtaatcccagcactttgggaagctgaggtaggaggattgcttgaggctaggcatttgaggccagcctaggcaacaaaatgagatcctgtccctagaaaacatttcaaaaaattaacagcatggtgacgcacacttgtagccctagctacttgggaggctgagtgggaggatcctttgagcccaggagttcgaggcagcagtgaactatacttgtcagcctgggtgacagggcaagactctttgtctctaaaaacaaaacaaaacaaaaagaacttaagcagactaggatataaagtataggagcgtattgtgtacaggaacgggaaatactgtttcctggatcttttgtttcacttacgcacacacccacacccgccagtagtgtaccaggttgcgatggaaatctctctctttctgtggatgagtttgtggaagcccttgctccagcatgccctccttcctgcccacccctggaccattccttcccttcacagcactgtcccatgggtaggccacagcccagcacaggccccagcctggcggctgcagcaggagccccatcccagggcctgaggggccatgcgggggtctgggtgggagtgggaaccgctgaggaaggtgaagggaaatatggtgagatgacaggcccgctgtcagggagagtgggaggagccctggagtgccctacctctgtggggctggaactccctgtatccgagctagggtcttccacacgcatgctcctaccccaagtgccacagctggaggtcagggacccagccaggctgtgctgggtgctcctgggcagggctcacctgactgcaagtctccctgtgggtggctcagagacccagagcccacctgggtgctgcttacagcccataaggcagctcccacccgcgtgtcactggccctgcagcctcatgaagccttgtgagcagccatccttatctcctttgtgctttgaatacaggaggatgctggctctaaaaggcagaggggcatcctcagttacccagcaggggcgtggcaggcctgtctccagtaccccaagaggaccctgaaaacaagtagcattgcatgaaagttccacactctgcagttcaacctagcacacttacaaaccctgagtcactgcatcctggctcatggagggagaatttcctttttctgtggctttaaggctagcaggaaattgccagcccaggcccctaaggcctccagtgagggccgggtctcatctcccactggataacagtgttgtcgggaacttccatccagcactggcggacactcccgtcgcagctgctcctgactgagcaagtcatttaagggggtccttggcactcataagcactcacagaatggggctggcagtgcgcccggcctccctgggatgggtccagaatggtaggaagcgcagtccgggagggaccctgagttagggccaggcatccccattcctgcttcctcctccccgaggaccacgtctgcccattcctcttttattttcttttggtatatatatatatatatgtatatataatttttcacaccattataattcctctttttaaaaaaatatatatgtatgtataactttcttagtaatttctgtagttaccgaatctggaaggaaaactaagaggccaccaggcaggccgtgtgatggaaggagtgaggggagaaggagcatccatgcagagggaacagcatgtgcaaagatgagggtcagtgaggacgtggtttgtacaggtaaattcgaggagctttgagggctgacaggtaatgctggctctggggaggtgttgggagaagagaagggaagggaggagccgtgtaatgaaaagctgtgctcaccatcactaaggactctggacttaacctgacagtgggggttttaggcagtggagtggcatgatcaaagccattgctggatgcagggaggaggctgggatgaatgaggcagagtttgggctggggcatccgttatgagtctatagaaatggttcagggaggggtctcagcttattgtaaggctttctttaaagttgatggaatgttttcttcccagtttcaaggcacagcaactgtcggttgtgagagatgcttctgctaccacttctattgctcacggcaaggcaaaatgtcagtctagattcaaggaggtggagaaatagattccacttcctgatgagagaagaatgaatgcagagtttgcaactcgtctgttaaagggaatgacaaagatgcaagaagagttaaactaaagttcattcagctggcagtatccaatccagtggtgggtggcagcagtgccaggaatagcattcaggcagcagcattaatagtgacattttttgtttttcagaatgttttagggtagaaccttggccatatttccagcttaccagtttcccttgttttcacctattttctgagcctgatttttcagacttcccattcactttggagttgcatgatatccttttaataaatgccctttctgcttaatttagccagaggctgcttctgttgtttgcctctaagggtgctgactgattctttggtcaataagataatcaccaaggactgtacagtaaaataaacaagataatttactaaagaggaaatgcaggtgggtaataactcctgagaaatgtctcacctcacttacgataaaaacaaaacacatctgaattaaaacagtaacaaccagatgcttttttgtttttgcctttacaatttgcaaattcatctaatcacagctgcagagggtatggtgagacaagctttcttctactgctagtgggagagtaaactgacctaaccttttttcctgtagatttcttggctatatgtactaagatcttaaaatgagttatcctttgtcacttccaggaatttagtctaagcaaatacttagaagtatggaaagaaatttatgcacgaaggtgttcatattttagtaaaaattggaaacttgaatgaaatgaggcaattaagatgtgatataataagataataagcagaagcaaccctttcttagaaaggtttgtaaagaactgaggattggccaggcatggtggctcgcacctgtaatcccagcactttgggaggccaaggcaggcagatcacaaggtcaggagttcaagaccagcttgaccaacatggtgaaaccctgtctctactaaaaatacaaaaagtagccaggtgcggtggcaggtgcctgtaatcccagctaccgggaggctgaggcaggagaattacttgaacccgggaggtggaggttgcagtgagccgagatcatgccactgcactccagcctgggtgacagagcaagactccatctcagaagaaaaaaaaaaaagaaagagctgacaattataggaaaaccttaatggaataatattgagtggtacattgttaaataataaattaaccaaaaattatacatgtgacatttgtcgttcatgatccagtggggaaaataaactaccctggacattttaaacaaagggaatttattgtgggaaatgcttcacaggtgatgaacagcagagacccaatcatcatggaagcagcccagagatgagtcacagcaggaagccactccaccatcagggctgcagaaagtggcattgggagagggcagaggatgggcacttggtggcagctagaatcatggaggagatgcagctactgatgcaaaactgcttcctgaaggagagagatggtcaagtaccctgccttatcccttcttttcactaccctgtctcttgctggtgtctcccaccggccatatccagctggaagccaattgccaatggaaccatggacaggaaatggatctgagtagatggacaatgaccaccacacagcatgatctcgactagataaacatgatgcatgttaaatggtattacttctgctgacagggcgatatatggcttttagtttcctatgtttttctgtattttctaaagaaactgaacaatattattaaaattaaataagtggaaagtgtgtttgtggcagatacaataacgtttttaaaaagataatgtgtacgtagggaaagatgggatgttgttaaacaacagacttttatatgctgtgtctccccgtgctccctccagctttagtcagtggccctaaaagggctagtgtcctggctgcatggggccagcagggggcgatccagtctagcacaaggccttccttgaccggcggactgtggctgggatttccttgcatttcagagcaggaccctagggcaggtgtcatcctgtcagctagctcctgcccccaagaggtttgtctctgtcagcctctaactcagagctgacccttcctcccatttcaggcaggctcttaccaggactcatgagaaagccaagccaagcaccactggcactcgagggtccttccttgtccctttgggtgattggcacggttgtccactgagcccagagcctcactgtgctcattaggtgtagcctaagggcacttgcatggaggtgccagtggtcactgcttagagctctcagccctagatggcgtatcacagttaatgctctataaaacccatcatggcttttccctagtaagcctcaaatcgctgcaagcaaggcttcatatatgagagtttctgctgtctcctggagccatctcacccaaagccactgactctgggagaccagcccaggccacaaaccagcaaagcaccagttatagttagagctgcattataaagtggccagaggacatttctttgcagtgagatgtgtatcgtgaacgtttggggcctgtgctcgcctagtcctcatctttgcttttctaggtacacaaagccatcccatggctgcaaatgttagctgggctgggctccctacttgcctcaagccccttcatagacccttcaggcacatgcttttctctggacgtttacagacaggtcctcagaggtcagagcaggttgtcctagggagcagggaggcttcctagggaggtcagactccaaatagtggatatggcaaaaatgcagctgcagactcatgaggagtcgccctgggctgccactagggctcccacagtgtgcgctgccaacctgctgcccgtgcagaaactctagggtaagagctggctcctggagtcccacccaggctgcgtgtccctcacagtctgctctgtgtctatgtgtgtgtgttggggggatattattggacaattcaagggaggctcagtgaggaggaaggaaaatttcatgtaattctttctggtttgtctttctcaaccccctcctcctgcctactccttaactgagagagtgtactattatttgtgtgaccctttttttcctccaatacacatagaaggttgtataattatgcttttctgttttggaaaatgacttaaaatcatgtaaagaaaaagcttacttaggtgaaatgtagataaagagattgtgtcagcaaaatataattcttaagggtaacaagggccatggacgcaattttaattgtgaaaaataagcaggatttcatcaaagtaaactactgcaggtgagaaaagttgaactgctgtaaataagcattatcctgggctgataatgcttacaaatgttgatcctgaaaattcttcaggtacctttcagagctgagagttgtgctctctggggtgacactcaaaggaaattgggtccttttttaagcataatcttcttgggtttttagtacattcttattttttattgaaatatacaatgaaaattcatcataatacactcttactcctaaaagagattgctgtatcataggacatgtgtgcatatgaaattttatatttatgttgaaaagttttgaggagaaaagaagaatcctttctctaagtaactttatagattttgtttttaattgcacgcatacaacaagttctcattaattataaattcagttcgtgggcaaaatatattttctgtgtgcccctttctataggaaacttgctggattatttctaattctgagtctgtatctgagtaataatgacaataagtaaatgatcccaaatatatttatataagtaagagattgcattctagaacttattttttgaataattttctataattaaaatgacaaacacttttgcaatctgaatttcatagtaaggataattctaaacaaattttgaaagttttggttttagaagaagttcaagaactatttggctctgcacggagagcttacacaagttgtatctctaagccctagcttcttgctatgcctttattaacataccagttttggggttaaaaacctactttagagctaaaatattttattaaaaatttaaaaaacctactttagagataaatattttattaaaaatttatcagcctgggggatatggagtggtagagagaattacttcccatggctgctcccttgcactgtttgaatattttaccaaatgcatgcattgcctttccaaaagaaatggaaatattttcaataatcaaatcagtaaaatttctgatgcttttcagttttttatacctacttttgcctttttgaatattctcaagaatggaactagacaaatgtaagtgataaattagagagaagtgactttaacttaaacatgcatctgtgcccagacatacccttgttaatttattaatattttagacaattgtcagaatctaaagtatttccagttctcaatctagaatggctaagcttatttttatggttctacatgccacttgacaataaaagatcatttatgattctaagaagcatttgtctctcaagtggcattgtaaatcagtacaatcttttgaaaaggaatttagtaacacatttcaaaggccatgaaaattccactccctgtaagtgaatgatttcagtaaatttaaaagtcaaacattagaaggcatgccatgttgcctttcacaaaaataattctgctaccatccctggaagctgttgttagaaggtcatgttcaataagcttacaatgttttcctgattgttgtttgtgtgaccattaaaatttcaccagtattggggaatttttacctttcagatcatttagttccaactgttaggaagcaattagctcttatgttcttctggttcgtgaaagtattttactttgggtgcaggagtagggtctctggggccatggaatgatccacacaggccctggcatgggagggactggttccatctcaatctgaaaatcagacaaaggtttatttcttacttctgttatgcaatgttggcaggttgttctgactcttttccagttcctgaatattacttgttgtataataaaaatgatattctaactaaaaattttaaagaaaaaaatttgcaatcttgcagtttaatgcaaccatagtcttagcatttttgtctgtgttctcttttcaatctttgtttataaacatatatgtttctacatagagctgattgtaagaggtatagaattccacactttataaatgccttgttaatttattgttttccatgttgtcacatagacttcaggggtctcctctcaactgactgcaaattactcactgagttggtgccccattatgtcctcggtcatttcccctatcgttgagcatttacaacttttctaatgattgacttttaaatttcttgaaattattgagttaaagggagcagaattttaacaacttttgttatgtgtcactaaatcccttttcaaaagattgtactgatttacaatgccaattaaatgttttacaagtattattttccaactatgtgaggattatttttgtttatttccatatatctctatctctcctctccaaccagccaaaaaataaaaataaaaataaaaataaaagtactcaagggtgagttaggatatagacatacatatatgcttatgtgtttacatttactacgaatgtctaagcttcaaatattgaattctacagatattctctcactgagagacaagaataactgacttatccaggctgcaagtctggtgcttgttctatttgatagtctgatgctgtaagttttttgtcacaaactctgaagagtaaagtggaaactttgactttttgcttctgattgcagatttctatccaaagagggagttgagggaaatgcttcctgttgtcctaattacacagtactaagtgaacactggatatggagtcagaagggaaagtagacttgtgagcccatcacatatggagaaaacacttttggttcccattgttggcagggacagggaggcaggccatgttgcctttcacaaaaaaaaaaaaaaaaaaaaaaaattctgctaccatccctgggagctattgttagaaggtcatgttcaacaaactcgcaaagtgttttcttgattgttgtttgtgtcaccattactcaacgttgtgtagaatgtagtcaggtgatattatccccaattttataccgagacttattttaggtggattatatgactcagtcagaatcgcatcaaagcagaaccagaaccaagtttgttttcaactccagtgcttctttccgaagttttatttccattgtcagccacttaactattttaaaacgtatcttttggaatagggatctctcaataggaatccacagcaaagatgaagagaaaactagatcagttgccttggcaattttgtccactcagaccaggacattcagggatttctagattgaatttgtgtttccttctgactacattgttgaaatgatctggatcatctcctaatcttgctcttggactctctaggtgtattctcagtgtctgtgagggagggcatgtgttttaagcagtaaattcctaaaggcctgtggaggcccaaggccatgcacactgagggagttgtggatcaagtggcatgatgggcccagtctatttctggcagagctgttattttagctgttattctctttggccagttatctcccttagagtagtgcctctttaaatgctttttcatttggtgaaatctaaaaatttgtctctaaaaggcatgctgccaggcctcttttcatattaaagtggtcatctccacattgtagatagtaaatcatgttcaaagaaaagaccttaaaaattcttcatattgccttgcagaaatcacagtattttagatgtgttggggagcttcacaatcactcagtttaacccattcatgttacagacagggaaactgaggcctggtgactttcccagttattaacaaggtagtgactgagaagggacttcagttcgctgtttttaatgactgtatagtgagcatctgatgtttggtcttctacagaaagggaacagagttgactaaagtgaaaataccctagttcagacatcagaggcaaaaaaattaatcataatcacaacagcaccttacagttgtggagtcctttatagtttttagactcttagacacagagaaatagagaaatataaatatggaaaataaggtttatttgatattttatgaaatggaaccctaattcaccaacatttttacccctttatagtactgcaataatttgttgtgagactctgaaatcgtttctgaattatcagaggaagaaaatcatttaaaaaaggaaaccagagctactggctctatcttacttcggtcatggtcttttaaaatctattcaatttattttaactagactaattcattcttaaagtaagtcagctaacatggaattttctgaggttacttaaaaaattttggaaatttccttagctctgcatgaagtatttttatctcttcttcttcttttttttctaaagaaatagtgtttgtgggtcttgataactgcccacaacagattttatatcatctggttttgatagagcaagggggtctaatgaatgattgaaactaacatttataaaatctttcaaatttgagaggcaggttcttggaagaaggaggatacaacagaatggcctctgtgtcactggtaggactctgaagacaggacttactgcctatgttccgacatgaagaaacagactagtgaagtatgttgtcaaaactttgagaattgtaaagcaatgttcacatgtaggttgataaaaataacagaagaagttatgttaacctaggtccgaccctaggtgctgtcatgttgtcactaccttcataataagcttcaaagaggtgctctgttattatctttaaaaattacagacgaggaaactaaggtttagacagtgttagtaacttgctcagggccagtcactcaatgtgtggcagagctggattccaagtcagtgctgtctggctctaaagcttagattcttttcattgcacttttattattaaaccaaagaacttatgattaaaatattttctgctttccttgacgatttatttcaagatctaaccatttctttttcctggacattctgagcagggagcactagctctcaacttccctgcctctaccctctggctgggctgcaccttctcctgctgcctgttcctcctgcttcatcagcacacagtgggactatacattagccagggtgttagacaggccctccctggaccttgtcttactttcccccttgtgttatgaggacaagctctgtagtaactacattgagaatcttaggagcaaaggctccccacccccatgggggcacgtcagtgacatttggctcctccattttgcttaagaaacctgtgaccagaccctcaccccaggcccatagtgagaaaagcctgttttcatttcttctttcaccaagcccatctggatagagcaggtgcagggctaggctcttaaaatagaagcccttgtttcatgtgacgtggcacggtggaaactcccttgcttccttgcctgttgatcagattaatgaaatgatgaaggtctctcccctcatcgtggtgttttcttgacttcctgtcattgtcagttgacctttctagtttcttcatttgtaaaatacaggacttgttcttcataacctcaagggtccctcctatctttgataatctgtctccatgcttccgattaggggtcagattttggaatttaccatttctatcttgtttatttctcccagcaatattattccagcaggaatagctgggactaaaacttattcttggttaaagcacatcatctcaccatcttgacatcccatttgctctataccatcaaccatctctgaccctgaaccccagtctccttctttgtaatttaggaataataataccttattcatggtgtgaatcatatgagagagaggatttaacattgcttagcaagtgatacacattaggcattcagacaatgcttgttcacttggggtcaaataataaggtccattttctcttcatgacttctagctattgattagctttgaggctgaaaaataagtttaagatgggccctctgacctcaagaggctagcaatattttatcttctttttaacgctatctcctataggaaggaaagctagcaatattttggataagacaaaataaatacatatgaaacagagaatggattaagtctggaaaatccttccagtgctacacctaggacaaggtaccccatgcagagcaggtaaattcttaaaaggatggtctctgagtcaaattttggagagtgaagtgccagcatagctgatcatcctaagaaaaagtcaagaccgcaagttatgggttccaacagtggagaaaaggctaaggaaattatgcactgttagtaagatagaatgatgtgcaccattcaaaatggtcaatatgatgcataagtagaaaaaaagaagtgctgtgaaacaacagcaagtgaaagaatttgaacacaaaattctagtaatagtgtcaatggctatgtatgaagatactcagataaatgttagaaaagaatataatgtgggaaatgaaaataatagatgtgttagggttatgggtttttggatgaatttcaaaaacattccttttattaggctttcacttcttaagtcaaacattttgaaaaatttcacattgtatgacttggattgcataatataccagttcctgggctaaggttccatctttctctggggcaggatttcctctctggttttcatcgtgatctctgcctttgaatggcttgctttttcttttaagagaaaaaagtatgacaaatccagtaggtgatggaatcctctctcttccatttatatttctgtggatcttccttctcaaattgcctataacttcatattgaatctgaagaaagggagagtttctaggagccctgatataagggctcagggatttgtgctgccatttctttagaaaatgcctgattttcccaagaatgggtcagctctaatggaggtacctattccttcaaggaaaagcagtcaacttagcaaacaggtaattccagaggtgatttacgttttactttggcagatggagccttcattttcaatagaactccctgtgaacttcctttaaaagtgttttgacttttctggaacacatggactccatgcagtgacgtgcccggtaggcagtaatgcatacttagggctggccttccacagcttgagtaggtgggttccctttaaatgaaacaatctgaagagatgcaacacaactgtgacccttggtggtcttccagcttttaatctgattcaggccactcatttcaaccctatgcaagccaatttgacgcaaatgagtccaatctaaccagtccaaaaaatacttgggtgtttgtgccaataaatctaacgatcaaatcattcccccttgaattagaagttaacaagacaggatagctcatactgccctctagtcattcctgccaccattaagaagcctggggctctttcttaccccatgtgccaacttctcagggcctccttgtctaattttgcttgagaatgtagagtagaggaaggagaaatggacagacagcctagagaagtgacttacagtctgggttcagctctaactactaatagtgttgaggacgtcagtcagcttctcgaagtctcagtctccatatttgttaaaataaagagggtagtctggtttttctggccccttctctcctgtcctcctagactatgaattcatttttagctttttaatgcaaatttttgattcattagaatctagcttcttcactctgccacttttagttggctcttcttagagcattagtgcccaatttgcactgttagaattttcccttgtttgtacccttcaaaatttttctttttttgggcaaggattgtatttttttctttttaactggctccttgaggatagatgttgtgatatctgtgtgcttgtatgtcctcaactgtgccctgcactgttagggcccttgtcaaaacaacacatttctcagtgattctgagactctttctcttatctatagaagtcataactcaagagtaaaatcataccaatattttacataaaccctagaatttttatagatctattatttctttttagagtacatattggaagtaacttcacaaggaacattttctttacttttttttttggaaaaaagatttatgcttataaccaaatgaggttgtttggcaaatttgtctggagagacacacacactcagggcaaataggcactcctttcctgggcaactcaattacctcttgcctctggtcaaaccactccacaaataaagtggactgatcctcttgactctatgtgtaagtgcccattgtgtgtgcacagagctggtgagaacggccatggtgctaggtgggggtggtgttggtggagttggactagattatctgggatcatgcgaaatggaaattcatttctagctggctggcttcagaaggtgccatctcctatttttatatgaagcgtgctttggaactcagggcaacgaagggtgggtgtgctgcacaaggacagcagaagagtgagctgactggtccctgaaatcgcagttggaaagtggattaccagtgcagtagaactcttcacggaggcctggaccatcaggtctaatggtgttgttccaggtgggtggtcatgtggagcaaaaatatttgaaatcagcgagcacgtacctgagagatgacttttccacttgggctagtctcttgatatttctggtcctgtttcttcatctgtaaactgggttagtaatgtcacactctgtgagttggtgcatccagataacaaacaaacaaacccacacacagaaaaacaatccccataaatgccctataaacttatattaatcatcaacaattcatttatttgttcactcacttatttattcaacaaatactcgtatgaccaaagcactgtgctttgtgctaagctctacaataaatatagaattgtataaagatcaaggagtaaaaatcctagttcaggtcctcaataaatgataggtgaatcatagactgaaacgtggaagtaaagtaaggaggtcttccacgactattgtgatcttcaaatgttcttttgggtgcagagtttccccgggaaactgccagtttctataatggacaaaagactttgcttttcaggagtatatattttgataggaaataaagatagaaatacttggaacttagacaaattaaatacataaatgatggatagtatgtagggaatacagtactgtggggaatcaaagagagggtgaattctgggtgaaatcaggagggtttctcattattcacagatgatctcttacaggaggtgggaatttttaggtcagctggaaatggaaccaggctttcatgttcagatatacttgcagataaacaactcataagaattataagactaacagcttcgttagtttacatttgacaatttatttgtgcctcattattttgggatgtgtcaagaatctgataacatgggtgataatgctatttgccactgtaatatcaggtagtcctagtgaaaatgcaacttttaagaacttgtttaattgtatctaccaactcttactgcagaatgtagacttgaaagaagcacattcctttttcttacataatcattaggggttactacatttctgagcaacaaggctcaagagtttccaatggaaatgtaatttcaattagaaaaccaaattgaggttgagggtggagagagccagctgcagaaggtatctggacagcagcatgtatctgcaggcctgcgtgtgtgccagggtgggggcaaggaggggtagattgtgtcattttccacatatgtttatttagcttctcctgtttcagggactttgggttttattaatagtcaatttaggatattgtgcctccatcctcaagcattgtcaatcttaaaaggatgggtgggagtggtaggcattaagcctcagaatcttctagccctttggctggagtggttctgtctgctattgctgcaacctgaggaaatctttcaaattctgggtgggctgctctggttaatatagtggagactctaacaaaaattatgtcatccagcaatagagctctggtgcagtgagtggcagactaactgatgaacatctcaatgcacagcaattctcagcagccctcagccagggcactcctagggagggcctctggttacaatgctcttcagagcctgcccagtctgtctctgtttctctgtcttttctttcctttctcattattcccatcactattattgtttctctttctctaaggtctgtatattatcctttcccctagttctttgaaaaatttacttcagttgcacacacaatagaattaaatgataaacatcaattttctaaataaaatgctgtgtacacccacactcacacccacagagtattttctatttcttaacaacaacaagaaaaacaacaaaatgcatagtaagaattaaaaaatctggaggaatattgaaggccagggcagattatttgtttagattagtgatccttaacccagaatttcctcacatctagattattgtctggtggatgacaaaggaaaatatatattggaaacccagttgtggatccttgagaatacagtagaaagaacagtgaaaattgaaagggaaaaggtgagaaaaccttcttattcatgtccaggaacagaattgggcttgaatttggtggctgcagctctgaacggactcaaagtgagtgtctgtaaatcctgctcagcaacacgaggacaggggttgccatgtcctcctcttccttatgtaccttccctcatctgcctccctatctctagcacatggaccaggggctcataaatgtctgtaggatggaaaaatctaggaatacatgtggggtcagaagttgtaagagattgggttgaatatattctgattccccaagttgtttttgtctacttattttctttttcttctctgtgatggttctttttttcttgttatttgtatctttgcacaatgaaagacaaaaaaaaaaatagttctagtcactagaggacttcagtaaacatgctatcacttacctgcttatgaaccaagaggttgggaaggcaggtctcagttggcatgtagcccgagaagagtttgtcacatcttagagtctagaacctcctttcccacagagatacaaaacacacagttaactcactggtattttggctgggaagatagctgaatgatagcaccactttaaatcatatagtgatgactgctgctgatgatgcacatttcttttcagtatgaaatattagttttttgggaaatccaatgttcaccctaatcttgcagcattttgtaatttccatcatggcactgagcaggaggcaggatgggctgaagggaaatacactgaactgaactggatccttaggcctgtgggtgagacacagtattggcagatagtgccttcaccttgtggctcagtttcttcaggtttcaaaattgagagacttttttcacttttacatgttaagtaggtaaggatgaacggaaggattgtgatgtattgcatattggaagaaacaaaggtatcaggtcaaaattaagaagggtttatttgtggaattactgcagggagaatatccactgagctcagccattgaactcaagaacctgttagtaattaagaatatgaaaagattgtgaattgagcaccttctctgcaccatgccccgtacaaagtggattatacacaatatttcatttgctgttcacagtgatgttgacatagaggtttattgttattgctttattataaacaagtaaccccaaacaaagaggggataaaaaagtgatagattcccatgtgagagctcactaacccatggtatcccaatcagagggctagagcattggaatgacgtgtgaagacactgttgatgttaggtaattcccaggttggttaatgtttgggcaggaggggtataacttctctggcctccaatatgtgttaggcaccccttctgtgtgcttacgtagagctctgtaggcactcctctcagctccatttctccatgttgcaatttctggttatttgtttatacactactctaggagctccttgaggtagagagttctgtcttgttgactatgttatctgcaaatcttcatagagagccaggtacatggaaatgctaatacatttctatggaattagtgaaggtggacattcatacgtccaggcatatgaacaggtttttctctggagttggtgttgtttggtgtagaagggctgtcaatgagccttatgacttgaggaaggatcaacagatgggtggatagaagtacagatggttatatgcatggatggaaagggaatatggtagaagagaatgcttctgtcatgggctctaggaagtttactgaaatatattctgaaaggttgatatgtatagttcatccttattcttcccagcctctcttttctgagatgaccaaactattcaacataaatggtttcctgctgctcttaaatatttccaggacacttctgggtctcctgaagcacctgcttgctcacagcttcattctcacgtgaagtctgcataggtcctgttaccatatcagaactcttagaggacacttattctgggctgaggttttccaaggtgagaactccaggactggagatggagcagtgcatttaggtgaagtgatatcaaacaaggttggggttggtgttacttcccatcccagtgctggacacagccttggccaggtcctgttgtgaccccaggtgcacggggccttgggaacttctgaaagggtgtggagtgctccacccagccctgttggaggaggatgggagcgaaagcaacagatgtgctcaaggttctgttttcagttccccaaagggtcttctccttgaccaaagcagtgtgacggttgctatgacagttgctatcttggtccctgggactctccctcataaggtagcattactttttttaatcttctcaggcaagtaaccatgaaactctgtaataaccagtctgaggtggggctggttgggggcatgtttgggcctgagtactgggatgtgatggtggaatatgctggggtaccaagaggtacctttgattaatgagttatttttccaaattagaccaacactcctcctagttgtcttaggcttgatgactctccatttctgcagaagttcagaattcttcccttgagatgtctgcaattagttcattgttgcaaattataaaaacataacaggtagaaagaacactgaccttgaatctcaaatctgtctctaccaggtcatgtcattcagtctctgcttgggtcttctcatgtgttaaatgagagctttgatttccaagctccttttcactctgagagtcactgatgttttgcctctgaaaatggcaaccatgaagagtagttactgagaaaccagcactgtgttttagagttagggctcttgatcaggctgcctcattttgaatcctgatttgggaatttctgatgatgtgatcttggacatggtattgactttctctaagtcttagtttttttttttttttttatctgcaaaagagggtaaaacaagctaccccagaggctgctggaagattcagtgacatgttgcttgtcagtgttgagacattgtatccattacaactatcatagaataaaaacctgttacaagttggcatgggccgagctgccagcaatttcatacatctcttttatgcctattttgtttttcattttgatcatcaatattttaatggtgtgtcataaattgggggctctttcttatttgttcttggacccatggtgaaataaaagcttgtatatttttttagaaggattcatagagatgaaaggcccttactgaacattcagtctgaccttattagttttaaaggagctgactgagacctaactgttattattacaaactgatattattggaaaccaacacagaacctaccatgtgcaaaactgtgggaaaggcttggaagtctgggtttgacaacctgagtttaaatagtgattctttgtcttactagctccgtaatcccaaacacgtaatgcaatctttcttagtctgtttcttcatctatgagacagggctaatgagaaacatctcagtgtatggtatgacagcaaagggggtcatacaggtgacagtgctagcaaatgtcagtcccctcctcttctctacctcccaactcccttgaccctctcctctgtcatcccttttctggctgcgtgcagagaatcttgctagctttagggatacaaaaggttccagagttgggagacagactgttctcatacagagatcaataaccacatgatatgggtagtaagggccattcagatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcaggtgagggcatgtctgttggggtgtttatggagggttttttcagggaaagggtctgcaaatggagccaacaagaaaggaactggcaggtggtcaggatgtcctcctgtgagagtcactcttctccccatcctctctcctcttagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgtagagcccctttgtccttccagtgaccacctcatttctctccttccctcttctaattctctccttgaaagcattgtccatgcatgctctctccaatttcttcgctctcattctcttttgaacccatttggatcagacttttgcccctggcattctatagaaactgcacttgtctagttcaccagtgattcccaatatggctaaatccaatggcccatttccattcctaatcttggttgacttgtcatcagcaattgacacagttgatccattttttcctctttgtaacatttttcctcttggatcctaggataacaacactgtcctgtttttttcatctccttctctagccagtctatttcaatcttcttttctggttcctcctcatcttgctgacttctttacgttggagtgcctcctggctcagtgcttggatttcttttttggtatgtcgttgctaggtactctctcccagtctgatggctttttacaccatgtgtgtggtgatgacatcacgtttgtgtctccagcactgacctcttgcttctgaattctagactcttatagccagttgtccatctgacatctccactttgttgtctaatagacatctcagactcaacgtacccaaaacagagctcctaaagcttcaggaatcgagactgtgtctattgacataaggataataaaattgattaggggaattaaataaaatagaaatagaccaaacttacattgtcatttgatttccaacaaaagcaccaaagcaatctaatgggaaagaaaagtctttacacgaatagtgctggaattttcagcagctcatgaaatgtatatatattttatgaaaaaaagtaaaaataaaagtaaaaaatggtgctggaacagctgcacatccacatggaaaaaatgaaccttgacccttacctcatgctatacacaaaaattaattccaggtgaattaaagttgagctcccaaacctatgcctatgttctatagacttcttcatttcagttaaggcaactctatccttccaattcatcaggctgaaaaccctggattcccccttcagttttctctcttccccacatcaacactagcagtgcttcctggcagggctactttcaaagtagcttcatctcctgcttggattatgtaacaggctcccaactggggtttccacacatcttcctatcccaccctggatgggttattctcatcagatcacccagagaaatcctgtttatgtatgtcagatgatattattattatttttattatttttgagacagggtctcactctgtctctcaggctgcagtacagtagcacgatcacagcttactgcagcctccacctccctgggctccctacctcagcctcccaagtagctaggactacaggcacacaccaccacgcctggctaattgtttgtataatattttttgtagagacagggtttccccatgttgcctagtctggtctcaaactccacccacctcagcctccctaagtgctgggattactggcgtgagccaccgtctccggcctcaatattattattttgctcaaagcctaccagcctcatctcacttaaaagaaatgcttcctgtgacccacaaaacccgacatgacctgccctccctataaccctgtgtcatgagcactccgggcacatgcccacctcagggctttttatttgcagttcctgctgtgctcttacctatttatccacatggtttacttcccacttcatttaaatctttacctgaatgctaccttcttagtgacacctttcctgatgaccctgtcaaaacttataaccctcctccaacaattcctgcccttgctttaatgctctgtttaccccgtcgttatctaaaatactatattttaaaatttatcaatctttatcatttatctccccagctagactataagcttcacaaaggcagggagttttacctgtgtgatagcctcaggatcaaagacagtacctggcacatttcaggcattcaatacatacttactgaatgaaagaataaagtgtggccaggcgcggtggctcacacctgtaatcccagcactttgggagactgaggtgggtggatcatctgtggtcaggagtttgaggccagcctgacgaacatggtgaaaccctgtctccactaaaaatacaaaattaaccgggcatagtggcacatgcttgtaatcccagctactcaggaggctgaggcaggagaatcacttgaacctgggaggcagaggttgcagtgagctgagattgcaccattgcactccagcgtggacaacaagagcaaaactccatctcaaaaaaaaaaaaaaaaaagactaaattgtgattgaggtttacagatgactggtcagtgtttcccatatccccaaactgttttcctgcttgatgctattatttcatggggcaagttcaatttccttatccattgcttgactgtccaattagattggcagagcgttaatggcaaggactgtgtatcttatcttgtactgttctatatcctccactattgctgccattgtgagggggaacaagggagtggcttccctccatccagttccctacatcatatgtcatatcatacaaatatattagtatttataaatatattaggtctacctccttctctgtgcaaaatatgtcatatcaatgtctgagttctagtatgttcatattcttgggcaattatgtaattatggcttatgttgtcataacttctatgcccgtatttataagaaaaaaatattgagagcatttccaggaaaataattgactggaagaagagagagtggtaaaaaggaattaatagtgagctaactatcagtatatacaagcccagccttctaggatctggataacccgaagcaagaatttctctgtcagttttctcatctgtataatggtgagagtgggggtgttgaagtagaaaaatcctttgattaatatttattctaatccttgactaggtgctcagtgttagtccagggaactctatcttatttcttcatgggccagcttaatgtcaagatccaaaactcttgtgtaaagcttgggaccattttcaaggatacatttagtagtttacaataatctagataacactgactgatagaaatatgcaggaaatacagaaaattataatgtgatccacatatataatttagaagttttcactagccatgttataaaagtaaaaagaaatctgtgcaatcaattttaataatatttttgtttgcacacaagatatacagggtaatctcaacatgtaatcatataaaatattaatattttacacgtattttttgtacaaaatgttaaaaattggatgtgtttttacacgtatagcccatcttagtatggactggccttatctccagagctcaataactctgtgtggctagtggcaggatattggatatcaagtctagaacatacgtgaattaattcaaggttcaagcacattaaggctgaaagagttatgactgaagaacaagttcaaggaggaaatcaaacaatagccaaatttcactgagctactccttccattactaatgataacaaatatttatagatcccttagtatatactaggcctgatgcttagaactttatatgaactgtttcatttaatcctcacagcaatcttacaagtaagacctccaccccctttcagatgagaaaactgaagcacaaaagtgcagtaacttgctattatgacttgtgagcatattttcccaggcaattatatgcacagtatgatgtaggtaaagcagcccaataatttattcactatatttctccatgctcatggtaaggactgacttgatccctggtggtcacccacttgtgctccctcagtgagggaagggctgcagagcccctggcccgtgtcctagtgactcaggcttgggatctccagcagctgctatggttgacaatttagtttagtaaaatgttagatcctaccctgataactgttataaaaaatcctccttccccttccccagcacaggtacccagcccaaggggcactttctatggaaagatgaaaagaactgacatggacttgagctcactgggggtgcaggtttcaagaaagaacaaagagagctgttaggttgaagagacgcagttgaagagttaagtcttggaattgttaatacctggaacaaggcacggtgtgaaaagacaaagaaacacacaaacatcaatctgtcctcctcttttctctttctgtttcatttcttatcctccatcagtcagactttgcttcctctttctcctccttcacctcctcctccctgcccttcccaatttctttctatcttccatttattgttcttccaaaattcgtatactcatcctctcttctccctttctcttttctccaaaataatatgttcaacttactgacttgctcagggacttgtgggggcgaatgtattagcaccaaacctaggaaacatggcgaattctaaaaacttgttctcatagaaaaaagagttaaaaatagaaagctacagtccagttttgaagccacagaagacctcactctgatgtatagacattagagtcagaaaaagactttgaaaagaccagtgaagctccttgtcccacagacagtgtgagggagggacaaggggaattgtgtgcccaagcgtacttgggatggtgtaggtggctgataagagtgtcagtggaggtggtggttagcatttggagtgccccaatcttgtgacactaaacatttattgttatactaaccccactgccaactaccaggaagttttcatttttcttactgtgtcttagtctccatggcatctataaactgttttcccccaatgtccaggcatcattcctctcccacagttgatgtctggctctgtgccatgggtgtgggcctgcctcttctctctcagaatgactgctgtttcatgcttggtgagccacgcagtatgccaagctgctgtctctgacctggagaaaggatacccatcctaccacaggtggggcatatcatgggatggccttcctggttttccttggcagacacatttttctcacttttttttttctctcctcccttctctttttccctccctctttgatttcttctcttttccttttctttctcttgcctcacttctgccctagatctaccatgggacccagggagctttggagccatgcaacccacagtgtgctaagctttttactcatgctatttcttttaatcttcacaattctttacctatcaggcattaccatcagatctgcaccttacaggtgagaaagggaggcccacaccgattaagaaatgtgctcagggccacacagcctgtacatgtcagagtaagggcattctcatgccaaggttcattttcagagccaaaagcataccacgtctcaggagaagcaggctagatctcttgtctgcttggcttttaactcatgctgacctgaactttctggatttgagtaactctcagacctgtggagcccgatttctgtgagtggattttgccagccacctggggaggtgaacccttgctggggtatggctcatcagtgtagaagggagttccttcagaggtacgctgtcttctcggccatccccattgtagtagtttcttgggtctgccctaacaaagtaccacaaactaagagccgtaaaacaacagaagtttattctgtcataggtctggagacagaaatctgaattcaaggcacaggcagagttagtgtcttctgcaggttctcggggagaaaccatcccacacctctccagcttctggtggctcccagcaatccttggtgctctttggctctcagctgcatccctctggtctctgcctccttggtcatgtggctttcttcctatgtgtcactgcatctccaatctccttcttcttataaggacaccagtcattggatttagggcccactcggatccagcataaaaaaaaagtttaaaaaaattatttggaaataattatagattcacagaaagtagcaaagacaggatataaagcacagaggtctgatgtgtcctgcacccagtttctcctgttggttacttcttacgtaattacagtacgatattaaaaccaagaatttgacattgataaaataagtgtgtacagttctatgtcattttatcacatgtctagatgcctgcaactaccactgcaatcaagatacagatttatcccatgatcacaaagatctccctttatagtttcgcctactcttctttctccaccaccctaacccctggcaaccagaatctgttctctatccctataattttgtcacttcaacaatgttacataaaaggaatcacatggtatgtgaccctttcagattggcttttttcactcagtagaaagtccttcagaatcactccagttctctgtatcaacacttcgttcctttttattgcctcatagcattctatggcatggatatattacaatttgttaggctagttgcctattgagggatgggttggctctttctagctttggctacaacaaataaagctgctgtgaacaatcatgtatgggttctgtgtggacataagtttttatttcctgggggtaaattcccaaggagtacaattcctgggtcatatggtaggtgtcttttgtttagtttttcaagaaactgacaactattttctagagtagctatacccttttatattcccaccagcaatatatgaatgatccattttcaccgcatcctcacaaacatttcagtatgacctaattttgacttgattacctctgcaaagaccctatttccaaataaagtcacatttatgtgacccatttatgagtaccaagagcaaggagttgagcatacctttttgaaggacacaattccacctgcagcacctgtcttcacttgcttaggttatgggtgggtttcccttcagagtgttatcttctgagaagaaggtttgaattcatagctggattatgcctgcctttgattgttcaatttggcccccagggatgagtgagcaagttcatgtcattggaagggacattactgagtctcacccctactcaaacctccaaagtttgaaagatttgatactcatcaacattctcaagaggcagaagggcaaggtgcttccttatgtagtttctccatgactgtccttccccactttcccagtactgactggaaagaaaaacaaagcaggacaaagggattgtcagtcatttgagggaagggatgctgtgttagttactcctgaaccccttcagagtgtaggcagagagaggtacttagaaaggtgtgttggatggatgagtagctgagaggggcagggccagagtgccccatagaatgaggaagagtcctcatttacatgtgcccttcccccttcccaaacatgtgagtgttcatacatgggtttccagtgtctgggcaaggttaattctgtcctctgtccccttgctgaaggtctgtttcatttaatttctatgtatgtgtgctcctagctagccaaacagggcacagatgccaggaaaatagcaggcctgttgttttgttgagcaccttgagccctggaaggcagactcattcagggctcaagagggcaggattaggcaggtagctatttgatcccaggcccccccacttaccagctgcgtggtcttgacctattacttattcctcttctatctattaactgggtataagatgttctttatgtgaagttattttgaagcataatgtgtatacagaacagtgcacagatcataactgcacaaccccacacgaggaacagaacattaccaagaccccagaagccccttcttgtcttctcccaggcactaactcgcccacccccagctaagagtaatttccatccaaatttctaactttatttttacctggttttgaactttatatggatgaaaacatacagaacatatcttttgcattgagtttctcttatgtaacattatttttatgagattcatctgtgtgagtaggtatagttgtagcttgttaattctcctcattgggtattctaatgtataaacataccacagtttaataactcattctattgttggacaatcgggctatttccaatttttggcttttgtaaataaagctgctttgaacattcttgcatagttttttggtgggtggggacactcagtcatctagaagtgggattgctgagttatagaatatatttgtctctcagctttatagaacctttgcaacattttaatgaatgtttttaatctcacagtatagtgtggattaaattaggttgtggaaagtactcaatacggcccttggcagacaggagtccctcagtacctgtttaaaaatgtaaataaggcatgacattccattaagtctaagtaccatgatgaacttaaacatttccctattgtttgtttatttaattgcttttattgtgttgttattttatatcatgttgcaatgaatgattctctttatagcaggtttcttcttttgaaaaatttgctttggttgattctcagggaattgaatcaaaggatatatgactgtaagacctgtcacccttaaaaaggactatgagggcttgctgaggaggggaaaacaaggaagcaagtctctcctaccatggcccaggggactgtgaggacagaaggcttgtgggtttgagggaggactgtcttgcagaggatgatagggtaaaatagaatgaaggatgatttttataaatggttatgcgccttaggatgactacatatttagtcccttataagagaaattgagtagttggtaaaacaacagataataattattaaatgaggaaagagagaaaccacaggtgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccacagttcctgaggaaagaagcaaacaggatggtgtttaagtaacaaagttctgcccttgggtgtgttgtttgcggataatcacagggcatgttagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaaccatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttgcagaccaaaataatctccttaaatatcacttttgagatcagctggggtaaacgacagcaacacaatgacaaatcattaaactattttagagattatgaaattaaaatactcagattaaaattttcctatcacagaattaaggtactggaaaatatgtttaagtttttattaatcacattgctataggtttagatattttgtacaactgaaataaaatcacacactggcagctacatttttgaaagttaaaaacatggtcacgaatatatcttattttaaaatcagttaatataccttaatggtatttaatgccaaattcaaagtgaattgatcaagccctcagtggccaggtcatgggtgtgatttttactctgaaagaattacatatttctttctttttggttgagcttttgttatttaaatacatttgatgagaggatattgaaataattaaatagcactgaaaaaaaaaaaagctttaaattatttacaatcccctaatggaaattttcactaatgagatatcataatgaatgtgaattttatttctgaaatctctaataaatcagtcttctccctggttttcccagctcagcgcccattacgtttctgttctctttcccttagtggcattatttgtatcactgtgcatcaggaaagctggctacggcagcatcaatcgggcagacacagggtggccacggccactagcggcaaggcggctgccccaagagcgcggtggcatggccaccaaagccactcaatcgagaaagaccgcggctctgtctacagctcgcggtgccacggccttcttggcagaataaaaatgtagacaagtaataacagaggataatgaaagaacatactctttaaaatatttcctatttttttcacagacccacggtcattaaaaaatgcaattatttactttttttcatttaaacacatttctttgagattgagcttttgggaataaccacctttccaccattacaataagagataatttcacgtttagtctaatgtacaaattggatttttaaaaaatgagctctatctgtgaagcccttattcctatagaatgtgtctttttgagtttattacttattacagactctaaaaacaacattgctgctgattttcaagtaagctgcctcttctacatagcaaataggtacacttcacttttccctgatttttcttagggcgtgctattgatttttattgttgtctgacaaaataatttatcaaacaaaagggagaaagactaaaaaatgtatttttccacttttctgtatcatgcataatcagcaacaaccaatacaatatttggcaagagtgaacaaaaataaatttacttttgctccttagaaatacaagggttcctttttagttacactttttttttttactttgtgtcattcagtttagagcaatttaatctttttttctccaaatccatttttgaagctgagtttaacttttgcaacccatggcaaatcttaaatgccctcatttaccaatctttaccaaactcctatttaagcctctaaaagtcaatactggccatcagacccaaatttcagaagacaatagtgaaaaattacttacgtttaatctccagtcgtgtcccttggccgaaggtgatccacagtgttaacttaattactttccccttaacaaaaatctcttttcgctgttaatatcactaacctgaccgatgcagagaaaatcttgcaattgagatgcctcacttaactggctagcgcttggctgttccttaagatgaactaattttctatcccttactcatctgactttttgaaagaatctggtactctttggaattgacctgagctaatatctcaaacacaaaaacgctccaaatttaaaaccttataagaaaaagcattaggaaagtgcacttacgtttgatctccaccttggtccctccgccgaaagtgagccacagtgagggatctcaccctttcccctcaacaaaaacctctcttgaagccaatcatatgagataggctgcttgttcagagaaaaatctagctatttcttccccatttcccccatgaatcctattctcctctcaaacccaatgattcgtctatttgctcagctttttaagttcattttctggtgtcctgctatttacttctgggtcaccaggtttattcaaccaaaatatcacaaaacttgcacaaatgatacaatggcactaaaatctcacgaataattgagacagatgtacttacgtttgatatccactttggtcccagggccgaaagtgaatcacagtgattcgtcttaacttttccctttacaaaaacctccctgaaagctcagcaagcctctttcccccaatgaagttattttgatttagaaatcttaaaaattagccacaagctagcgtcctgtggaacaatttcccctcctctgtacctaacctgggaatgaagtttgttagatccctggcatccgactaatgaaaatccacacaaaggaacacaaagtaaactaattagcaacagtgaagaatcagtggaaaaaagtacttacgtttgatctccagcttggtcccctggccaaaactgcacacacaatggttcctcttaacttccctcctatacaaaaactccctttctgacaattgaccaaggctctgtccagaacatgttatgttccccaggacatttctgaagctattacttagacaagttattctcacccaatgactgaatcttgcttgctcttcaaagaaaatgtgcaatcaattctcgagtttgactacagacttatctttatcttttccctgaaggatatcagaggctgattgcagagtcaccttatagatcacttcatagacacagggaacagaagacacagacaactgaggaagcaaagtttaaattctactcacgtttgatttccaccttggtcccttggccgaacgtccaccacagtgagagctctccattgtcttgctgaacaaaaacccttctcaccaaaggggaacagagtcctgggtcagctgctgaagctcaactcccttttcgagcaggtgtggaaaccctgaggcttctctgacatagcatgtgtttattttcttaggtgagacctaaaatccaagaagagaatatatttacgtctatggcctgatggttcctttctttagcaacttgccacatctggactgcttattatttatttattttttagaaagtagactgaatgttaattacaaagaaaaacaagcaattaaaaaaaatggccagtttttttgtactttcttttggggtgggctgggggggcttttgcaaaggataaacttcatttagtgtaattatggaaatcatcagcttctcaatgagtaataattacaggttgtcttactattttatcttctcctttgctgcaatgttatttaaaaaaaggtagactaaatatatatcaacttaaggctcataactttgaaatgcattttgaaatgtagctccagatggtatacgaaaccaaagtgaagactaatagagtagaaaagtagactttacttggttggtttgtctgttttcacagcacaggaagagctcagctcttactgagctggaccaggcgcatgccatctttggagctgccatggagtcccagtgttccatagtgtttccatagtaatctcatcaacaacactgaagaccttttcagtattttcttttgagtccagctccatttttgcagccttgtatctctcttaaccttccatctccaccccttccatacattactcccacctccctacactccttagagtttttctatggcctccagctttcacaagcactccctctgcttgggaacatctttgtccacctgggttagcttgtgaactgctaattgtctttcaaaattcaactgaagagagaccttctctcagattagccctgagcaggtgacctgaatttacagagtacagagacaggtcactgggcctagagtacctaattattttttattttatttatttattttttttgagacggagtctcgctctgtcgcccaggctggagtgcagtggtgcgatcttggctcactgcaagctccgcctcccgggttcacaccattctcctgcctcagcctcccgactagctgggactaaaggcgcccgccaccacgcctcgctaattttttgtatttttagtagagacggggtttcaccgtgttagccaggatggtctcgatctcctgacctcgtgatccgcccacctcggcctcccaaagtgctgggattacaggcgtgagccaccgcgcccagccgagtgcctgtttatttttacctgctttcagattctcttctacccttctaaattataagctgtttgatgttttatttgccctgtatttgggaggctccgtccagtatctttacttagcaaatgcttaacaaacattttcagaataaataaaaaaaaatacctaattgaaagtcaataatagatcagagatgctatcatagaccaaagactaatactgactgccacaacagtaacttttacaacagaaatcataactacaattctaaagattaggggtaggtttatttgattctgtcactggcagctttgctagttgccttgaatagcagaattagcatttggtctcaccagaagatgaggaaggagagggatcaagttagaggtggagagttaacattggcaagtgaaatttaatgtgcaaaatagctgaccaagggcatagtccttttttaaaggggacacaaagtgattttctctgcagacatacacgcaataccaatcataaagggtgacatttattgagcacttactaagtgccagacattgtacatggatcatcacatttaattattcccaagactctatgaactaggaactaatattatcccctactttgtaggtgcaaaaacttgagggcagagaggtcaaggaactggcttatggcagtaagtggcagagctgtgacctaaactcagatcccatgtttttaactgaactatatgcagattatactccaggagtaaagtcactcaacggaagcaacaagcgtgacagggaatgctgggatgggggaaggtaaaaggaactccttagactgggataagtgtgtacagacgtatgtataagactacacatggaaatattgtttaaagagtgaaaaataactaaaatcctcattaataggagtttggttaaactgtgctagagctttacaatgtagcacaaagcagacattaaggggaagacgtagacttctatatagttacgtggaaggtgtttgtgaaaatgcaggtcactgaagagtatgtgtggtgagatatcatgatcccatctacattgaatatatatgtatataaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaaactttgaagaacaccacagagatttaaaccatgtcattgaattcatagagaaactggaatttagaaacattttttccattgcaaaaacaggaggcgtccttgaagcagccagttctagttttccccacagagccccagaaaagccgtacttcagagctatcgggctgggaatggtgataggtggacagtggagagtggaataacacctgggtcatctctctgctggttacagacagcttggccctcatgcttcaggccgtgggaatagagattgaaagaaaaagggggcaagttaataggcattcaatagtaatgggatttaaaaaaccctcccaaaccactagaaggaaaagaaatagacaaaaataataaaccaatccagcaaagtttaggaaaagtgaataaaaaattgaggtaagcacgatacataaaagtacaaattaagtttgaaggaccaagtcaaaatatacagtcacaaactattgtgaatgttaaattatttaaaactttaaataatttatctaaaaataaaaataaaccaaaaagatgactatgtatgttttcaaggatatttgattcactagagaaacagttcatttgcttcctatttatgatgattaaaaactagattgcaaaagttagatgttaatgtaaagaaaactttatgaaaatgataatggatttttatctagtagaaaagataaccccaatgcttatggttttattgctctgtaggacattaacaagttgtgcatcttatttagcaaacttattctaacattagtagatgtgagtgtgtgtgtgtgcgtgtgtgtgtgtgtacgtatacatataggtgtgtgcaggtatgtgtatatgtatgtatgtaggtatatatgtatatactagcaaatgataaagttggttcaaaggacgatgtacagtagtacctccttatccacaattttgctttctggggtttcagttacctgtaggcaactgtagtctgaaaatattaaaaagaaatttctagaaataagaatttactcattttaaattgtgtgccttagtagcgtgatgacatatcatgcccttccgctccataccagcctgggactgaatcatccctttgtccagcgtctccatgctgtctacacttaccctcctgtttagatgcttagtagccctcttggtcatcagattgactgtcatgatatcctagtgtttgtgctcaagtaactcttattttactgaattgttctattttattactagttattgttgttaacctcttactgtgactaattaatgcattttatcataggtaagtgtgtataggaaaaaacatagcatatgtagggttgtgcaatagcatccactggggggagaattttgctgaagttagaacagagaagactgtccagaagaaagaattttctatacttgccaccttttttctgtttggtgtcctcatgtaagtctcagtgttacgatctgtctccccacctcaatcactgccctctgtctctggaaggaaattccccttgggctgaggccagcatggtgccagacaggagagatccagtacccactctggaaaatttcataagataactggttctccaccttcttcagggaccttttatcatatctcatgtgcccatggcatttgtcactgccatctgcacaacactgaactccagcaacatcaactgagaagaaagagagagagagggagaaagagaaagagagagagagaaaagtcgtttgttgattgagccacacaaaattttttttctaattaaattatatatccaggtagctgcaatatgctacaatcccaaatacacatatttattaaatatgattcaaagagcattcattgagtactctgtatcaaggcacaatgtaaaataagtgcaaaattactggtgattgttacgcctttctgtgggactcgactctctctggttggaggtactgtgtgggagcacgtgagctccaatcaggtggtctggagggagcaaaatgcagctgttggaggttaaatatgaagggaaatagcagtaggcatcggatagcatagaatgaaaataaaagtgcatatacttccagtgcctgttttacagattccttgtctttttttttttttttgaagacggagtctccctctgtcgcccaggctggagtgcaatgctgtgatcttggctcactgcaacctccgccttctgggttcaagcgattctcctgcctcagcctgctgagtagctgagattacaggtgcgcaccatcacgcccggctaatttttgtatttttagtagaggcggtgtttcactatgttggtaaggctggtctcgagctcctgacctcgtgatccacctgcctcagcctcccaaagtgctgggattacaggcatgagccagtgcgcctggcctccttgttttttaaaactagttcaaaccctcaactcataatttgggaaattcaggtcataggatgccctgttatttataaggtatccagcaatgcatggaacagaatatttaacttttaaaaaacttatattaggttgttgcaaaagtaattgctgtcattttctcctttctttttctttttctttctttctttctttctttttctttctttctctttcttcttttctttctttttctttctttctctttctttcctttctttcttttctttctctttcttttctttcctttttctttcttgtctttctctttctttctctttctttttctttctttctctttctttcctttctttcttttctttctttctctttctttcctctttcttttctttcccctttctttctttctttctttcttgtctttctttctttcttctttctttctttttttctttccttcttctttccttcctttcctttccttccttcctccctctctccctcccttccttccttttccttccttccttcccttccattcccttcccttccccttccttccttccctccctccctcccttccttccttctctctctctttctttctttcttcctttctttctttctctttcctttcttctttcgttgttgtgttccagaacgatttagtgttacctacagttcccagagaaagaatcctgtcttgaggggtggctggggcagggctactactctccctgctctgtgctctagtggccaggtggatcagctccagctgccaggtcaaatttcctagggaatggaattctgtctttttaacaagaacaaaataggtgcttagtaaatataagatgccttcagcttttagtatatgcataatcataaatataaatttgtttaaaacctgaactattctgatgttctcactggctagccaaacttaaaatgtgtatttggacttgaatttcccaccaagggtgttactagcttctttactgttgcagctgccttttgttttgtttttgaaagtttaaaaaaatacacaagggggcttttgcttcctgaaagatggagtagaattacttttacctatttctctcaagtaaagtaaaaaccccggacattgtacgtaaagcaaacttatgaagactctggaagctggagagaagaaggcagaccagttaggaacattgggacccaaggagcgacccagcagtgcattccacggggtttctttttgcctcatccattccagacttggttctggagaagtttgtcaacccagaaacaccaacaggcccagaaaaacataaagccctaataaaaagctggctctctctagtcaaaggagaaagaaaggggaagcccagtaaaacaattcttaggcagtaacggctctgctccattcaaacacccaacttctccttcctgagtggcaagagaggaaattcgctgagatgagtttaaatgagatccaaagcctcataacacaatactccaaagtccagatttcaaatgaaaaccacacatcccaacaggaaccaggggaaccaggaaaatctcagctttgatgagacagttaagaggcgctaatactgacatgacagagacgttagaattacctgacaagaatgttaaagctgccatcgtaagaacacatcaaactcaacaccaccatcaatgagtaagatcataaatcaacatttctggaaaactccaaccagcaccagcagaattcgcattcttttcaagtgctcatggaacatataccaaaattgccatatactgggccatgtaacaaacctcaacaaatttaatagaactgaaatcacatgaagtgtgttctctgaccacctggaatcaaactggaaatcgataatagaaaaataatgggaaaaatgccaaacccttggaaacaaaacaacacacttctaaacaatccatgggagatttcaaggaaaataaaagattatatattgaatagaataaaactgaagatgtaacatattataatatcaaggatacagtaaaagcccaaagaaatgaaaacttatcccagaaaaatgaaaacttagcacaaaaacgtatacaatacacaactattcatagtggttttatttgtattaaaaaaaaactggaatcagtcaaaatgtcctacaatagattaatggtaaaacaaactgcggtacatccatcccatggaataattagtaataaaaagtagtgagttgggcacggtggttcatacctacaatccatacctacatacctacagcactttgtgaagtagaggtgggagaatcgcttgacctaggagtttgagaccagcgtaggcaacatagtgagaccatgtctctaaaaaaaatttaaaaaaattagctgtgtgttgtgtcccatgcctgtagtcctagctacttgggaggctgaggcaggaggaagcttgagcccaggagttcgaggctgctagagagagttatgatctcgccactgcactccaccctgtgtgacagagtgagactctgtctctaaaaaaaattaaaaaaaaaatagtgagctgttgatacacatgacttgaatggatctgaggggcattatgctgagtataaaggtcacatattgcatgattccatttacataacgtttttgtcttttcaaaaatattgcaaggggtacttggttgcagggtgtgcgcatttttcaatttacaaattggcctcaaattcgtgtattaagtttcattcccacatttgcaatgataagtcctccatggagtttcctcactctacatcctctccaatacttgatattatcaggctttttaatttttttccactcaaatggtcaatacgttgtattttatttttggtttaaaatacatatttgtgttttctgatcactcatgaggttgaccatttaaaaatgtttattggctattggggtctcatctgttgtgaattgcctgtttttaaggtatgcccacttttttattgagtttcttatttttttcactattgcataggagttttcaatctttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttgggtttgggtaaaacttaaccatatgtttaacaggacctggactttgatttaagcaaacttagggtaaaaacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggt

SEQ ID NO: 6 - DNA, 299890 bp, Artificial Sequence
  Description of Artificial Sequence: Synthetic polynucleotide
  D9-E24-F17 (Fig. 1b after integration)
ttaattaagcctgtaattttaatgcagttgaatatgtcaatcgtttattgactatgttttttataaagtttaagaaattcttctctattttgggagtcatgaagatattcttgcattccagattttcctcctgacataatttactttcttcctgaagtgcaccctttagtagtctctttagtgaaggtcagtggctagtagtcagtttgatttactagaaaatgtccttaaatttcccctgacaattattttctctccacacttccaagatatatttccactgtgttgtatattttttcatatgattctgttgtattcttgcttccattgttgccgttgaaaggtcagctgtcagttgaactcttattttgtaggaatctgtcttccttacttggctatatttagtcttcactctgtctttggcattctgcagtttgtgaaacagtgataccatgtgttgagatgtggatttttttttattactcctgcttggtattcattctatattcaatatctgaaaattccattcacttgacctcaatagcttgattctgcaatttgtcacttccattaacttccattcttgttcacttgtttcctcttatgtttagtgaattttgattggaagctcatgtctgtgggggtaactcagttctgaatgatgtattagaaactttctataccaaacaacttcactcacttttttttttttcttgagagagtctctctctgtcactcaggctggagtgcagagagaggttcaatcatggctcactgcagactccaactcctgagatcaaatgatcctcccacctcagcctcctaagtagttaggactacaggcacacactaccacacctggccaatttttgttttattttttgtagagaccaggtcttgctgtgttgcccaggctagtgttaaattcccagcctcaagaaatgttcctgccttggcctcccaaagtgctgagattacaggcattagccactgtgccctgccttcacgcccttctgtatagctcagccaaaagatatacaacttcagttctgctttccaaaatatatccctagctttctggaaccagcagttcttatcttacaactggccaatacatagacatagatatgtcaccctttcccttctgaggcttccacttgctgttgtctggctgttgtctttgaatttatggagtattcatggtctcttaaggagaaaaaagaaaagggagatgagaagccagaagagaacaggaagttgaccacaaggcagagactcctcagcaaggagcacaatcacagctttacagggccagaaaacaactccagcagcgtggctgcctcttaaagcgccagttctggaagcaaattcccccttaacaatcaatatctaagtgaattttggaagtcctaggctggtctgagactgccggagaatgagtcaaggccggcttgtcctagggagggggtggtgagggatggaagccgctgtcctctggctccccgtcaactgtgcatgtcaatcccagtgacaagggctgctgatgcttcagaaaggtaccaggcctcagctttaaggcgcttgccaagaagccatgagaagtgcattaagatgctggcacatgaacagcacccaaacaatgctggttattagtggttcaccaggtgctttacagtttataaaatacattcactcagactgcctggtttagtccacacaacaattctaactcccttggaaagaccagagaactgccatttgataccttccactgcttactgcaagctcacctgcgccaggcatggggacagcaagggaacctcagccccatcttgccagtcagtgcctgcagaggggtcccggtgcccctcttgccatcagaagcttccctggccagacacagccatatgcatgttacttacatttgcacatttaatctttgccacagtccatgagatagtctgtaccagagggaactggggcctgaggtcacacaggcagtgcgtggtgggactcaggcatggtgtaggacacttgtggttcttgccccgaaaccagatttcaaggccaagggcaaggccagatagaggctcctagaatgtgccagagggtggcctgctacagcctcagccaaggtctgcctggggcattaggggccttgatggggatatcacgcctgcagtctcagggagcccatcagcggcctcctctctctggattccagctatggcttagggatccctgtcctacctttcacaacaggccaggggcctctgagtatttgggaatctgctcaaacattgtgggaaccttcctgcaatggcttcagtgttgcagaatcaatgttctgccaaagaaagtcactcacttcttatttctacacccctctacctcctaaacagtaggagggaccagagccaagggctgcaggtggctttacacccagtagacttagtgatctcatttctgtctccagtagtctaggttggatttcttatagttgtgaaaactttgagtatttgtttttactttttcttaaagctcgtatggtggccccaaactgctttcccattttaatgcttatttttgtatctcatcagagctggagatatttttcaatggttgaggctggccctcaaagtggagaaatatttgattacagtgagccatttacagcaagtagatttcaagcacaacactggcaaaatccttttctataagaaacactgtcttatatagattttccaaaaggctgaactgaaactggaaaggatgtcttaaggaaagatggatattaacaataggtttttaaaacctattcttctctagaacatggagaagagctccttcatgtttagaaagttggttaagaactagaatataagaactggggtaacaacacccagattcagcttccaatctggaatctggaagtccaggaagaaagggctggtgccaggtttggagagggaggttgaacctggatgttaccacaccagatagagagaaaacttccaaaggctcctcaggtccagtcaaaaggactcggcaggctcctgttggccaaagatgggaccgcttgggcttcttatagctacaatggattggaatgcaccaactaaggtgaaatccacgagttcaaaatgatacttaaaacaaaaacttctttggtcactcttggaggatgcttattattttgaaactgctttaaaagaaaaagaagccggcaaaaaatgtgttgtgggggcaaagagcttctgaaatacgcacatacctgagcactaccctctgggcagcactccaagtcctgctactcctagaaccctttggggacttcaagaaagccccagggtctgcgtcctgccccagagagtctgcttgaacaggtaagggaggctgcattgttgagagttccccaggcagggtggccagggctgagaaagcctgaggccagctctctgcttctactctcacctccagtccatgcaccatgcagcgccattcctcctgggtttgaatcccagctctgcctggtgggtaggtcatttagcttgtctgtgcctctgtgtgcctgtctatcaaatagaagaggtgggggtctcactggcccctctatcatctggcccttgtgagggtttgatgagtctgtctggcacatggtgaatgttggctgtagtagccataaccatttggaatggcacagagggcaggaagagacgttccatgagaaagatacaggggagggaatgtctaagagaggcctctctaaaggatgggaaattcacttttggaaaggagagatgggagatcaatcagctgggtgggcgagataacatttagagggcacagacccttcttatgagttgatgatggctttggttaccaagaaaaatgtacctatacacacacacaacttttgcctacaaatctaaggactcacagaccccccaatgtccgtctgcaaccccaacagttgaagtccattgccacctccaggttaaataactgtcatcaacgactctattattttgacaatattgatcaaaacattaaatgcccatactcttcaactaaataatttcacttgatggaatttgtcctacaaatgatgcatgtgaggaaaataacaactataaaagttgtttattgcagcctgttgattacagaaaagctaggaaatgatctcttcatccacaggggaccagttaaatcaattgtatctacagagtgaaacactctgcaatcttcaaaaaaaaaaaaaaaaaaaaagagaaaattctatatcccaaaatggaacaagaacaatctccaataatttgtaaaggcacagaccagtgtactcagtgtgctatgatttgtgcagaaaaataagaaaatgcatgtgtgagtgtctgtgtatatgtgcatttgttgaaggtgaacagaatatttccagaatgagaccctatcagccagtcagtgccttggtctcggggaagcagaacctcttgtcttggagacagttttgaatgtaggaccatattcatgtttacattaatccaaaacaaataacaggtacatttaaaaagaaaagaaagccacgtgggcattggaggctcacagagaattctgaatgggaagagataaggaggatggcctttggggagagtggatctgctcacctgaacagagcatctggaagcccctcatgggtgggagaggggctgctgcaggggccgggatcacacgctgaggttctgagacagttgctgcctgagtaatgacgccctgggaaccgtgaaggatatgtcaaaaagatgcatggtctcaggtctgtgtggccagggctccaggccatggctgggaggtgtgggtttggggtggggcagacaagttgctgagaagcaaagaggtgtgccaggggtgggtacccggtggcaggtttttctgcatagctgggcattgcttcagcatggcaggtttcatgtactgccaaccccaaattccttttcttactgctcgtcttaattttcatgacagctttgcctctccttctcttccctggcgcttaggtgaccacaggcttcataaagcctaaaaaacttcagactgagaggaaaagaccccagtcaagatgggtgcggctgttgtcatcagcacacaggtgagccggggtctcctggtcccaccacgggccaggcagtaatgggctctgtaaaggacacacaagggcgttgcccacggcgggaacctggatgtcccaaaggctccctctgccattgtgatgtttcaggatgaaggaaacgattgtccttctcattcaggtgtgcagagtgcacgttgtttaagtccaggctctcttgtctactatatacctctctctctttttaaaaattgtggttaaacatatataacaaaatcaaccatcttaaccatttttcagtatacagttgagtggcattcgtgttcattcacactgttgtgcacccgtcaccaccatccatctccagagtgctttccatcttgcagatctgaaactctgcacccattaaacaacaactccccactcttccctccccgcagtccctggcaaccaccattctactttctgtctacactgggtacctgatatgaatggaatcatgccgtatttgtccttttgtgactgccttttctcgcttagcataatgtcctcaaagttcatctgtgttgtagcatgtgtcagaatttccttctttttcaagtgctgaataatattccattgcatatgtgtgtcacagttggtttatccactcatctgcttatacacactagcgttgcttccaccttttggctattgtgaataatgctgctatgaacacgggtgtccaattagctcttggatgcacactcccgaaaaagaaaaaacagctgggtgcagtggctcacacctgtaatcccagaactctgggaggccaaggtggggatcacttgagcccaagggttcaaaagcagcctgggcaacatggcaaaaccctgtctctaaaaaaatacaaacattacccagacatggtggcacatgcctgtagtccccactactcgggaggctgagatgggaggaccacttgagcccgggaggcagacagccttgattttgccactgcacttcagcatgggtgacagagagagaccctgtctcaaaaaaaagggaaaaaacaagacaaggtttctcctggggctgtgcttcagaccccattaggcagttgctctgcaaaatgcctcatgagtcacagctctgtcaaacagatgtgcacatgttcctaccactgtagcatcccttgggggtttggttctgttcacccaaaatgagtgggagtttggttctgaacacgcagcactaaggggacctcaaaaaggacaccttatagtacgagaactcaaaaaggaaggcagagtgtcaccttgcttgacctcagctgggaatgtgtgttcatgtctggcaactcaagtttttcgctgctctgagcatgtcaatggctgtgaaagtgccaagtgtattaatttgggggttacaaatacatcttagcaagtaggtgaacttgcaaatacagaatccaggagttatgagggtccactgtattttcagtgtcgaaattatcttccatcaagttgataaaacctcatttactcaattaggccctagtcagggtatgtgaagtgttctagctttttcctattacaaatgatgctgcagtgaataccttgctgcaaagagagttctctcattataaactgtttctgtggcgtgagttccccaactgggctctcaccagtaaggggatgtcgctgcccatgccattaggctcaccacattccctactagggacacatatttggctttgtcctggtcaacgagacagagggaaagtctacctggtgcctaagaagggggtacagggcacaatggtccctttcttgctctggccattactgtgcagtggtgaacctggagctgtgaaatggaggaggagaaagaggaaaggagcctgcatcccagatgacacgaccgagctgctgacccagatcgcaggacacgagatagtgcatttcccttctgttaaggtcagtcccagccagcgacagcccctccacagcactgctgaggagcccctggtcacccatacccctcaccctctcttcagacactccactgccccccacgactcccaggccaaactcaggacacccaccctctgccattatgccgggctccccaagcctccaccacttcccccagtcctgggactggcaaactatgagtgagactcattcacagattgtgacttcatttagtggattatcaaccagcattaagaactgaagccaactgggcataatggctcacacttgtaatcccagcactttgggaagctgaggtaggaggattgcttgaggctaggcatttgaggccagcctaggcaacaaaatgagatcctgtccctagaaaacatttcaaaaaattaacagcatggtgacgcacacttgtagccctagctacttgggaggctgagtgggaggatcctttgagcccaggagttcgaggcagcagtgaactatacttgtcagcctgggtgacagggcaagactctttgtctctaaaaacaaaacaaaacaaaaagaacttaagcagactaggatataaagtataggagcgtattgtgtacaggaacgggaaatactgtttcctggatcttttgtttcacttacgcacacacccacacccgccagtagtgtaccaggttgcgatggaaatctctctctttctgtggatgagtttgtggaagcccttgctccagcatgccctccttcctgcccacccctggaccattccttcccttcacagcactgtcccatgggtaggccacagcccagcacaggccccagcctggcggctgcagcaggagccccatcccagggcctgaggggccatgcgggggtctgggtgggagtgggaaccgctgaggaaggtgaagggaaatatggtgagatgacaggcccgctgtcagggagagtgggaggagccctggagtgccctacctctgtggggctggaactccctgtatccgagctagggtcttccacacgcatgctcctaccccaagtgccacagctggaggtcagggacccagccaggctgtgctgggtgctcctgggcagggctcacctgactgcaagtctccctgtgggtggctcagagacccagagcccacctgggtgctgcttacagcccataaggcagctcccacccgcgtgtcactggccctgcagcctcatgaagccttgtgagcagccatccttatctcctttgtgctttgaatacaggaggatgctggctctaaaaggcagaggggcatcctcagttacccagcaggggcgtggcaggcctgtctccagtaccccaagaggaccctgaaaacaagtagcattgcatgaaagttccacactctgcagttcaacctagcacacttacaaaccctgagtcactgcatcctggctcatggagggagaatttcctttttctgtggctttaaggctagcaggaaattgccagcccaggcccctaaggcctccagtgagggccgggtctcatctcccactggataacagtgttgtcgggaacttccatccagcactggcggacactcccgtcgcagctgctcctgactgagcaagtcatttaagggggtccttggcactcataagcactcacagaatggggctggcagtgcgcccggcctccctgggatgggtccagaatggtaggaagcgcagtccgggagggaccctgagttagggccaggcatccccattcctgcttcctcctccccgaggaccacgtctgcccattcctcttttattttcttttggtatatatatatatatatgtatatataatttttcacaccattataattcctctttttaaaaaaatatatatgtatgtataactttcttagtaatttctgtagttaccgaatctggaaggaaaactaagaggccaccaggcaggccgtgtgatggaaggagtgaggggagaaggagcatccatgcagagggaacagcatgtgcaaagatgagggtcagtgaggacgtggtttgtacaggtaaattcgaggagctttgagggctgacaggtaatgctggctctggggaggtgttgggagaagagaagggaagggaggagccgtgtaatgaaaagctgtgctcaccatcactaaggactctggacttaacctgacagtgggggttttaggcagtggagtggcatgatcaaagccattgctggatgcagggaggaggctgggatgaatgaggcagagtttgggctggggcatccgttatgagtctatagaaatggttcagggaggggtctcagcttattgtaaggctttctttaaagttgatggaatgttttcttcccagtttcaaggcacagcaactgtcggttgtgagagatgcttctgctaccacttctattgctcacggcaaggcaaaatgtcagtctagattcaaggaggtggagaaatagattccacttcctgatgagagaagaatgaatgcagagtttgcaactcgtctgttaaagggaatgacaaagatgcaagaagagttaaactaaagttcattcagctggcagtatccaatccagtggtgggtggcagcagtgccaggaatagcattcaggcagcagcattaatagtgacattttttgtttttcagaatgttttagggtagaaccttggccatatttccagcttaccagtttcccttgttttcacctattttctgagcctgatttttcagacttcccattcactttggagttgcatgatatccttttaataaatgccctttctgcttaatttagccagaggctgcttctgttgtttgcctctaagggtgctgactgattctttggtcaataagataatcaccaaggactgtacagtaaaataaacaagataatttactaaagaggaaatgcaggtgggtaataactcctgagaaatgtctcacctcacttacgataaaaacaaaacacatctgaattaaaacagtaacaaccagatgcttttttgtttttgcctttacaatttgcaaattcatctaatcacagctgcagagggtatggtgagacaagctttcttctactgctagtgggagagtaaactgacctaaccttttttcctgtagatttcttggctatatgtactaagatcttaaaatgagttatcctttgtcacttccaggaatttagtctaagcaaatacttagaagtatggaaagaaatttatgcacgaaggtgttcatattttagtaaaaattggaaacttgaatgaaatgaggcaattaagatgtgatataataagataataagcagaagcaaccctttcttagaaaggtttgtaaagaactgaggattggccaggcatggtggctcgcacctgtaatcccagcactttgggaggccaaggcaggcagatcacaaggtcaggagttcaagaccagcttgaccaacatggtgaaaccctgtctctactaaaaatacaaaaagtagccaggtgcggtggcaggtgcctgtaatcccagctaccgggaggctgaggcaggagaattacttgaacccgggaggtggaggttgcagtgagccgagatcatgccactgcactccagcctgggtgacagagcaagactccatctcagaagaaaaaaaaaaaagaaagagctgacaattataggaaaaccttaatggaataatattgagtggtacattgttaaataataaattaaccaaaaattatacatgtgacatttgtcgttcatgatccagtggggaaaataaactaccctggacattttaaacaaagggaatttattgtgggaaatgcttcacaggtgatgaacagcagagacccaatcatcatggaagcagcccagagatgagtcacagcaggaagccactccaccatcagggctgcagaaagtggcattgggagagggcagaggatgggcacttggtggcagctagaatcatggaggagatgcagctactgatgcaaaactgcttcctgaaggagagagatggtcaagtaccctgccttatcccttcttttcactaccctgtctcttgctggtgtctcccaccggccatatccagctggaagccaattgccaatggaaccatggacaggaaatggatctgagtagatggacaatgaccaccacacagcatgatctcgactagataaacatgatgcatgttaaatggtattacttctgctgacagggcgatatatggcttttagtttcctatgtttttctgtattttctaaagaaactgaacaatattattaaaattaaataagtggaaagtgtgtttgtggcagatacaataacgtttttaaaaagataatgtgtacgtagggaaagatgggatgttgttaaacaacagacttttatatgctgtgtctccccgtgctccctccagctttagtcagtggccctaaaagggctagtgtcctggctgcatggggccagcagggggcgatccagtctagcacaaggccttccttgaccggcggactgtggctgggatttccttgcatttcagagcaggaccctagggcaggtgtcatcctgtcagctagctcctgcccccaagaggtttgtctctgtcagcctctaactcagagctgacccttcctcccatttcaggcaggctcttaccaggactcatgagaaagccaagccaagcaccactggcactcgagggtccttccttgtccctttgggtgattggcacggttgtccactgagcccagagcctcactgtgctcattaggtgtagcctaagggcacttgcatggaggtgccagtggtcactgcttagagctctcagccctagatggcgtatcacagttaatgctctataaaacccatcatggcttttccctagtaagcctcaaatcgctgcaagcaaggcttcatatatgagagtttctgctgtctcctggagccatctcacccaaagccactgactctgggagaccagcccaggccacaaaccagcaaagcaccagttatagttagagctgcattataaagtggccagaggacatttctttgcagtgagatgtgtatcgtgaacgtttggggcctgtgctcgcctagtcctcatctttgcttttctaggtacacaaagccatcccatggctgcaaatgttagctgggctgggctccctacttgcctcaagccccttcatagacccttcaggcacatgcttttctctggacgtttacagacaggtcctcagaggtcagagcaggttgtcctagggagcagggaggcttcctagggaggtcagactccaaatagtggatatggcaaaaatgcagctgcagactcatgaggagtcgccctgggctgccactagggctcccacagtgtgcgctgccaacctgctgcccgtgcagaaactctagggtaagagctggctcctggagtcccacccaggctgcgtgtccctcacagtctgctctgtgtctatgtgtgtgtgttggggggatattattggacaattcaagggaggctcagtgaggaggaaggaaaatttcatgtaattctttctggtttgtctttctcaaccccctcctcctgcctactccttaactgagagagtgtactattatttgtgtgaccctttttttcctccaatacacatagaaggttgtataattatgcttttctgttttggaaaatgacttaaaatcatgtaaagaaaaagcttacttaggtgaaatgtagataaagagattgtgtcagcaaaatataattcttaagggtaacaagggccatggacgcaattttaattgtgaaaaataagcaggatttcatcaaagtaaactactgcaggtgagaaaagttgaactgctgtaaataagcattatcctgggctgataatgcttacaaatgttgatcctgaaaattcttcaggtacctttcagagctgagagttgtgctctctggggtgacactcaaaggaaattgggtccttttttaagcataatcttcttgggtttttagtacattcttattttttattgaaatatacaatgaaaattcatcataatacactcttactcctaaaagagattgctgtatcataggacatgtgtgcatatgaaattttatatttatgttgaaaagttttgaggagaaaagaagaatcctttctctaagtaactttatagattttgtttttaattgcacgcatacaacaagttctcattaattataaattcagttcgtgggcaaaatatattttctgtgtgcccctttctataggaaacttgctggattatttctaattctgagtctgtatctgagtaataatgacaataagtaaatgatcccaaatatatttatataagtaagagattgcattctagaacttattttttgaataattttctataattaaaatgacaaacacttttgcaatctgaatttcatagtaaggataattctaaacaaattttgaaagttttggttttagaagaagttcaagaactatttggctctgcacggagagcttacacaagttgtatctctaagccctagcttcttgctatgcctttattaacataccagttttggggttaaaaacctactttagagctaaaatattttattaaaaatttaaaaaacctactttagagataaatattttattaaaaatttatcagcctgggggatatggagtggtagagagaattacttcccatggctgctcccttgcactgtttgaatattttaccaaatgcatgcattgcctttccaaaagaaatggaaatattttcaataatcaaatcagtaaaatttctgatgcttttcagttttttatacctacttttgcctttttgaatattctcaagaatggaactagacaaatgtaagtgataaattagagagaagtgactttaacttaaacatgcatctgtgcccagacatacccttgttaatttattaatattttagacaattgtcagaatctaaagtatttccagttctcaatctagaatggctaagcttatttttatggttctacatgccacttgacaataaaagatcatttatgattctaagaagcatttgtctctcaagtggcattgtaaatcagtacaatcttttgaaaaggaatttagtaacacatttcaaaggccatgaaaattccactccctgtaagtgaatgatttcagtaaatttaaaagtcaaacattagaaggcatgccatgttgcctttcacaaaaataattctgctaccatccctggaagctgttgttagaaggtcatgttcaataagcttacaatgttttcctgattgttgtttgtgtgaccattaaaatttcaccagtattggggaatttttacctttcagatcatttagttccaactgttaggaagcaattagctcttatgttcttctggttcgtgaaagtattttactttgggtgcaggagtagggtctctggggccatggaatgatccacacaggccctggcatgggagggactggttccatctcaatctgaaaatcagacaaaggtttatttcttacttctgttatgcaatgttggcaggttgttctgactcttttccagttcctgaatattacttgttgtataataaaaatgatattctaactaaaaattttaaagaaaaaaatttgcaatcttgcagtttaatgcaaccatagtcttagcatttttgtctgtgttctcttttcaatctttgtttataaacatatatgtttctacatagagctgattgtaagaggtatagaattccacactttataaatgccttgttaatttattgttttccatgttgtcacatagacttcaggggtctcctctcaactgactgcaaattactcactgagttggtgccccattatgtcctcggtcatttcccctatcgttgagcatttacaacttttctaatgattgacttttaaatttcttgaaattattgagttaaagggagcagaattttaacaacttttgttatgtgtcactaaatcccttttcaaaagattgtactgatttacaatgccaattaaatgttttacaagtattattttccaactatgtgaggattatttttgtttatttccatatatctctatctctcctctccaaccagccaaaaaataaaaataaaaataaaaataaaagtactcaagggtgagttaggatatagacatacatatatgcttatgtgtttacatttaggtgacactatagaaggatccgcggaattctacagatattctctcactgagagacaagaataactgacttatccaggctgcaagtctggtgcttgttctatttgatagtctgatgctgtaagttttttgtcacaaactctgaagagtaaagtggaaactttgactttttgcttctgattgcagatttctatccaaagagggagttgagggaaatgcttcctgttgtcctaattacacagtactaagtgaacactggatatggagtcagaagggaaagtagacttgtgagcccatcacatatggagaaaacacttttggttcccattgttggcagggacagggaggcaggccatgttgcctttcacaaaaaaaaaaaaaaaaaaaaaaaattctgctaccatccctgggagctattgttagaaggtcatgttcaacaaactcgcaaagtgttttcttgattgttgtttgtgtcaccattactcaacgttgtgtagaatgtagtcaggtgatattatccccaattttataccgagacttattttaggtggattatatgactcagtcagaatcgcatcaaagcagaaccagaaccaagtttgttttcaactccagtgcttctttccgaagttttatttccattgtcagccacttaactattttaaaacgtatcttttggaatagggatctctcaataggaatccacagcaaagatgaagagaaaactagatcagttgccttggcaattttgtccactcagaccaggacattcagggatttctagattgaatttgtgtttccttctgactacattgttgaaatgatctggatcatctcctaatcttgctcttggactctctaggtgtattctcagtgtctgtgagggagggcatgtgttttaagcagtaaattcctaaaggcctgtggaggcccaaggccatgcacactgagggagttgtggatcaagtggcatgatgggcccagtctatttctggcagagctgttattttagctgttattctctttggccagttatctcccttagagtagtgcctctttaaatgctttttcatttggtgaaatctaaaaatttgtctctaaaaggcatgctgccaggcctcttttcatattaaagtggtcatctccacattgtagatagtaaatcatgttcaaagaaaagaccttaaaaattcttcatattgccttgcagaaatcacagtattttagatgtgttggggagcttcacaatcactcagtttaacccattcatgttacagacagggaaactgaggcctggtgactttcccagttattaacaaggtagtgactgagaagggacttcagttcgctgtttttaatgactgtatagtgagcatctgatgtttggtcttctacagaaagggaacagagttgactaaagtgaaaataccctagttcagacatcagaggcaaaaaaattaatcataatcacaacagcaccttacagttgtggagtcctttatagtttttagactcttagacacagagaaatagagaaatataaatatggaaaataaggtttatttgatattttatgaaatggaaccctaattcaccaacatttttacccctttatagtactgcaataatttgttgtgagactctgaaatcgtttctgaattatcagaggaagaaaatcatttaaaaaaggaaaccagagctactggctctatcttacttcggtcatggtcttttaaaatctattcaatttattttaactagactaattcattcttaaagtaagtcagctaacatggaattttctgaggttacttaaaaaattttggaaatttccttagctctgcatgaagtatttttatctcttcttcttcttttttttctaaagaaatagtgtttgtgggtcttgataactgcccacaacagattttatatcatctggttttgatagagcaagggggtctaatgaatgattgaaactaacatttataaaatctttcaaatttgagaggcaggttcttggaagaaggaggatacaacagaatggcctctgtgtcactggtaggactctgaagacaggacttactgcctatgttccgacatgaagaaacagactagtgaagtatgttgtcaaaactttgagaattgtaaagcaatgttcacatgtaggttgataaaaataacagaagaagttatgttaacctaggtccgaccctaggtgctgtcatgttgtcactaccttcataataagcttcaaagaggtgctctgttattatctttaaaaattacagacgaggaaactaaggtttagacagtgttagtaacttgctcagggccagtcactcaatgtgtggcagagctggattccaagtcagtgctgtctggctctaaagcttagattcttttcattgcacttttattattaaaccaaagaacttatgattaaaatattttctgctttccttgacgatttatttcaagatctaaccatttctttttcctggacattctgagcagggagcactagctctcaacttccctgcctctaccctctggctgggctgcaccttctcctgctgcctgttcctcctgcttcatcagcacacagtgggactatacattagccagggtgttagacaggccctccctggaccttgtcttactttcccccttgtgttatgaggacaagctctgtagtaactacattgagaatcttaggagcaaaggctccccacccccatgggggcacgtcagtgacatttggctcctccattttgcttaagaaacctgtgaccagaccctcaccccaggcccatagtgagaaaagcctgttttcatttcttctttcaccaagcccatctggatagagcaggtgcagggctaggctcttaaaatagaagcccttgtttcatgtgacgtggcacggtggaaactcccttgcttccttgcctgttgatcagattaatgaaatgatgaaggtctctcccctcatcgtggtgttttcttgacttcctgtcattgtcagttgacctttctagtttcttcatttgtaaaatacaggacttgttcttcataacctcaagggtccctcctatctttgataatctgtctccatgcttccgattaggggtcagattttggaatttaccatttctatcttgtttatttctcccagcaatattattccagcaggaatagctgggactaaaacttattcttggttaaagcacatcatctcaccatcttgacatcccatttgctctataccatcaaccatctctgaccctgaaccccagtctccttctttgtaatttaggaataataataccttattcatggtgtgaatcatatgagagagaggatttaacattgcttagcaagtgatacacattaggcattcagacaatgcttgttcacttggggtcaaataataaggtccattttctcttcatgacttctagctattgattagctttgaggctgaaaaataagtttaagatgggccctctgacctcaagaggctagcaatattttatcttctttttaacgctatctcctataggaaggaaagctagcaatattttggataagacaaaataaatacatatgaaacagagaatggattaagtctggaaaatccttccagtgctacacctaggacaaggtaccccatgcagagcaggtaaattcttaaaaggatggtctctgagtcaaattttggagagtgaagtgccagcatagctgatcatcctaagaaaaagtcaagaccgcaagttatgggttccaacagtggagaaaaggctaaggaaattatgcactgttagtaagatagaatgatgtgcaccattcaaaatggtcaatatgatgcataagtagaaaaaaagaagtgctgtgaaacaacagcaagtgaaagaatttgaacacaaaattctagtaatagtgtcaatggctatgtatgaagatactcagataaatgttagaaaagaatataatgtgggaaatgaaaataatagatgtgttagggttatgggtttttggatgaatttcaaaaacattccttttattaggctttcacttcttaagtcaaacattttgaaaaatttcacattgtatgacttggattgcataatataccagttcctgggctaaggttccatctttctctggggcaggatttcctctctggttttcatcgtgatctctgcctttgaatggcttgctttttcttttaagagaaaaaagtatgacaaatccagtaggtgatggaatcctctctcttccatttatatttctgtggatcttccttctcaaattgcctataacttcatattgaatctgaagaaagggagagtttctaggagccctgatataagggctcagggatttgtgctgccatttctttagaaaatgcctgattttcccaagaatgggtcagctctaatggaggtacctattccttcaaggaaaagcagtcaacttagcaaacaggtaattccagaggtgatttacgttttactttggcagatggagccttcattttcaatagaactccctgtgaacttcctttaaaagtgttttgacttttctggaacacatggactccatgcagtgacgtgcccggtaggcagtaatgcatacttagggctggccttccacagcttgagtaggtgggttccctttaaatgaaacaatctgaagagatgcaacacaactgtgacccttggtggtcttccagcttttaatctgattcaggccactcatttcaaccctatgcaagccaatttgacgcaaatgagtccaatctaaccagtccaaaaaatacttgggtgtttgtgccaataaatctaacgatcaaatcattcccccttgaattagaagttaacaagacaggatagctcatactgccctctagtcattcctgccaccattaagaagcctggggctctttcttaccccatgtgccaacttctcagggcctccttgtctaattttgcttgagaatgtagagtagaggaaggagaaatggacagacagcctagagaagtgacttacagtctgggttcagctctaactactaatagtgttgaggacgtcagtcagcttctcgaagtctcagtctccatatttgttaaaataaagagggtagtctggtttttctggccccttctctcctgtcctcctagactatgaattcatttttagctttttaatgcaaatttttgattcattagaatctagcttcttcactctgccacttttagttggctcttcttagagcattagtgcccaatttgcactgttagaattttcccttgtttgtacccttcaaaatttttctttttttgggcaaggattgtatttttttctttttaactggctccttgaggatagatgttgtgatatctgtgtgcttgtatgtcctcaactgtgccctgcactgttagggcccttgtcaaaacaacacatttctcagtgattctgagactctttctcttatctatagaagtcataactcaagagtaaaatcataccaatattttacataaaccctagaatttttatagatctattatttctttttagagtacatattggaagtaacttcacaaggaacattttctttacttttttttttggaaaaaagatttatgcttataaccaaatgaggttgtttggcaaatttgtctggagagacacacacactcagggcaaataggcactcctttcctgggcaactcaattacctcttgcctctggtcaaaccactccacaaataaagtggactgatcctcttgactctatgtgtaagtgcccattgtgtgtgcacagagctggtgagaacggccatggtgctaggtgggggtggtgttggtggagttggactagattatctgggatcatgcgaaatggaaattcatttctagctggctggcttcagaaggtgccatctcctatttttatatgaagcgtgctttggaactcagggcaacgaagggtgggtgtgctgcacaaggacagcagaagagtgagctgactggtccctgaaatcgcagttggaaagtggattaccagtgcagtagaactcttcacggaggcctggaccatcaggtctaatggtgttgttccaggtgggtggtcatgtggagcaaaaatatttgaaatcagcgagcacgtacctgagagatgacttttccacttgggctagtctcttgatatttctggtcctgtttcttcatctgtaaactgggttagtaatgtcacactctgtgagttggtgcatccagataacaaacaaacaaacccacacacagaaaaacaatccccataaatgccctataaacttatattaatcatcaacaattcatttatttgttcactcacttatttattcaacaaatactcgtatgaccaaagcactgtgctttgtgctaagctctacaataaatatagaattgtataaagatcaaggagtaaaaatcctagttcaggtcctcaataaatgataggtgaatcatagactgaaacgtggaagtaaagtaaggaggtcttccacgactattgtgatcttcaaatgttcttttgggtgcagagtttccccgggaaactgccagtttctataatggacaaaagactttgcttttcaggagtatatattttgataggaaataaagatagaaatacttggaacttagacaaattaaatacataaatgatggatagtatgtagggaatacagtactgtggggaatcaaagagagggtgaattctgggtgaaatcaggagggtttctcattattcacagatgatctcttacaggaggtgggaatttttaggtcagctggaaatggaaccaggctttcatgttcagatatacttgcagataaacaactcataagaattataagactaacagcttcgttagtttacatttgacaatttatttgtgcctcattattttgggatgtgtcaagaatctgataacatgggtgataatgctatttgccactgtaatatcaggtagtcctagtgaaaatgcaacttttaagaacttgtttaattgtatctaccaactcttactgcagaatgtagacttgaaagaagcacattcctttttcttacataatcattaggggttactacatttctgagcaacaaggctcaagagtttccaatggaaatgtaatttcaattagaaaaccaaattgaggttgagggtggagagagccagctgcagaaggtatctggacagcagcatgtatctgcaggcctgcgtgtgtgccagggtgggggcaaggaggggtagattgtgtcattttccacatatgtttatttagcttctcctgtttcagggactttgggttttattaatagtcaatttaggatattgtgcctccatcctcaagcattgtcaatcttaaaaggatgggtgggagtggtaggcattaagcctcagaatcttctagccctttggctggagtggttctgtctgctattgctgcaacctgaggaaatctttcaaattctgggtgggctgctctggttaatatagtggagactctaacaaaaattatgtcatccagcaatagagctctggtgcagtgagtggcagactaactgatgaacatctcaatgcacagcaattctcagcagccctcagccagggcactcctagggagggcctctggttacaatgctcttcagagcctgcccagtctgtctctgtttctctgtcttttctttcctttctcattattcccatcactattattgtttctctttctctaaggtctgtatattatcctttcccctagttctttgaaaaatttacttcagttgcacacacaatagaattaaatgataaacatcaattttctaaataaaatgctgtgtacacccacactcacacccacagagtattttctatttcttaacaacaacaagaaaaacaacaaaatgcatagtaagaattaaaaaatctggaggaatattgaaggccagggcagattatttgtttagattagtgatccttaacccagaatttcctcacatctagattattgtctggtggatgacaaaggaaaatatatattggaaacccagttgtggatccttgagaatacagtagaaagaacagtgaaaattgaaagggaaaaggtgagaaaaccttcttattcatgtccaggaacagaattgggcttgaatttggtggctgcagctctgaacggactcaaagtgagtgtctgtaaatcctgctcagcaacacgaggacaggggttgccatgtcctcctcttccttatgtaccttccctcatctgcctccctatctctagcacatggaccaggggctcataaatgtctgtaggatggaaaaatctaggaatacatgtggggtcagaagttgtaagagattgggttgaatatattctgattccccaagttgtttttgtctacttattttctttttcttctctgtgatggttctttttttcttgttatttgtatctttgcacaatgaaagacaaaaaaaaaaatagttctagtcactagaggacttcagtaaacatgctatcacttacctgcttatgaaccaagaggttgggaaggcaggtctcagttggcatgtagcccgagaagagtttgtcacatcttagagtctagaacctcctttcccacagagatacaaaacacacagttaactcactggtattttggctgggaagatagctgaatgatagcaccactttaaatcatatagtgatgactgctgctgatgatgcacatttcttttcagtatgaaatattagttttttgggaaatccaatgttcaccctaatcttgcagcattttgtaatttccatcatggcactgagcaggaggcaggatgggctgaagggaaatacactgaactgaactggatccttaggcctgtgggtgagacacagtattggcagatagtgccttcaccttgtggctcagtttcttcaggtttcaaaattgagagacttttttcacttttacatgttaagtaggtaaggatgaacggaaggattgtgatgtattgcatattggaagaaacaaaggtatcaggtcaaaattaagaagggtttatttgtggaattactgcagggagaatatccactgagctcagccattgaactcaagaacctgttagtaattaagaatatgaaaagattgtgaattgagcaccttctctgcaccatgccccgtacaaagtggattatacacaatatttcatttgctgttcacagtgatgttgacatagaggtttattgttattgctttattataaacaagtaaccccaaacaaagaggggataaaaaagtgatagattcccatgtgagagctcactaacccatggtatcccaatcagagggctagagcattggaatgacgtgtgaagacactgttgatgttaggtaattcccaggttggttaatgtttgggcaggaggggtataacttctctggcctccaatatgtgttaggcaccccttctgtgtgcttacgtagagctctgtaggcactcctctcagctccatttctccatgttgcaatttctggttatttgtttatacactactctaggagctccttgaggtagagagttctgtcttgttgactatgttatctgcaaatcttcatagagagccaggtacatggaaatgctaatacatttctatggaattagtgaaggtggacattcatacgtccaggcatatgaacaggtttttctctggagttggtgttgtttggtgtagaagggctgtcaatgagccttatgacttgaggaaggatcaacagatgggtggatagaagtacagatggttatatgcatggatggaaagggaatatggtagaagagaatgcttctgtcatgggctctaggaagtttactgaaatatattctgaaaggttgatatgtatagttcatccttattcttcccagcctctcttttctgagatgaccaaactattcaacataaatggtttcctgctgctcttaaatatttccaggacacttctgggtctcctgaagcacctgcttgctcacagcttcattctcacgtgaagtctgcataggtcctgttaccatatcagaactcttagaggacacttattctgggctgaggttttccaaggtgagaactccaggactggagatggagcagtgcatttaggtgaagtgatatcaaacaaggttggggttggtgttacttcccatcccagtgctggacacagccttggccaggtcctgttgtgaccccaggtgcacggggccttgggaacttctgaaagggtgtggagtgctccacccagccctgttggaggaggatgggagcgaaagcaacagatgtgctcaaggttctgttttcagttccccaaagggtcttctccttgaccaaagcagtgtgacggttgctatgacagttgctatcttggtccctgggactctccctcataaggtagcattactttttttaatcttctcaggcaagtaaccatgaaactctgtaataaccagtctgaggtggggctggttgggggcatgtttgggcctgagtactgggatgtgatggtggaatatgctggggtaccaagaggtacctttgattaatgagttatttttccaaattagaccaacactcctcctagttgtcttaggcttgatgactctccatttctgcagaagttcagaattcttcccttgagatgtctgcaattagttcattgttgcaaattataaaaacataacaggtagaaagaacactgaccttgaatctcaaatctgtctctaccaggtcatgtcattcagtctctgcttgggtcttctcatgtgttaaatgagagctttgatttccaagctccttttcactctgagagtcactgatgttttgcctctgaaaatggcaaccatgaagagtagttactgagaaaccagcactgtgttttagagttagggctcttgatcaggctgcctcattttgaatcctgatttgggaatttctgatgatgtgatcttggacatggtattgactttctctaagtcttagtttttttttttttttttatctgcaaaagagggtaaaacaagctaccccagaggctgctggaagattcagtgacatgttgcttgtcagtgttgagacattgtatccattacaactatcatagaataaaaacctgttacaagttggcatgggccgagctgccagcaatttcatacatctcttttatgcctattttgtttttcattttgatcatcaatattttaatggtgtgtcataaattgggggctctttcttatttgttcttggacccatggtgaaataaaagcttgtatatttttttagaaggattcatagagatgaaaggcccttactgaacattcagtctgaccttattagttttaaaggagctgactgagacctaactgttattattacaaactgatattattggaaaccaacacagaacctaccatgtgcaaaactgtgggaaaggcttggaagtctgggtttgacaacctgagtttaaatagtgattctttgtcttactagctccgtaatcccaaacacgtaatgcaatctttcttagtctgtttcttcatctatgagacagggctaatgagaaacatctcagtgtatggtatgacagcaaagggggtcatacaggtgacagtgctagcaaatgtcagtcccctcctcttctctacctcccaactcccttgaccctctcctctgtcatcccttttctggctgcgtgcagagaatcttgctagctttagggatacaaaaggttccagagttgggagacagactgttctcatacagagatcaataaccacatgatatgggtagtaagggccattcagatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcaggtgagggcatgtctgttggggtgtttatggagggttttttcagggaaagggtctgcaaatggagccaacaagaaaggaactggcaggtggtcaggatgtcctcctgtgagagtcactcttctccccatcctctctcctcttagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgtagagcccctttgtccttccagtgaccacctcatttctctccttccctcttctaattctctccttgaaagcattgtccatgcatgctctctccaatttcttcgctctcattctcttttgaacccatttggatcagacttttgcccctggcattctatagaaactgcacttgtctagttcaccagtgattcccaatatggctaaatccaatggcccatttccattcctaatcttggttgacttgtcatcagcaattgacacagttgatccattttttcctctttgtaacatttttcctcttggatcctaggataacaacactgtcctgtttttttcatctccttctctagccagtctatttcaatcttcttttctggttcctcctcatcttgctgacttctttacgttggagtgcctcctggctcagtgcttggatttcttttttggtatgtcgttgctaggtactctctcccagtctgatggctttttacaccatgtgtgtggtgatgacatcacgtttgtgtctccagcactgacctcttgcttctgaattctagactcttatagccagttgtccatctgacatctccactttgttgtctaatagacatctcagactcaacgtacccaaaacagagctcctaaagcttcaggaatcgagactgtgtctattgacataaggataataaaattgattaggggaattaaataaaatagaaatagaccaaacttacattgtcatttgatttccaacaaaagcaccaaagcaatctaatgggaaagaaaagtctttacacgaatagtgctggaattttcagcagctcatgaaatgtatatatattttatgaaaaaaagtaaaaataaaagtaaaaaatggtgctggaacagctgcacatccacatggaaaaaatgaaccttgacccttacctcatgctatacacaaaaattaattccaggtgaattaaagttgagctcccaaacctatgcctatgttctatagacttcttcatttcagttaaggcaactctatccttccaattcatcaggctgaaaaccctggattcccccttcagttttctctcttccccacatcaacactagcagtgcttcctggcagggctactttcaaagtagcttcatctcctgcttggattatgtaacaggctcccaactggggtttccacacatcttcctatcccaccctggatgggttattctcatcagatcacccagagaaatcctgtttatgtatgtcagatgatattattattatttttattatttttgagacagggtctcactctgtctctcaggctgcagtacagtagcacgatcacagcttactgcagcctccacctccctgggctccctacctcagcctcccaagtagctaggactacaggcacacaccaccacgcctggctaattgtttgtataatattttttgtagagacagggtttccccatgttgcctagtctggtctcaaactccacccacctcagcctccctaagtgctgggattactggcgtgagccaccgtctccggcctcaatattattattttgctcaaagcctaccagcctcatctcacttaaaagaaatgcttcctgtgacccacaaaacccgacatgacctgccctccctataaccctgtgtcatgagcactccgggcacatgcccacctcagggctttttatttgcagttcctgctgtgctcttacctatttatccacatggtttacttcccacttcatttaaatctttacctgaatgctaccttcttagtgacacctttcctgatgaccctgtcaaaacttataaccctcctccaacaattcctgcccttgctttaatgctctgtttaccccgtcgttatctaaaatactatattttaaaatttatcaatctttatcatttatctccccagctagactataagcttcacaaaggcagggagttttacctgtgtgatagcctcaggatcaaagacagtacctggcacatttcaggcattcaatacatacttactgaatgaaagaataaagtgtggccaggcgcggtggctcacacctgtaatcccagcactttgggagactgaggtgggtggatcatctgtggtcaggagtttgaggccagcctgacgaacatggtgaaaccctgtctccactaaaaatacaaaattaaccgggcatagtggcacatgcttgtaatcccagctactcaggaggctgaggcaggagaatcacttgaacctgggaggcagaggttgcagtgagctgagattgcaccattgcactccagcgtggacaacaagagcaaaactccatctcaaaaaaaaaaaaaaaaaagactaaattgtgattgaggtttacagatgactggtcagtgtttcccatatccccaaactgttttcctgcttgatgctattatttcatggggcaagttcaatttccttatccattgcttgactgtccaattagattggcagagcgttaatggcaaggactgtgtatcttatcttgtactgttctatatcctccactattgctgccattgtgagggggaacaagggagtggcttccctccatccagttccctacatcatatgtcatatcatacaaatatattagtatttataaatatattaggtctacctccttctctgtgcaaaatatgtcatatcaatgtctgagttctagtatgttcatattcttgggcaattatgtaattatggcttatgttgtcataacttctatgcccgtatttataagaaaaaaatattgagagcatttccaggaaaataattgactggaagaagagagagtggtaaaaaggaattaatagtgagctaactatcagtatatacaagcccagccttctaggatctggataacccgaagcaagaatttctctgtcagttttctcatctgtataatggtgagagtgggggtgttgaagtagaaaaatcctttgattaatatttattctaatccttgactaggtgctcagtgttagtccagggaactctatcttatttcttcatgggccagcttaatgtcaagatccaaaactcttgtgtaaagcttgggaccattttcaaggatacatttagtagtttacaataatctagataacactgactgatagaaatatgcaggaaatacagaaaattataatgtgatccacatatataatttagaagttttcactagccatgttataaaagtaaaaagaaatctgtgcaatcaattttaataatatttttgtttgcacacaagatatacagggtaatctcaacatgtaatcatataaaatattaatattttacacgtattttttgtacaaaatgttaaaaattggatgtgtttttacacgtatagcccatcttagtatggactggccttatctccagagctcaataactctgtgtggctagtggcaggatattggatatcaagtctagaacatacgtgaattaattcaaggttcaagcacattaaggctgaaagagttatgactgaagaacaagttcaaggaggaaatcaaacaatagccaaatttcactgagctactccttccattactaatgataacaaatatttatagatcccttagtatatactaggcctgatgcttagaactttatatgaactgtttcatttaatcctcacagcaatcttacaagtaagacctccaccccctttcagatgagaaaactgaagcacaaaagtgcagtaacttgctattatgacttgtgagcatattttcccaggcaattatatgcacagtatgatgtaggtaaagcagcccaataatttattcactatatttctccatgctcatggtaaggactgacttgatccctggtggtcacccacttgtgctccctcagtgagggaagggctgcagagcccctggcccgtgtcctagtgactcaggcttgggatctccagcagctgctatggttgacaatttagtttagtaaaatgttagatcctaccctgataactgttataaaaaatcctccttccccttccccagcacaggtacccagcccaaggggcactttctatggaaagatgaaaagaactgacatggacttgagctcactgggggtgcaggtttcaagaaagaacaaagagagctgttaggttgaagagacgcagttgaagagttaagtcttggaattgttaatacctggaacaaggcacggtgtgaaaagacaaagaaacacacaaacatcaatctgtcctcctcttttctctttctgtttcatttcttatcctccatcagtcagactttgcttcctctttctcctccttcacctcctcctccctgcccttcccaatttctttctatcttccatttattgttcttccaaaattcgtatactcatcctctcttctccctttctcttttctccaaaataatatgttcaacttactgacttgctcagggacttgtgggggcgaatgtattagcaccaaacctaggaaacatggcgaattctaaaaacttgttctcatagaaaaaagagttaaaaatagaaagctacagtccagttttgaagccacagaagacctcactctgatgtatagacattagagtcagaaaaagactttgaaaagaccagtgaagctccttgtcccacagacagtgtgagggagggacaaggggaattgtgtgcccaagcgtacttgggatggtgtaggtggctgataagagtgtcagtggaggtggtggttagcatttggagtgccccaatcttgtgacactaaacatttattgttatactaaccccactgccaactaccaggaagttttcatttttcttactgtgtcttagtctccatggcatctataaactgttttcccccaatgtccaggcatcattcctctcccacagttgatgtctggctctgtgccatgggtgtgggcctgcctcttctctctcagaatgactgctgtttcatgcttggtgagccacgcagtatgccaagctgctgtctctgacctggagaaaggatacccatcctaccacaggtggggcatatcatgggatggccttcctggttttccttggcagacacatttttctcacttttttttttctctcctcccttctctttttccctccctctttgatttcttctcttttccttttctttctcttgcctcacttctgccctagatctaccatgggacccagggagctttggagccatgcaacccacagtgtgctaagctttttactcatgctatttcttttaatcttcacaattctttacctatcaggcattaccatcagatctgcaccttacaggtgagaaagggaggcccacaccgattaagaaatgtgctcagggccacacagcctgtacatgtcagagtaagggcattctcatgccaaggttcattttcagagccaaaagcataccacgtctcaggagaagcaggctagatctcttgtctgcttggcttttaactcatgctgacctgaactttctggatttgagtaactctcagacctgtggagcccgatttctgtgagtggattttgccagccacctggggaggtgaacccttgctggggtatggctcatcagtgtagaagggagttccttcagaggtacgctgtcttctcggccatccccattgtagtagtttcttgggtctgccctaacaaagtaccacaaactaagagccgtaaaacaacagaagtttattctgtcataggtctggagacagaaatctgaattcaaggcacaggcagagttagtgtcttctgcaggttctcggggagaaaccatcccacacctctccagcttctggtggctcccagcaatccttggtgctctttggctctcagctgcatccctctggtctctgcctccttggtcatgtggctttcttcctatgtgtcactgcatctccaatctccttcttcttataaggacaccagtcattggatttagggcccactcggatccagcataaaaaaaaagtttaaaaaaattatttggaaataattatagattcacagaaagtagcaaagacaggatataaagcacagaggtctgatgtgtcctgcacccagtttctcctgttggttacttcttacgtaattacagtacgatattaaaaccaagaatttgacattgataaaataagtgtgtacagttctatgtcattttatcacatgtctagatgcctgcaactaccactgcaatcaagatacagatttatcccatgatcacaaagatctccctttatagtttcgcctactcttctttctccaccaccctaacccctggcaaccagaatctgttctctatccctataattttgtcacttcaacaatgttacataaaaggaatcacatggtatgtgaccctttcagattggcttttttcactcagtagaaagtccttcagaatcactccagttctctgtatcaacacttcgttcctttttattgcctcatagcattctatggcatggatatattacaatttgttaggctagttgcctattgagggatgggttggctctttctagctttggctacaacaaataaagctgctgtgaacaatcatgtatgggttctgtgtggacataagtttttatttcctgggggtaaattcccaaggagtacaattcctgggtcatatggtaggtgtcttttgtttagtttttcaagaaactgacaactattttctagagtagctatacccttttatattcccaccagcaatatatgaatgatccattttcaccgcatcctcacaaacatttcagtatgacctaattttgacttgattacctctgcaaagaccctatttccaaataaagtcacatttatgtgacccatttatgagtaccaagagcaaggagttgagcatacctttttgaaggacacaattccacctgcagcacctgtcttcacttgcttaggttatgggtgggtttcccttcagagtgttatcttctgagaagaaggtttgaattcatagctggattatgcctgcctttgattgttcaatttggcccccagggatgagtgagcaagttcatgtcattggaagggacattactgagtctcacccctactcaaacctccaaagtttgaaagatttgatactcatcaacattctcaagaggcagaagggcaaggtgcttccttatgtagtttctccatgactgtccttccccactttcccagtactgactggaaagaaaaacaaagcaggacaaagggattgtcagtcatttgagggaagggatgctgtgttagttactcctgaaccccttcagagtgtaggcagagagaggtacttagaaaggtgtgttggatggatgagtagctgagaggggcagggccagagtgccccatagaatgaggaagagtcctcatttacatgtgcccttcccccttcccaaacatgtgagtgttcatacatgggtttccagtgtctgggcaaggttaattctgtcctctgtccccttgctgaaggtctgtttcatttaatttctatgtatgtgtgctcctagctagccaaacagggcacagatgccaggaaaatagcaggcctgttgttttgttgagcaccttgagccctggaaggcagactcattcagggctcaagagggcaggattaggcaggtagctatttgatcccaggcccccccacttaccagctgcgtggtcttgacctattacttattcctcttctatctattaactgggtataagatgttctttatgtgaagttattttgaagcataatgtgtatacagaacagtgcacagatcataactgcacaaccccacacgaggaacagaacattaccaagaccccagaagccccttcttgtcttctcccaggcactaactcgcccacccccagctaagagtaatttccatccaaatttctaactttatttttacctggttttgaactttatatggatgaaaacatacagaacatatcttttgcattgagtttctcttatgtaacattatttttatgagattcatctgtgtgagtaggtatagttgtagcttgttaattctcctcattgggtattctaatgtataaacataccacagtttaataactcattctattgttggacaatcgggctatttccaatttttggcttttgtaaataaagctgctttgaacattcttgcatagttttttggtgggtggggacactcagtcatctagaagtgggattgctgagttatagaatatatttgtctctcagctttatagaacctttgcaacattttaatgaatgtttttaatctcacagtatagtgtggattaaattaggttgtggaaagtactcaatacggcccttggcagacaggagtccctcagtacctgtttaaaaatgtaaataaggcatgacattccattaagtctaagtaccatgatgaacttaaacatttccctattgtttgtttatttaattgcttttattgtgttgttattttatatcatgttgcaatgaatgattctctttatagcaggtttcttcttttgaaaaatttgctttggttgattctcagggaattgaatcaaaggatatatgactgtaagacctgtcacccttaaaaaggactatgagggcttgctgaggaggggaaaacaaggaagcaagtctctcctaccatggcccaggggactgtgaggacagaaggcttgtgggtttgagggaggactgtcttgcagaggatgatagggtaaaatagaatgaaggatgatttttataaatggttatgcgccttaggatgactacatatttagtcccttataagagaaattgagtagttggtaaaacaacagataataattattaaatgaggaaagagagaaaccacaggtgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccacagttcctgaggaaagaagcaaacaggatggtgtttaagtaacaaagttctgcccttgggtgtgttgtttgcggataatcacagggcatgttagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaaccatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttgcagaccaaaataatctccttaaatatcacttttgagatcagctggggtaaacgacagcaacacaatgacaaatcattaaactattttagagattatgaaattaaaatactcagattaaaattttcctatcacagaattaaggtactggaaaatatgtttaagtttttattaatcacattgctataggtttagatattttgtacaactgaaataaaatcacacactggcagctacatttttgaaagttaaaaacatggtcacgaatatatcttattttaaaatcagttaatataccttaatggtatttaatgccaaattcaaagtgaattgatcaagccctcagtggccaggtcatgggtgtgatttttactctgaaagaattacatatttctttctttttggttgagcttttgttatttaaatacatttgatgagaggatattgaaataattaaatagcactgaaaaaaaaaaaagctttaaattatttacaatcccctaatggaaattttcactaatgagatatcataatgaatgtgaattttatttctgaaatctctaataaatcagtcttctccctggttttcccagctcagcgcccattacgtttctgttctctttcccttagtggcattatttgtatcactgtgcatcaggaaagctggctacggcagcatcaatcgggcagacacagggtggccacggccactagcggcaaggcggctgccccaagagcgcggtggcatggccaccaaagccactcaatcgagaaagaccgcggctctgtctacagctcgcggtgccacggccttcttggcagaataaaaatgtagacaagtaataacagaggataatgaaagaacatactctttaaaatatttcctatttttttcacagacccacggtcattaaaaaatgcaattatttactttttttcatttaaacacatttctttgagattgagcttttgggaataaccacctttccaccattacaataagagataatttcacgtttagtctaatgtacaaattggatttttaaaaaatgagctctatctgtgaagcccttattcctatagaatgtgtctttttgagtttattacttattacagactctaaaaacaacattgctgctgattttcaagtaagctgcctcttctacatagcaaataggtacacttcacttttccctgatttttcttagggcgtgctattgatttttattgttgtctgacaaaataatttatcaaacaaaagggagaaagactaaaaaatgtatttttccacttttctgtatcatgcataatcagcaacaaccaatacaatatttggcaagagtgaacaaaaataaatttacttttgctccttagaaatacaagggttcctttttagttacactttttttttttactttgtgtcattcagtttagagcaatttaatctttttttctccaaatccatttttgaagctgagtttaacttttgcaacccatggcaaatcttaaatgccctcatttaccaatctttaccaaactcctatttaagcctctaaaagtcaatactggccatcagacccaaatttcagaagacaatagtgaaaaattacttacgtttaatctccagtcgtgtcccttggccgaaggtgatccacagtgttaacttaattactttccccttaacaaaaatctcttttcgctgttaatatcactaacctgaccgatgcagagaaaatcttgcaattgagatgcctcacttaactggctagcgcttggctgttccttaagatgaactaattttctatcccttactcatctgactttttgaaagaatctggtactctttggaattgacctgagctaatatctcaaacacaaaaacgctccaaatttaaaaccttataagaaaaagcattaggaaagtgcacttacgtttgatctccaccttggtccctccgccgaaagtgagccacagtgagggatctcaccctttcccctcaacaaaaacctctcttgaagccaatcatatgagataggctgcttgttcagagaaaaatctagctatttcttccccatttcccccatgaatcctattctcctctcaaacccaatgattcgtctatttgctcagctttttaagttcattttctggtgtcctgctatttacttctgggtcaccaggtttattcaaccaaaatatcacaaaacttgcacaaatgatacaatggcactaaaatctcacgaataattgagacagatgtacttacgtttgatatccactttggtcccagggccgaaagtgaatcacagtgattcgtcttaacttttccctttacaaaaacctccctgaaagctcagcaagcctctttcccccaatgaagttattttgatttagaaatcttaaaaattagccacaagctagcgtcctgtggaacaatttcccctcctctgtacctaacctgggaatgaagtttgttagatccctggcatccgactaatgaaaatccacacaaaggaacacaaagtaaactaattagcaacagtgaagaatcagtggaaaaaagtacttacgtttgatctccagcttggtcccctggccaaaactgcacacacaatggttcctcttaacttccctcctatacaaaaactccctttctgacaattgaccaaggctctgtccagaacatgttatgttccccaggacatttctgaagctattacttagacaagttattctcacccaatgactgaatcttgcttgctcttcaaagaaaatgtgcaatcaattctcgagtttgactacagacttatctttatcttttccctgaaggatatcagaggctgattgcagagtcaccttatagatcacttcatagacacagggaacagaagacacagacaactgaggaagcaaagtttaaattctactcacgtttgatttccaccttggtcccttggccgaacgtccaccacagtgagagctctccattgtcttgctgaacaaaaacccttctcaccaaaggggaacagagtcctgggtcagctgctgaagctcaactcccttttcgagcaggtgtggaaaccctgaggcttctctgacatagcatgtgtttattttcttaggtgagacctaaaatccaagaagagaatatatttacgtctatggcctgatggttcctttctttagcaacttgccacatctggactgcttattatttatttattttttagaaagtagactgaatgttaattacaaagaaaaacaagcaattaaaaaaaatggccagtttttttgtactttcttttggggtgggctgggggggcttttgcaaaggataaacttcatttagtgtaattatggaaatcatcagcttctcaatgagtaataattacaggttgtcttactattttatcttctcctttgctgcaatgttatttaaaaaaaggtagactaaatatatatcaacttaaggctcataactttgaaatgcattttgaaatgtagctccagatggtatacgaaaccaaagtgaagactaatagagtagaaaagtagactttacttggttggtttgtctgttttcacagcacaggaagagctcagctcttactgagctggaccaggcgcatgccatctttggagctgccatggagtcccagtgttccatagtgtttccatagtaatctcatcaacaacactgaagaccttttcagtattttcttttgagtccagctccatttttgcagccttgtatctctcttaaccttccatctccaccccttccatacattactcccacctccctacactccttagagtttttctatggcctccagctttcacaagcactccctctgcttgggaacatctttgtccacctgggttagcttgtgaactgctaattgtctttcaaaattcaactgaagagagaccttctctcagattagccctgagcaggtgacctgaatttacagagtacagagacaggtcactgggcctagagtacctaattattttttattttatttatttattttttttgagacggagtctcgctctgtcgcccaggctggagtgcagtggtgcgatcttggctcactgcaagctccgcctcccgggttcacaccattctcctgcctcagcctcccgactagctgggactaaaggcgcccgccaccacgcctcgctaattttttgtatttttagtagagacggggtttcaccgtgttagccaggatggtctcgatctcctgacctcgtgatccgcccacctcggcctcccaaagtgctgggattacaggcgtgagccaccgcgcccagccgagtgcctgtttatttttacctgctttcagattctcttctacccttctaaattataagctgtttgatgttttatttgccctgtatttgggaggctccgtccagtatctttacttagcaaatgcttaacaaacattttcagaataaataaaaaaaaatacctaattgaaagtcaataatagatcagagatgctatcatagaccaaagactaatactgactgccacaacagtaacttttacaacagaaatcataactacaattctaaagattaggggtaggtttatttgattctgtcactggcagctttgctagttgccttgaatagcagaattagcatttggtctcaccagaagatgaggaaggagagggatcaagttagaggtggagagttaacattggcaagtgaaatttaatgtgcaaaatagctgaccaagggcatagtccttttttaaaggggacacaaagtgattttctctgcagacatacacgcaataccaatcataaagggtgacatttattgagcacttactaagtgccagacattgtacatggatcatcacatttaattattcccaagactctatgaactaggaactaatattatcccctactttgtaggtgcaaaaacttgagggcagagaggtcaaggaactggcttatggcagtaagtggcagagctgtgacctaaactcagatcccatgtttttaactgaactatatgcagattatactccaggagtaaagtcactcaacggaagcaacaagcgtgacagggaatgctgggatgggggaaggtaaaaggaactccttagactgggataagtgtgtacagacgtatgtataagactacacatggaaatattgtttaaagagtgaaaaataactaaaatcctcattaataggagtttggttaaactgtgctagagctttacaatgtagcacaaagcagacattaaggggaagacgtagacttctatatagttacgtggaaggtgtttgtgaaaatgcaggtcactgaagagtatgtgtggtgagatatcatgatcccatctacattgaatatatatgtatataaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaaactttgaagaacaccacagagatttaaaccatgtcattgaattcatagagaaactggaatttagaaacattttttccattgcaaaaacaggaggcgtccttgaagcagccagttctagttttccccacagagccccagaaaagccgtacttcagagctatcgggctgggaatggtgataggtggacagtggagagtggaataacacctgggtcatctctctgctggttacagacagcttggccctcatgcttcaggccgtgggaatagagattgaaagaaaaagggggcaagttaataggcattcaatagtaatgggatttaaaaaaccctcccaaaccactagaaggaaaagaaatagacaaaaataataaaccaatccagcaaagtttaggaaaagtgaataaaaaattgaggtaagcacgatacataaaagtacaaattaagtttgaaggaccaagtcaaaatatacagtcacaaactattgtgaatgttaaattatttaaaactttaaataatttatctaaaaataaaaataaaccaaaaagatgactatgtatgttttcaaggatatttgattcactagagaaacagttcatttgcttcctatttatgatgattaaaaactagattgcaaaagttagatgttaatgtaaagaaaactttatgaaaatgataatggatttttatctagtagaaaagataaccccaatgcttatggttttattgctctgtaggacattaacaagttgtgcatcttatttagcaaacttattctaacattagtagatgtgagtgtgtgtgtgtgcgtgtgtgtgtgtgtacgtatacatataggtgtgtgcaggtatgtgtatatgtatgtatgtaggtatatatgtatatactagcaaatgataaagttggttcaaaggacgatgtacagtagtacctccttatccacaattttgctttctggggtttcagttacctgtaggcaactgtagtctgaaaatattaaaaagaaatttctagaaataagaatttactcattttaaattgtgtgccttagtagcgtgatgacatatcatgcccttccgctccataccagcctgggactgaatcatccctttgtccagcgtctccatgctgtctacacttaccctcctgtttagatgcttagtagccctcttggtcatcagattgactgtcatgatatcctagtgtttgtgctcaagtaactcttattttactgaattgttctattttattactagttattgttgttaacctcttactgtgactaattaatgcattttatcataggtaagtgtgtataggaaaaaacatagcatatgtagggttgtgcaatagcatccactggggggagaattttgctgaagttagaacagagaagactgtccagaagaaagaattttctatacttgccaccttttttctgtttggtgtcctcatgtaagtctcagtgttacgatctgtctccccacctcaatcactgccctctgtctctggaaggaaattccccttgggctgaggccagcatggtgccagacaggagagatccagtacccactctggaaaatttcataagataactggttctccaccttcttcagggaccttttatcatatctcatgtgcccatggcatttgtcactgccatctgcacaacactgaactccagcaacatcaactgagaagaaagagagagagagggagaaagagaaagagagagagagaaaagtcgtttgttgattgagccacacaaaattttttttctaattaaattatatatccaggtagctgcaatatgctacaatcccaaatacacatatttattaaatatgattcaaagagcattcattgagtactctgtatcaaggcacaatgtaaaataagtgcaaaattactggtgattgttacgcctttctgtgggactcgactctctctggttggaggtactgtgtgggagcacgtgagctccaatcaggtggtctggagggagcaaaatgcagctgttggaggttaaatatgaagggaaatagcagtaggcatcggatagcatagaatgaaaataaaagtgcatatacttccagtgcctgttttacagattccttgtctttttttttttttttgaagacggagtctccctctgtcgcccaggctggagtgcaatgctgtgatcttggctcactgcaacctccgccttctgggttcaagcgattctcctgcctcagcctgctgagtagctgagattacaggtgcgcaccatcacgcccggctaatttttgtatttttagtagaggcggtgtttcactatgttggtaaggctggtctcgagctcctgacctcgtgatccacctgcctcagcctcccaaagtgctgggattacaggcatgagccagtgcgcctggcctccttgttttttaaaactagttcaaaccctcaactcataatttgggaaattcaggtcataggatgccctgttatttataaggtatccagcaatgcatggaacagaatatttaacttttaaaaaacttatattaggttgttgcaaaagtaattgctgtcattttctcctttctttttctttttctttctttctttctttctttttctttctttctctttcttcttttctttctttttctttctttctctttctttcctttctttcttttctttctctttcttttctttcctttttctttcttgtctttctctttctttctctttctttttctttctttctctttctttcctttctttcttttctttctttctctttctttcctctttcttttctttcccctttctttctttctttctttcttgtctttctttctttcttctttctttctttttttctttccttcttctttccttcctttcctttccttccttcctccctctctccctcccttccttccttttccttccttccttcccttccattcccttcccttccccttccttccttccctccctccctcccttccttccttctctctctctttctttctttcttcctttctttctttctctttcctttcttctttcgttgttgtgttccagaacgatttagtgttacctacagttcccagagaaagaatcctgtcttgaggggtggctggggcagggctactactctccctgctctgtgctctagtggccaggtggatcagctccagctgccaggtcaaatttcctagggaatggaattctgtctttttaacaagaacaaaataggtgcttagtaaatataagatgccttcagcttttagtatatgcataatcataaatataaatttgtttaaaacctgaactattctgatgttctcactggctagccaaacttaaaatgtgtatttggacttgaatttcccaccaagggtgttactagcttctttactgttgcagctgccttttgttttgtttttgaaagtttaaaaaaatacacaagggggcttttgcttcctgaaagatggagtagaattacttttacctatttctctcaagtaaagtaaaaaccccggacattgtacgtaaagcaaacttatgaagactctggaagctggagagaagaaggcagaccagttaggaacattgggacccaaggagcgacccagcagtgcattccacggggtttctttttgcctcatccattccagacttggttctggagaagtttgtcaacccagaaacaccaacaggcccagaaaaacataaagccctaataaaaagctggctctctctagtcaaaggagaaagaaaggggaagcccagtaaaacaattcttaggcagtaacggctctgctccattcaaacacccaacttctccttcctgagtggcaagagaggaaattcgctgagatgagtttaaatgagatccaaagcctcataacacaatactccaaagtccagatttcaaatgaaaaccacacatcccaacaggaaccaggggaaccaggaaaatctcagctttgatgagacagttaagaggcgctaatactgacatgacagagacgttagaattacctgacaagaatgttaaagctgccatcgtaagaacacatcaaactcaacaccaccatcaatgagtaagatcataaatcaacatttctggaaaactccaaccagcaccagcagaattcgcattcttttcaagtgctcatggaacatataccaaaattgccatatactgggccatgtaacaaacctcaacaaatttaatagaactgaaatcacatgaagtgtgttctctgaccacctggaatcaaactggaaatcgataatagaaaaataatgggaaaaatgccaaacccttggaaacaaaacaacacacttctaaacaatccatgggagatttcaaggaaaataaaagattatatattgaatagaataaaactgaagatgtaacatattataatatcaaggatacagtaaaagcccaaagaaatgaaaacttatcccagaaaaatgaaaacttagcacaaaaacgtatacaatacacaactattcatagtggttttatttgtattaaaaaaaaactggaatcagtcaaaatgtcctacaatagattaatggtaaaacaaactgcggtacatccatcccatggaataattagtaataaaaagtagtgagttgggcacggtggttcatacctacaatccatacctacatacctacagcactttgtgaagtagaggtgggagaatcgcttgacctaggagtttgagaccagcgtaggcaacatagtgagaccatgtctctaaaaaaaatttaaaaaaattagctgtgtgttgtgtcccatgcctgtagtcctagctacttgggaggctgaggcaggaggaagcttgagcccaggagttcgaggctgctagagagagttatgatctcgccactgcactccaccctgtgtgacagagtgagactctgtctctaaaaaaaattaaaaaaaaaatagtgagctgttgatacacatgacttgaatggatctgaggggcattatgctgagtataaaggtcacatattgcatgattccatttacataacgtttttgtcttttcaaaaatattgcaaggggtacttggttgcagggtgtgcgcatttttcaatttacaaattggcctcaaattcgtgtattaagtttcattcccacatttgcaatgataagtcctccatggagtttcctcactctacatcctctccaatacttgatattatcaggctttttaatttttttccactcaaatggtcaatacgttgtattttatttttggtttaaaatacatatttgtgttttctgatcactcatgaggttgaccatttaaaaatgtttattggctattggggtctcatctgttgtgaattgcctgtttttaaggtatgcccacttttttattgagtttcttatttttttcactattgcataggagttttcaatctttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttgggtttgggtaaaacttaaccatatgtttaacaggacctggactttgatttaagcaaacttagggtaaaaacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggtttaattaaaaatttacaatgaaattagaaaaataaaaataaaaatcgaaaatcaaatggagataaaataacagtggtaatcaaaatagacccctattttgatctaaaaaagaaaagaaaaaaagataatttggacatcataaaattaaacttctgctcttcacatggcacgttaagaaaataaaaggcgccacacattgggagaacatattcataaaacacaaatgtgagaaaaaaatcatatgcagaatatacaaagaactctcacagtccatagtaacaacaccccaataaaaacttgaccaaaaatttgaaaggatatgtcatcaaagaaggtatatagtgaagttaaaatactaggctcgagcaagtggaaccctcattcactgctgatgggagtgcaaaagagcacagcaactttggaaaacagtttggcagtttcttataaagttcaacatacacctaccagatgactcagcagtcccaaagctaggaatttacccaagtgaaatgaaatcctgagttcacacaaaaacctgcattggaaagcttacagcaactttattcttagcagctaaaaattagaaatgaccaaatggctttaaattgttaactagataaacaatctgtggcatatccacacaatggaatactactcaacaatagacagtgaactagtgctacacgaaacagcaaggatgaatctcaaatgcattctcctaagtgaacaagtgaacaaagccagactcaaaaggcttcacattgcatggctctatttacatgacattcaggaagaggcaaacgattggatcagacaaaaaccagtggttgccaagggctggggtgaaggaaggggcataaaggaactttaaaggatgagggacttgtcctatatcttgaatgtggttgtggttacacagctatgcatttgccaaaacttatagaaatatacacgaaaaggtggcttttattgtaatttatacctcagtaaacctcacttaaaataagcagtttttgattgaacataaaatctggttctgagcttcttggaaaccgactaaatgaagataatgtgttatgttacataactttcatctaggggaaaaatttctagtttctacgtgtgactgaaggttttcctgggataaaagttgaagacaatttctatcttggggcattgcataggagctgctaaatggataatattgggggcactgcatagaaacggcattggataatactctcagtagtaatttcatagagaataaaaaacagaattcgtatgatcttttttttacttgtataaatttaagcaatacaggtgcaattttgctacatagctatactgtgtagtggtgaagtctgggcttttagtgtatctatcgcctgaatcatgtatattgtatccatttagtattttctcatcactcaacctccttccacccttccacccatctcaatctccagtgtttatcataccacactctatgtccatgtgtacacatcatttagctcccacttataagtgagaacatgtgacatttgaccttctgtttttgaattatccacttaagataatggcctccagttccaaccacattgctgcaaaagacatgatttcattcttttctttatagctgaatagtatttcattgtggtatgtgtatacacacacacacacacacacacacaccacgttttctttatccaatcatctgttgatggacatttgggttgattccatatctttgctattgtgaatagtgctgcaataaacaagtgagtgcagatatcttttttatataataatttatttccctttgggtagatacccagttgtggtattgctgaaccacatggtagttctatttctagttctttgagaaatctccatagtgttttccacagaagctgtactagtttacattcccactaataatgtgtaagtattcccttttctctgcatccttgccaacatgttattttttggtgttttaataataggcattctgactgctgtaagataatatctcattgtggttttaacttgcgattctctagtgattagtgatttgagcattttgttttttgtacgcttcttggccatttgtatactgtattagtctgttcttatgctgctaataaagacatacccaagattgggtaatttacaaagaaaaagtggtttaattgactcagttccatatggctggagaggcctcacaatcatggcagaaggcaaaggagaagcaaaggcacatattacatggaggcaggcaagagagtgtgtgcaggggaactcccctttataaaatcatcagatctcataggacttattcagtatcatgagaacagcatgggacaaacctgcccccatgattcaattacctcccaccgggtctctcccatgatatgtggggattattacaatttagggtgagatctgggtggagacacagagccaaaccatatcatataccttcttttgaaaaatgtctattcatgtcctttgcccacttttttggtggggttattttgctgttgttgttgaattgtttgagttccttctaaattctggacattatttccctgtaggatgcatagtttgcaaatattttcacccattctgcagattatctgttcactctattgattatttctcttgctgttcagaagcgttctagtttaattaagtcctgtttgtctatttttgttttggtgcttgtgcttttgatatcttagtcctgagttcttcacctagattaattccagaagcattttccctaggttttcttctagtgtttttgtagttacaggtcttatatgtaagtctttaatctgtcttgagttaacttttgtatttggtgagagatagaggtctagttccattcttctgcatatggcaattcaatttccccagtactgtctattgaaaaggatccatatgactatttcttgtataaatgttgaatgtgaatagagaacatcagatggcaaagctggtatgtggctttaccatctgtaaacagatggtggactgtccatctggtggtctcagagggtggcctcctaggtattcaccttgatgaagttagcagagctgaggccacacttttagacttgtgtgctcacaaacccttggatgcaaattcagagctggatagattcattctattgcaaaccaacatgttgatttattcatctgtgcctagaaatctaaccattctgtaaacttgatgacagcatcctctggccagcatgtttcttcctagttggaggcgtggtgtgtttgatggagcatcaacttagacacagaattagaatcttaactctgcatcttatgaactgggtgtgacattaggtaaattacttaactttccccaagcctcaaatttctcatctgaaatgtggaaataataacgtttctcttataaacttgctgtgaggagtaaataaaatagtgtttatgaattacttagcatagtccctgggcatgtaatttcttagtaagtactaatttttgttggttagatccagttacaggggaagcaaatttacagatatgtggttcatgagcaacagattttctggattattgtcttacacacagtaaccagactgatctttaaaaatcacaaacaagaaacaaatcaaattattcccctgcttaaactctctggaggtttcttattgcacttagaaactcattgtcatgatccctaggccaacacctgtggttcccacccttggctggtgtgcatagaatcttctggagaactttgaaaactactggtgcccaaattgatgcctagagattccgaagagtctggtccatgtggggactgggcactgtgacttttattagctctctagttgtttccagtatgatcttgccctgacccctccctcctgtctgtgtttcttattgggccttctctccttccctgctcctatgactgggacctcccttctaatctttgaatgtgctgagctcttccttcaggaccgaaagcctcttcattactgagccaggtgctaccaccccttctatgtcaagctcacattccatcttcgttatgactctggcctctggtcagaacgtggggtgctctttcccttcaggaagttgggacttggagggctgggacttcaccatcagagtcttttgtgcctggttgtagttggaatctcgtgcattttcatgtagaggttacactgtttgcagggcccatctggtcttcacagtgaagagagaagtcttagctgttcaaaagtcatgttgcttgctattggagcccctgatatgtggcccagattatggtaaggcgagtgagtgaggcattgccttggtcataaattttaaggaggtcccgcaaactcagtagtcaagataaataatattttaatgcaatatttaaacaatcaaaattaatgcaaaaaatccatgatgaaaaaaaaatcagaattcaggtcaattccaggttgatttagtgaataaagagatatcaatagggactgctttatttttttatattttatttacttaatttttttttttttaagatggaagtctcgctctgttgcccaggctggagtgcactggcacaatcttggctcactacaacctccacctcctgggttcaagtgattctcctgcctcagcctcccaagtagctgggattacaactgcctgccacaactcctgaataattttgtatttttaatagggacggggtttcaccatgttggccaggctggtcttgaactcctgagctcaagtaatccacccgccttggcctcccaaagtgctgggattacaggtgtaagccaacacgcccagtcacggactgttttatatttgtggttaagggggatttaagggataatttgagtctgttctgctttcttgggttgtgtttctcaaactggcttatggggatttccagcgatgtaaattttgtgatgaaaatattttatagtaaagcacacatggccatattgtggaaagaaatgccaaaattttatgaaactttaaaataaatcaagctcaactactggagaagctgaggtaggaggatcgcttgagcccgggagttggaggttacagtgagccatgcattcgaaagcagaacagaatcgaattatccctcgaatgcgctacagccacaatataaaacagtcattactgatatctctttattcactagatagatcctgaattgtctcgctctgtctcccaggctggagtgcagtgcgagaccttgtctctaaaacaaataaataaataaatacaaacaaaaacaagctcaagactttgaagaaatgataccccggagctttcagaccagagactcccgagttacacacattttcttctttctgccactaggtggaggcagtggagcaggttgagaatcactgtcataaagcttgtaattaaagaacatcagagtgccagacagtggagctgctataaagtgcagaataactactcctgtcctatacttggtcgcgtatgagcgggaagtgaatggaagggaggctcgaaacaatgggaagagccgtaagaatcaggtctgataaacttacataaacggccttgcacacaacttttctggctgaacctgcacttcccataagtcaaatgcaaatgttggaaggaatatcttgcgaggttctttctagcttgtacagcctgagctattttaaaggagaaaagctgacgagcaatcgtccttggaatttgcagtgcataaacttgaccagcaaagggcagcagtgcacacaccttttaaaaagtaactttccaaattttctactgccatgagagagttctgattctacaaataggagacagtgtttggaccacttaataacaaccaaccataaaagtaaattttctttttattaaaccttttaattttacatttgtaaacagaaaagaaatccttattttgttggctctgggacatcactttcttggttcaactccttcctcctgaccactgcttctaagtctcctgtgctgttttcttctcatctcttcgacctctacttgttgggttacctgccaggtcccagcctgccttcattgatttaactcattgctagtaacctcgccctgtttcccaaatttgcatctccacccggactatttcccgaactccagaatcacgcatattcatccacctgtccaagggatattgccaattagaggtctagcaggcatctcaaatgtctaatatgttcaactctaatccctgattcccgcctgccttccccatctcagaaaatgtccttccaaattctctagttgctcaggttaaacacttgcaaccaccttgatttcacgtttctcccacgcctcacatccaatatgttaacaaattctattttttctacctttgaaacatgaccagaatctgacacttttcaccacagttgccactgagcctcttgactattatcaagaaaggagatgtgttctgttttgtaaagattattaaaagatgttaaattgggactttttttgtatttgttttgtaaggtatctcaaaggccaagaataatataatggatattgtgttctctaatggaacaattcattttctctcctcctccactgcatttttggggatggtggaagtattggaggattttcagaataagaaacaattttattgctgttcaccagatgtcaggagggtatggtgtggtgggcctgggagtggactgtttaaccctagaacttagaaaccagtgtccctgtggagcacaaaccctaataggtcttggtgagtaacagaatagataaaagagagctcagtctggtcataaatcctttggccagttgccattcattgccatgagaaattccccaagaagacacccacctctttttcaggcaattctgtttactagattctggaggattcgttatcatcgaagaaccctgccttctagtcagatggtgcattagtcagaattctttttgcaagtaacataagtcagctgtaacacatacaagtagaaaaggaattagaaaaagaaaagtagttatactaatgtgaaagaaaaaataaacctcaggaccccaaaaatcactaagccaaaagggaaagtcaagctgggaattgcatcaggcaaacctgcctcccattttattcctaaataagatagctacaaagaaaaaaaagctacatacctccctcacaatttgcccacaaggtaattccttgtggacaaagaaaggacagagctcaaagtcatccctctgttcacttcagacaaatgcatatgcaatgcttcttctgccctactgtttcaataagccagactaaggcataaatgactatttctctacctgcctttcacatgtgaaaggctgatcagagactcaaaacaatgcaaccccagcaggaagcccccttccctgccttgagttgtcacacctttccagaccaaagcgatgcacatcttctacatatcgattgatgtttcttgtctccctaaaatgtataacaccaagctgtgccccgacccccttgggcacatatatcaggacctctggagactttatcatgggcttgtccttaatcttgggaaaataaactttctaaattaattgagatctgtctcatactttgagttcacactaggttgttcacaaagacacaaggaaggctatagatccaggatggggctatgcaggtggaaaatgtacctttgatcatgtcaccaaaccagtccagggatacgcccaaaacatgcttggcagcatgaggctgcagtgtgcactgatgacattagtgcttatggacttggtctcactgctagtgagagtcattttcttgattatttttctcaaatttgggtgaggtgaatgtgtagctccacaagatggtgtagagggggcaatgtgaagccatgtaaccttattgaacatctttttggagtgtccattttacttgaatggctcatggaaaaaaattatattaaaatttatacacacataaaaggcacaagttgtagtatttactacgagaagaaaacatgatttaagagataagcttcaaactgcacaaatagcagtaggggagacgaagatagttattcacttccctctgctgcttattgtgaaccatgagaagccccatcttaaagcgtctgaggaagtacatggacttataatagcaaatctatgcatatatcttattttagccttttctgctagactttgggttggagaagtgatgtgagaaggtgtaaagagcacaaaattaggagtcaaaaggcctggttttagcctcagctctgccacgaactaagtgacctgggttaagatatttctatctgtgccctctaagatatttccttacatcaaagaatgcaatagataatttctaaggttctttttggcttttagtctctaggtcattggaatggagacgttaggcgagcattcttctttggagctgtagaacattagtttgatcaccagaaggcacaggatcccatggtgatataggattataggaaatgaacaaaacacagtcttctctcatgcacttctctcacagtcttctctcacttctctctctcttttctgttttgtgtatttatattttccataatagggtaggttataccactgccccaaatctcatggcctagctccaacaaatgcttatatcttgctcatgctacaatcttcaccagggccagaaaggtgctctgctccatgcagccactcaaggatccaggcagacagaggctctaccatcttgtatttgcaccatttggagcacatggcctcttaagttgcttatacagataaaggatagactggaaaattccgtaagatctttttcctgcctcagcctgcaaaggatgtatgtatgcctatttctttggccatagcatttgtaaggagactgggacatataggtgagcaaatggaacatatacaaagtaataatgtctctaagataaatatttacaattcacaaatgtacaaagaattttatagatgcatccataattcacattttgtgtcattatcaccattttctcctaaattacataaaacttattttatttattgacatgtgcttcatatttatcatttatcactgcctgctaattttcatcaggagcatcaatggctattcaatatcctatttatgtaccatagtttataaatgtattgacatttaagtgataatttattatggttttttgctattataacttattgaattgatgaaatgacatacttttattaactgatttttctaatattaatttctagttccatgaggctttccactttggatggtaaaaagggagatagcatttctacttatatgcataaattaattctaggtagtgaattttatttatctgggaataatttttagatatggcaactctcattcattttgacaagaaaaatctaaagctcataaaccctgaatcctatatgcttactctcacaaaaatctctaatgtcctgctgggatttatccacagtttagattagacctggaatacatatggtcatgcaacaatgatcttagaacaggactttaacttggctttaggaactgaggctgagagtaatagaattgatttttttgtgtgtgtgtgaagctcctattataataattagaatactttgattcactcagttaaagttttcccctgatttattgtgtacatacaatgaaggatcaagaaagagaaatttttaaatggaagcattagccagacaagtttgacctcacagttttactaggggatatatcacctagttttggatctatttctaacatcttaacattgtgaaaagagtcttgggaaactggttaaatcccaaagaatgctgcaataggaggttggcccttatgagttatttaatatcttgagctgccttcggaaaatgttgctgagcaggcattgaagagtatcgataaaatttattgagaatttgtttattatgattaacagaggtaaaagccagtatattactgattaatataggtaaaaggcagttaagaaattgggaatgctttctcttctgctttcttctacgatgcacaaggcgtttcacatttatgcccctatgaaaattactaggctgtcctagtcattagatctttcagcagtttgtagttttagagcttctaagttgacttctgtcttttctattcatacaattacacattctgtgatgatatttttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacagtgcttcagcctcgaacacaaacctcctccccatacgctgggccagtaggtctttgctgcagcagctgcttcctctgcacacagcccccaacatgcatgcttcctctgtgtgttggggaggtcactctcttgatttattcgttggagggtttgcagggcccaggattaaattaagagacttgacttttgctggatctctttttgtagaagattattaaagcaaaatgttgtaaagatcccttagagacattgtcaggagtttttgtgttgcaggaacctgcatgtttcacatggacacatcacatgaccgagccaaatagatttatctttactctctagaacagggtccactcagttttacgcacagatgggtcaattctttcctctatgtgcctccttgactctggaaagtttctacttggattcctaattctcttttttctttcttcatctgcaatccttcccaatattaaaccttgatccttcctattcatagcctcccacatagaaggtagtgtccctctgtagctttttccttccagagaccctgtttctttccatcatattaatactttcataggcaattttctaattctttattactctagaaatatgtgacagcatttctcattgccttttacaatagtttgccaactttcttcttatttatcatttttccatttttaattttcatggtatacagtagaaagattatatacacacacacacacacacatatatatatacacatatgtatatatatttatggggtacctgagatgtttagatacaggcatgcaatgtgtaataatcacatcatggagaatggggtctccagccccttaagcatttatcctttgtgttacaaacaatccaattacactcttttagttatttaaaaatgtatagttaagttattattgactaaagtcaccctgttgtactagcaaatagtaggacttattcattctttctaagtattttttgtatggattaactatccccactttccccctactccccacccctgcccactactcttctcagcctctggtcgctatccttctagtctctatgttcataaattctattgttttcatttttagactcttcatatacatgagaataaatgatgtttgtcttcctgtacatggcttatttcactaaacgtaatgacgttcgttagttccatccaaattgttgcaaatgacaggacctcattctattttatggctgaatagtactccattgtgtttatgtactacattttctttttctgttcatctgttgatggacatttaggttgcttccagatcttagctattgcgaacagtgctgcaacaaatatgggagagcagatatctctttgatatactgatttcctttgttttgggtatatacccagcagtggagttgctgaatgatatcgtagctctatttttagctttttgaggaacctccaaactgttctccatagtgggtgtactaatttacattctcaccaacagtgtataagggttcctttttctccacattcttgccagcttttgttatcgcctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaattttttctcctattctgtggttgcctcttcacttttttgattgcttcctttgctgtatagaagcttttaaacttaatgtgatcccatttgtccatttttgctttgattgcctgtgctagtggggtattactcacgaaatctttgcccagactgatgtcatggagagtttcccaaatgttttcttgtagtagtttcatagtttgaggtcttagatttgtctttaatccattttgatttgctttttctatatggtgagagattgaagtctagtttcattctcttgcatatggatagccaatttccccagcattatttattgaagagattcttttccctagtgtaaattgatgacatctttgttgaaaatgaattgactgcaggtatgtggatttgtattgcagggttctctattctttccattggtctatgtgtctcttttttatgccagtgccaccctgttttggttactatagctctgagtataatttgaagtcaggtaatgcaattctttcagttttgttctttttgcttaagatagctttggctattgtgggtcctttgtggtttaatataaatttaagggttgttttttctatttctgtgagaaatgtcattggcgttttgatagggattgcattgaatctgtagattgctttgggtactatggaaattttaacaatgctgatttttccaatccttaagcatgaaatatctttccattttttggtgtcttcttcaatttctttcattggtattttatagttttcattataaagatctttcacttgtttggttaattcttatgaatttaagtatggttattgtaaatgggattatttttaattttttgtcagagtgttcactgttggcatatagaaatactgttgtttttttgtatgttgattttgtgtcctccaactttactgaactggtttatcagttctaagagttttttagtggagtccttaggtttttcaaaatatgagatcatataatcgcctaacaagaataatttgacttcttccattgaatttttgatctccttaatttctttcttttgtctgattgctctagctaggacttccagtaccatgctgaataagagtggtgaaagtgggcatccttgtcatgttccagatctctcaggaaaggctttcacttttcccccattcagtgtgtctgttatatatagtttttattatgttaagatatgtttcttctacatccagtttattaagtggtttttatttatttatttatttttgtttgtttgttttttacacatcacttcttttggccattcctagctccaagagggtctgtgttgatgttgttattgttttctaataaggaaaaagaggaaaactgaggttaggagacaagtagccacctgtgtacagggtcagacataaagtcaaatgatcactgatggagctctggtgataggcctctcttaaaaatcaccaaacttaatgcaaaatcctaaggactccatacctaaaaccccctaaaatgagatcagtgaaaatgagcagtgggcaaaattgggacccatgagaatgtatccagtaggatcatgatcagtcaagcaaatgggtttaacttggctttcctggtttattattatttatttcctggtttattattattatactttaagttctgggatacatgtgcagaacgtgcaggtttgttacataggtatacacatgccatggtggtttgctgcacccatcaactgatcatctacattaggtatttctcctaatgctatccctcccctagcccccgctctccccccgcaggccctgatgtgtgatgctcccctacctgtgtccatgtgttttcattgttcaactcctacttataagtgagaacatgcagtgtttggttttctgttcctgtgttagtttgctgagaatgatggtttccagcttcatccatgtccctgcaaaggacatgaactcatccctttttatggctgcatagtattccatggtatatatgtgccacattttctttatccagtctatcattgctgggcatttgggttggttctaagtctttgctattgtgaatggtgctgcaataaacatacgtgtgcatgtgttttatagtagaatgacttataattctttgggtatatacccagtaatgggattgctgggtgaaatggtatttcttgttctagatccttgaggaattgccacactgtcttctttggtacgtgtaaattgttgaactaatttacacgtaccaaaacagatatatagaccaatggaacagaacagtggcctcagaaataatgccacacatccacaaccatctgatatttgacaaacttgacaaaaacaagcaatgaagaaaggattccctatttaataaatggtgttgggaaaactggctagccatatgcagaaaactgaaactggatcccttccttacaccttatacaaaaattaactcaaggtagattgaagacttaaatgtttaagatctaaaaccataaaaaccctagaagaaaatgtaggcaataccattcaggacataggcatgagcaaagacttcttaagcatttttttgatagagtagcacagataagtatctgtctgttttttttttccaactgtatttccttctgctctatttttttctgtctctgcaacttcaaatatttgtaaattaattattgagaaaataataatagtaataataataattattattatttgagacagggtctcactcagtcacctaggctggagtgcagtggtgcaatctcagttcactgcaacttctgactcatgggttcaagcaattctcctgcctcatcctcctgagtagctaggtctacaggtgtacaccaccaagcctggctaatttttgtatttttagtagagacagagttttaccatgttggccaggctggtctgaaactcctgacctcaagtgatccgcccaccttggcctcccaaagtgctaggattacaggcatgagccaccgcaccctgctgagataatgattttttaatcaaataactaagttttctttctgttctctatatattgatgtatgttgtatattgtcattgaaattttgattatactcaccatgggatatcttactttggaataggtggcatctcaaatacaatttatttcctttggcagaaggggattattttgttgtgaattcaaaccttcattaacttcagtgtaacataataccataagtgatgtttcctgttattaaatcacaaacagtattaggaatgagaggctgaagcaggagaatggcttgagctcacagatttgaggccagtttgagtgacatagtgagaccccttgtgaaaaaaaagagaaaattttaaatgcggtatatttaaaacacatatttctagacatttattactggtatatggaaatcatgtttattatctaatatcataaactctgacatgatcactatcatttctttagtttttaataaattttcagcatttgtgtatgtcatatgtatttattgattgacatagaccttaatgtcttataatataatacagaagtggacatgagcatattataatttaattaaaaaaatgaaagaatttccacttagaagaccaccatagctgttgctataaatgcagaaataaacacaaacttaactaaaaattcatgtgtatgatgacatcggagagctacagaagacacaaaggttagatgacctaaaattctagagaagaaatagacctctgtaggtgaggtaaatctgagctctcatttagttctttttttgtgtgtgtggtttccatggaatctatttaatcaaaactgcagaaggttctagaaaaacacatttttaaccaaggactgccgatgattctaagttttgagtaaaactgtggttgggggaaacaattttctgctttattgtgtgtccgagtacatacatgataaaagtaaaagccagggaatggaataaaacatagctttatataatatattagtagatacctaaatacaatatggtcttaaaaatgaagtcatatgtatatagttgtattcctaagtatgttagtcccccctcatccacaaatctcctttctgtggcttcagttacttatagtcaaccacagtctaaaacacatgagtactgtaaaagaagatattttgagagcgagagggaccaaccaaattcacataacttttcatattagatcttagtgatgcaaattagatcttactcatacaaatgagacattgaattaagtctttctctcagtctgacccttagaattgtcttttgtaagattttaaaatgcatcaagtaatacttacatatgtaacagctgacccctgagccatcactgacacagatggtaccaggactgctgtgcacagacaggctttcgactctgagtagtagacacaagtttgctgtatttgcagcctccacttgagggcttgggggttccctggcctggctacactgatagcacaactggctttgactctatccccaattccccttcctccctatcccctatgcaaatcccagtaattctccaggtgatatcctggggatttccttgggatattcttggtcttcatcctgccttagagaaaactgatcctcagaggcctcacctgatccagagttttaggtttatcctgacccagactctaattccagggttatcctcttgagttggaggaagaaatggtgatttttaaaagataatcatctataggatcagtagtcagaggcttcatgctgatgagctgtaggaaataagatcaaatggcagcaaaagggtggaatacggaagtttccaaaataataataaggtatagcccatttggttcactggaaattaaagagacccatggccttgaacaatgatgtatgtgtgagttacacacccttcaaagaaacatggtgttatctttgtgtgtctgcactgaatagcttggtcatataacggtaataagaatggcagcaaaatgcccagtcatcgcccaatgggctcatgaacaaagtgatcgcagtggcaggaatggagcttatgcatggcctcagtaaaatggactttcactccctacagctgatctggctgtggccacagctgagtgtccaatctgtcagatgcagagacctacactaattctctaatatggcaccattcccctgggtgacaagcagctacgtggtggcaggttgattacattagaccacttccatcatgtaagaaacagcatttcattcctactaaaatagatgcctactctggatatgaatttaccttccctgaacacagtgcttttgcctgaactatgatccataaacgtacagaaagccaatagtcctaagcaagtttatattctctggacacagtttttagctgctgcaatcaaacatgatttaattaacttaccatgggtaagtggcttctcttccttagctaacaaatgtgccactcaaaaacttagttttgcggcagcctcattttcattttttaattttgtgaataaattctgttatgaacagctattgtgttttaaatttttctaatttttacaaatcatgaataggtattggattttgacaaatgctttttctgcacgtaatgatataatcatatgaaatttctttcctctcaatctgtgtatctttaatttccattatttgtcttattatattggcagaacttgtagtactctgtggaaaaggaagtaagagggaacatcctttccacatcttagcaggaaagcttctaatttctcaccattaaatatggtgttacatgcagatttttgtagatggacttcatgacttgcatctacaagaggaagttctcttctattcttagtttactgagagttttttctttataattaatgagtatgggatttctttaaattctttttctgcgtttattgatatgattatgtatttcttcttaatctgttaatatgatggattacattaattggtttactaatattgaaccagccttgcagatgtggaataaatcccaattgcttatagtatataattctttttagatattgttgggttcgatttactaatattttattgaggaatattgcatctattttcatgagcaatattggtctgtagatttttttagtaatttcttttttttggtttggcattctgattatgccagtctcatagaaacaggaagtattctctcttgcttttctcttctggaatatattgtagagaagtggtataatttcttccttaaatattagatagaattcacccataaatccatctaggcctggtgttttctgttttgaaagcttattaattattgattctacttcttcaatagatacaggtcttttctgattttactatttcttcagtgtgagcttttgtagattgcatttttcaaaaagttggtttatttcatctaggttatcaagtaagtgggcacaaagttatctatagtattcttttactatttttttttagcatacataaaatctataatgatgtcctctttttaattccttgatacttttccttgctctgaagtctggtctgtctgaaattattctggttttcttttgataagtgttagcatggtatatctttctccatccctttacttttaatctatatgtctttatatttacaatggatttcttgtagactacatatagttgggtgttttttataatgtggctgacaatctcttttaattggtgtaacaatccactgatgtctaaagtgattattagtacatttggattgatgaataatgtttgttatttcatatttggtgctctggttctttttgctcatttgtctccacactttttttctgtcttttgtgatttcaattgagcattttgtatgattccattttctttcttttcttagcatatcagtgatggtgatctttttttttgtttttgttttttactttttaagtagttgtactagggattgcaataaatgtacaattaatccaagtcaggttttatttacttttttatgctaatttttttattagaatgaaagctataaataaacacattacatagagaaaacttttaatatatattcctatgtgtagattatacaagtgatgtttgcatacattcttgttattaagaaactacaatgaagtatttagattaaaaagtaaaagtcactcttcatacaccactagtggtctttctactgttccagtgatttaataaaataatttttaattgtttttccaaaatattttattattaaataataatttttcatatttatggggtacctgtgatattttgatatatgtgtgtgtgataaacaaatcaaatgtgtaataaacaaatcaagatatttaagacatccatcacttcaaacattcataatttctatgtgttgagaatattcaaaatcttctcttttagctacttttaaatgtacaatgttattgatagctattgtcaccctatgatgctatcaaaaacttatgccttttctctaactgcatgtctgtacccatcaaccaacctctctttattccccccttcccagcttctggtaactattctactctctagctccataagatccactactttagctcttacatatgagtgagaacatgaaatatttggctttctgtgtctggcttatttctaagtgcacttttaattaacattaaatgtttcatgggtagtgcaaatatgttatgataatagtagctattaatcaaaattctatgtattactgctgttatataattgtgtggcttaataaatcgaaattaaattgaagtataattaattttaactctccagcctgagtattaaaacaggaactactgatgcttaggcagtaagcactgtgagtaaatcattacaaaataaaagcatactcataaacattgtaacaaaacatatcaaggagttattataattctcccaagagtttagaatctccatgtttgaaaattgctgtaataatgcaaagcaattttccacagtattagaagtaaaaactaagtttaaatattgttatatttgatagaaaagaacattattctcatatgaagattcaaattatcaattattattgagaaaaacaatttaaaaattattttttccttgtaatggaggatccagtgatatgatagaatgcataagcagacattttgaattatatgaaagctgatcttgctattcatgttactattatattttcaaagtaataaaatatttttgagaaaattctcttcctgttttaagaagcagccctgcatttttattttgcactggggctcacaaattatgttgttggttctgttttccagtaatacatatcagataccagcaatgctgaagtttggaaactttctagaatgctttttgtttcattaggaagagtcctccacctccatgattccctttgccttctagaagaataaaatgggaaaaacagaattttattattaaaaaaaaaaacccagaagagtaacatcactttccactcaaactgactacactaatctaatttctcattctttatctcttttacactaaggtatacctgtaattttcagagttccattttcaaagactgcttatagtttttaaaaatgtgcatttatggtatagaaagaaaatcattttacgactaccaggttccactgaaaagtaattaatatactgtagtcaaaataaaataaaaattttaatacatgaaaacaactaccgaaatgttatgaaattatagtttagtagaactaacaagtgcattaatgcaaaagaaaagtagggctcagtaatcagggaaccaagtgtgcattgtaaaagtgcagcctctctaacactgggtttcatcacaagtaacagaacaggatgcctgatgcagggaaaaaagaaaggcaattgttggcaatgtcaggaatattgccatggcgtctaccactggtgggttactgagcatcagaaccacagaagaggtaacactgaagcctgcagaataatgagtcttgttgcagaaatgcaaagaaaaagaaagatgataaatgcacacccaggaggttacgttaattttaaccttctgagtgtgcacagctgtgaagataaaactatgcacagctcatgggttaggtttcacacagtctgccatttaaacactccctatgtcaccatcatgtaccatataatttgcatatttgtcctttatataaccctataatatgtttgtggccataaaatctgtgctgtcaaactgattaggaactgactaccacctgcaggtcagggccaaggttatggggtcccaggttcacctcctcagcttcctcctcctttggatctctggtaagagaaacacttcctctcctctgtgccaccaagtcccctgcatatccacaaaaataatatattttcataaggaattgattttcctcattctctgcaaatatgatgcatttgatttatgttttttactttgctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctcacagtgatacaccctgttacaaaaacctccaagttctctcagtgggattgcctcagctgctgctgaaaatgttcagaatgtggaactgggtggccctgtggtgtttataaggcttctccatgcccatgcaactcacttcctttttctttttgtttctgtagtttctgctgcccccatgctgtgcctgacacacttgatatggcaaaaaccaggacagcctttctcacgttgtccagctgtgccaacaatttcacttccaagcagaggtaaattctcatggccaactccctgtcttttgccacactcatcatttccacctccaagaaaaacaaaaccaaaaaccaaaatgcatctagcttagattccaaatagtagcattaaaggaaattgtccctccctataagcattctcaccctcatccacacagtcatcgtgactcttccctaacccactgagtgctcaccagtcctcttcagtcctccctccagtgatggggaaaagcgagtgatagttatgagagcaacatgtaacctgggtgcagactcttactagtcaggtttgcctcagatttcaagtatttatctttcttttattttccattttttttcttaattatatggatcagtaagatgtctcatttcttttttttaagttacttgttcttttaacacaattcaattctataattccaaatttaaagagataccctgtatgtctttggcatgtgttatatctggacaagttttgggttatccccttcatgccactgctcaaatcttacctgaaaccccacatatttttccaaaaacctgaaaactgtgtagcggttgaggaaattaaatttggcaaatcacaatacttgaggaaacatgtatctttttatcttcactctctaatgttcaggtgatgctgtttaattgagcatttgctatttagaatcacccctctgaaacttgtgggaaaacagcaccagcaaggcagtcttcatgttttgacctcattattcctggattatgctagccttcttgctattgttctactacagccactacctgaagaaacctcatgtaggattgtttcctaatgaaatattaagatttatctgcaattatccctaactctgcaaacttaactgacttctcaggttagtatttaatagccatcaaataaggagtggctgaaataatattaccaaggaaggaaataattggatcatagaaatgagggctttgtggttattgcatggtgaagaccaacaaaggccattgcaaccagtaataatatgcacaatgatgagctcgtagttaagagcaatttctgtcttagttttactgtcactgaactgggctggaaccctggagggcagggtagatgaatgataatcaaaaacatgatttcatatgttaagttctttggaaggctcaatttcggagatttctcccactttctataagagcagacatcaaagaatctgattctggaatctcgttttttctcttacagctctctttttttctactctaatctcttttccgcttccaaggacatacattgataaatatggtcaacagaatattaaggtgatgtcaatattagtgactaccctataagagggaacagaaacattcgtgtttgtaagcttttagtcctcacttaagcttctttcttgagtaatgtaatcgctccccttaatgtctggagcagacattagtaagaataataaatagtatgtttagtctcaaagatggtgaatacagaaagtggtcagaatgtgaacaacactattaagtatttagctaaaaataaaactattgagttttgtaaattcttatcaagtcttctctaagattgaagctccaggttttagtgaaaatcctgtccaggaaatattacattataatccctttctctctgttcccatctaccttaggctcatagtgacatgaaagcaaatttccatcctctgggaatatataaacccggattatttctttttatatagatgctctatcccttgcctgtgtgctattttcttactgagtcactaccttgcaccatgtacacaacccccagtggtttatgataggatgaacctattgaagcagctagcagagaaaaggttatttatgtgggtaactgtgtatgcttgttggacattccctgggtctctcacactgttaccacagcagcattataaaaacatcatctatctatctctctatctatcaattgatctatctgtcaatctatctattgtctatctccataaacacacaaacatactcacatttgtgtgtgtgtgtgtgtgtgtgtgtgtatgtatacagaagaaatgataaaagttatatatgtcttatgtcccaaactttagaaaggatatgtaacatgttagcaatctttgaacacacttgctggaatatagagtaaaatactttgttgctggtatatcaaactgtagtagataatccttctgatttccaaacagggtatacaaatgcacctttccaccagcaatgtatgagggtttctattgttctacatgtccaccaatacttggtattgtaaaactttttaatttaagcctttcttctacatgtgtagtagtatcactccataattacgatctgtgtttgtgggattatatatggattatatatgcttgtagggcatttgaccatcctctgggttaaaatttctgtcaaattctgcccattttactaatgcattttctgatttagttgaacagatatgtatgaaaatatatatataacatatgcgtgatatatatcagcgtgtatctgcctatcatccatccatctatctatccatcaatctgaatgtttgtgctctgccaaaattcatatgttgaaatcttaatctcaatatgttgatcaagattgagccttggcaggtaattaggctgttagggtaaagccctcatgaatggaattaatgtctttataagaagaagtgaagagaccagagggctagctagctctctgctcttagccacatgaggatgcaaggagaaggtcctctacaaacctggagtcgggcttcactatacaccagattggctggcaccttgatcttgaacttctcagcttccagaattgaaaaagtttctgctgtttaaccctgtccatcccccagtttatggtagtctgatatagcagcctgaactaacatctgtatctatatttatacaattatagatatagatagaaccagtattttttcgcatttgtctctgtctctggtttacctttttactcacttaagtctgtaaatggaatcattttcttaatttgtttttcagattgtttattgttattgtagaaatgcaacttttttattttctttcctgaaactatatttaatttatttattagttctaatattttttgataagttttttaaaaaaatttattttgttttaagttccaggatatatgtatggatgtacaggatgtgcaggtttgctacataggtaaacgtgtgccacggtggtttgctgcacctatcaacccatcacctaggtattaagccttatgtacataagctatttatcatgatgctcttcccctatcccccagtgtgtgttgtccctccctgtgtccatgcattctcattgtttagctcccacttgtaagtgaggacatgagatgtttggttttctgttcctgtgttagtttgctgaagacaatggcttccagctccatccatttccatgcaaaggacatgatctcattactttttatggctgtataatattccatcgtatatgtaccacgttttctttatccaatctatcattgatgggcatttgggtggattccatgtctttgctattatgaatagtgctgcaatgaatgtacataagcatgtatctttgtaatatgatgatttacattcctttgggtatatacccagtaattggattgctgggccaaatggtatttctggttctaggtctttgaggaattgccacactgtcttccacaatggtggaactaatttatattccaacagtttaaaagtgtttctatttctccacagcgtcaccagtgtctgctgtttcttgactttttaataattgccattctgactatcatgagatggtatctcactggggttttgatttgcatttatctaatgatcagtgatgttgggcttttcttcatatattttttggccacatatattttgagaagtgtctgttcctgtcatttgtccacttttaatggagttgtttgtttttttcttgtaaatttgtttaaattcctggtagattctggatattagacctttgtcagatggatagagtgcaaacattttctcccattctgtagttgtctgttcagtctgatgatagtttcttttgctgtacagaagctctttagtttaattaagtcacatttgtcaatttttgcttttgtttcaattgctttcgatgtttttgtcatgaaatatttttatctgggtatgctgaagaatagttttcctaaaagttatatattaataaacaaagagttagtgagagcactagaatcagagaatatatgtaagagtttgttcaaagcagggtcttaaattttagtctcattgcaaatttggattctattcctcttgaatggactactgaagagatataaagaccatgaggaagcacgaaaatatctgctttgctgcctcaaggatgtttaattgccccattgattctcttgggaaagaattctcccattgttgctcactgattctcaaagattagaagtaaaaataacttaggggatttgtgactaaagttcccatgcctagagatactgacctcctacgtggtgttgagtttaccttaattcttgaaggatgcttaactttgaagggaactctagctatatggctactttttcttatcattttaaggaaattttatggtctctgcttttcctgatttatgtttagaggttagctattaatcttattcttgtttcttcaaaatgagagaattttttctgattaagatttttttgtttgatcagtagatagtaaagtgtgacattatttatacaacgtaacactacacaacaaaaaagattaataaattgcaacaacttgaatttttacagtaaaattaaaatgacacatatctattacctaaaacacatctgagaagctaatttatagaaatagaagtatgcatgtgtaaagatataggtaaaattgtattaacaaatccattgattatattagcaaaacctgaacataatttaattgcccttcagtagaaatgtttgaataaagtataggttttctacacaatccaaaatgtgatgataaagaataggttatatttttcatctcttgatctggagataatctctttagaaatgttaaacataaattcccaaaaatgttaatttatgagccaatatttgaaaacatagaagcagaattatgaaaagtagtaatttgtcttttctatctttacaaatatggaatcattttacatcttgtggggttacaatgaagaaaaaaagcagttatgacaatgggaaaaatgtatgcgtaacatacagcaatgttcacagagatgaatgaagttatagtgacaaatgaaaaatgtaaaaggcaatttgatttatattgaatatatatatgtcaggaatatggaatgagaggagacaggtaaacacaataaaaactctgaccaatgcctgaaataaggatattacagaaataaaacaatgctatttaaacatctaaaaacagcataataatcaccagaattaaaaaagatcctgtagatgtgtgttcattcatagaaagatggaagtccctacattattattaatattttcaccatcagagaaatagggtgctactcagaaaaatattttttaaacaattgacctaaatcatatcaagtaatgagatatttcttgagtccaggcatgatcatgtaaatgcatgttggttaaatccttggacttgtaatgcacattacaactttcagaactcctctctgtttagcatttataggagaccttctgactacatcaaacttcatctaatcacattttacctgcactgagaacttttggtgggaagtgagatggaacgccatagtgtcattgcatattcagaccccaagagggagctgagagatcatgccttgaggaagtgattctgaaagagtccccacagtggaggattccagagctctgtgtgataacattgcctatccactgacccacgccctccccaaatgtgcaaagaaagtccagctgccagaagcccttatcagtgtgcagattccccataatcaacactcctttgcatccaccatatctgtaggggaagtgcagttccaggctcagctcctcaggtgtcttctacccaggtgaaagtccaaggtagatcagtcacaaaatcagtgcaattttaaaattgctttattaaagtacagtgtcaaaccatgaaaagcacctattttaagtgtgcaaatcactgacttatggtaaatttgcaaagttgcagataaccacagtttaatcttacaacattttaatcatcccctgaaggatcccttatgcagaccggcagctatttttatttccactcccagtctcaggcatgtattaatcgactttccctctattgattgcttgatatgaacattctatataaatggaataatgcatgcatggtcgtttctatctggtttctttccattaaacgaagtttaggttcatccctgttttagcatgtatcagtaggccattcctttttatttttggatagtattccgctgtacggatatatcacattttatttatctattcacaggttgaggaacattgaggtcctttgcactttttggttatatgatgatcaacaatgctgctatgaatatttgcctgtaagtctttgtgtggacaccggttttgatttttctcagacagacctctacaagtggaaatgctgagccatatgataaatttctgtttattttttaaaaactgccaaactgttttcaagagtgtgcagcatttaacacttgcaccaacagtgtatgaagccttcttttctgtcacattctcaccaacttttgttattgtctgttttttaaattattaaaatcattatagtgtatatggaatggtgcctattgtgaatttaatttgatttttgttaatgactaataatgttgagcaccttttcatgtgattactgtctgttcatatatcttcttccataacatctatactaaaatattttgttcatttttaaattgggttgtcttatgacttatatattctggaaatatggcgtgtatcagataaatggtttataaataatttctctggtctgtggtttgtcttttcattttcttaatggtatcctttgaaatgcaaatgttttgaacattaatgaaacctaatatattagcattttctttcataagttgagcttttgatgttgtaactaagaaatatttggtgaacccagaaatggaaaagttttaacctaaagtttttataatttcagattttaggaatgggcagaagctggaaacattccccttaaaaactgacacaagacaaggatgtcatctctcaccactccttttcaactgagtattggaagttctggccagggcaatcaggcaagaaaaagaaataaagtgcattcaaataggaagaaaggaagtcaaactatccctgtttgcagatgacatgatcctatatcttgaaaaccccatcatttcagccccaaagctttttaagctggataagcaactacggcaaagtctcaggatacaaaattaatgtgcaaaaatcactagcattcctatacaccattcatacattcctatacaccattcatacattcatacagcattcctatacaccaacaacagttattccgagagccaaatcacgaactcccattcacaattggcacagaaagaataaaatacctagaaatacagctgacaagggaagtgaaagatctctacaaggagaactacaaaccactactcaaagaaatcagaaacaacacagacaaatggaaaaacattccatattcactgataggagtaatcagtaacattaaatggtggctatactgtccaaagcaatttatagattcaatgctattcccattaaagtaccactgacattcttcataaaactagaaaaaaacaattttaaagttcatacggaacaacaacaacaaaaaagtcctgaataaccaaggcaatcgtaagcaaaaagaacaaagctggaggcatcacactacccaatttcaaattatgctacagggctacagttatcaaaaccacatggtactggtacaagaacagacacatagaccaatggaatagaatagagagcccagaaatatgtcctcacacctataaccatctgatctgtaataaagttaacaaaaacaaaaaatggggaaaggacttcctattcaataaatggtgctgggataactggctagccatgtgcagaagattgaaactggacgcctttccttaagccagatacaaaaatcaactcaagatggataaagtatttaaatttaaaacccaaaactataaaaaccctgaaagacaacctaggcaataccattcaggacacaggcacaggcaaagatttcatgacgaagatgccaaaagcaattgcaaccaaagcaaaaattgacaaatgggatctaattaaactaaagagcttctgcacaccaaaagaacctatcaacagaatgaatagatccctacagaatgagagaaaaatttttcaagctatgcatctgacaaaggtctaatatgcagcatctataaggaacttaaacaaatttacaagaaaacaatcaaccccattaaaaagtgggcaaaggatgtgaacagacacttctcaaaagaagacatacaagcagtcaatagtcatatgaaaaaaagctcaacatcactgatcattagagaaatgcaaatgaaaaccacaatgagataccatcgcacactagtcagaatggctgttatcaaaaagacaaaaaataacagatgctgatgaggttgtggagaaaaaggaatgcttatacaccattgatgggagtgtgaattagttcaaccattgtagaagagagtgtggtggttcctcaaagacttaaagtcagaaatacaatttgacccagcaatcccattactgggtatatactcaaaggaatgtaaatcattctattctaaaggctcatgtatgagtactttcattgcagcaccattcgcaatagcaaagacattgaatcaacccaaatgcccatcaatgatagactggataaagaaaatgtggtacatacacaccataggatactatgcaagcataaaaatggacgagatcatgtcctttgcagggacatggatggagctggaggccattatcttctgcaaactaacacaggaacagaaaaacaaacactgcatgttctcacttataaatgagagttaatgatgagaacacatggacacacaagggggaaaaacacacacttgggcctataggagggtggagggtgggagaagggagagaatcaggaaagataactaatggatactaggcttaatacctgggtgatgaaataatctgtacatcaaacccccatgacacatgtatacctatgtaacaaacctgaacatcctgcatatgcacccttgaacttaaaagttaaaaaataaaataagatctctgatctattttgatctagtgtgcatggcaagagatcagggcctaaattcgtcttttcacctatagataccaattgaaaatctatccttcctcccatttaatttcctaggcattattttaaaaaataacttaccaaaaatgtaaaggtttatttctagattctcaattccatcctactgatctataagttcatttttgtgccagcaccatcttgtcctggaaactgtagtttatagttgttctctgctttatagtataggcgatccttggacaacactgatataagctgtgcaggttcactcatacatggattttctgccacatctgaaataacaagaccaatctctcctctccctcctcctcagcctactcaatgtgaatacgataaggatgaagacatttataatgatccattttcacttaatgactagtaaacatatgttctcttctttataattttcttaaaaacattttcttttctctacattacttgattgtaaaatacagtatataatacatataacagtcaaaatatgagctaatcagctgtttatacaattggtaaggcctccagtctacaacaggctatcagtagttagatttttggggattcaaacattatacatacattttctattgtgcacggcgtctgtgcccttaactcccacattgttagagggtcaactgtacattttgaaactggaaattttatgccctccaacttcaattttcttgaaaaattgttttggttatttgaagtcttctgaattttcatataaattttagaatcagttcaccaaattctatagcctactgggattttgactcaaattgtgttgaatctgtagatcacactggagagaattatcatcttaataatactgaatcttccagtccatgaacatgaaatgtctcttcacttatttggatcttctttaatgtctctcagtaatgttttatagttttcagcatatctcttacttttttgttaaatatattcagaagtattttcttcttatcaatgtttgttcattgtctttatgctttattttcaagttagtgatccacagtagtcaatcttatttgtgtattctgtatttgtgaatttgcctgcctgctaaaatttaatacaatcccaaagtcaatacatagagtgcttttattctcatttgtggacatgcacagagtggcaaaaaaattgagccactgaacactcatgttcccaactgaggtttaacaaagccacactcttccatcttgtttcacttctcatactgtaaacaagtgtccttttgctcaattttgctctttatgttggtaattttgtggttataaatgttccccaaatataataatgctgaattgctgtttaatgttcctaagcacaagtctgccatgtgtcttacgaagaaaatatgtgtgttagataagctttgttcaggcacaagtcatagtgcttttggccatgagttcaatgttaataaatcgtgtgtgtatgtgtgtgtgtgtatgtgtgtgtgtataggaaaatgccttgttttattgcacttcactttgttgctctttgaagatactgttttttacaaattgaaggtttgtaacagccttgggttaagcaggtctatcatcaccattttcccaaaagaatatgttcactttgtgtctctgtatcacgttttgctaattttcacaatattttaaatttttcattattatatctgttagggtgatctgtatttagtgatctttgatgttactattataattgctttggggaaccacaaaacacacaaaccacacttactcgataaatgtatgtgtggtgactgctccagtaactggccgttccttgttttcctcttgtcgggcctccctatttcctgagacacgataatatgaagattaggctaattaagaactttataatgatctgtaagtgttaaagtgaaagaaagtcacatgtctctcactatcaatcaaaagctaggaatgattaggcttagtgagcaaagcatgtcaaaagcttagatagaccaaaagctagacctctcgccccagttagccaagttgtgaatgcgaagaaaaagttcttgaagaaagttaacagtgctactccagtgaacacatcacaaatgtctaaaaagcaacatagccttattgctgatatggagacagttttagtgatctggatagaagctcaaaccagccacaacattcccttaatccaaagcctaatccagaggaaggcccaaactcatagaatttatgaaggctgaaagagatgaggaagctgcggaagaaaactttgaagcagcagaagttggttcatgatgtttaaagaaaaaaagccatctccatgacatacaagtggaaggtgaagcagcaaagtgctgatggagaacctgcagcaagttatctagaagatctagctagaagtattaatgaaagtggctacacttaacaacagattttcaatgtagatgaaacagtcttatgttggaagatgatgccatctaagactttcatagctagagaggttcctggcttaaaagtttccaaggacaggcagactctgttattaagataatgcagctgatgacctatgttaagtcgaagccaatgctcatttaccattctgaaaatcctagggcccttaagaattatactaagtctatttttcctgtgctgtatacatggaaccacaaaacctagatgacagcacatccgtttagagcatggtttaccaaatatttgttgagacctactgctcagtaaaaaaagatttctttcaaatattactgctcattgatttacaatgcacctagtcactgaagggctctgaaggagatacacaaggagatgaatgttgttttcatgcctgctaacacaacattaattcttcagctcatgcatcaaagagtaattttgacttccaagctttattgcttaaaaaatacatttcataaggctagaactgctgtagatagtgattcctctgatagatctgggcgaagtaaattaaaaaccttctggaaaggagtcactattttagatgccattaagaaaatttgtgattcatgggagctggccaaaagatcagtattaacagaagtttgaaaaaagttgattccaaccctcatggatgatttcgaggggttcaagacttcagtggagtaagtaaatgaagatgtgtaaaattaaaagagaactagaattagaagtataactatgtaacaaacctgcatgttctgcacatgtgtcccatttttaagaagaaataaagaaaaagaaaagaagcggagcttgaagatgtaactgaattgctgcaatatgacagtaaaacattaatggatgaggagttacttcatacggatgagcaaataaaatagtttcttgagatggaatctactgctgtgaagatgctgtgagcaaggttacaatgacaacaaaggatttataatagtataaaaaaatttagttgataaagcagcagtagggctcgaggattgactccaattttgaaggaagtactactatgggtaaagtgctatcaaaaagtatgtcatgctacagagaaacctttaattaaaggaagattcaatcaatgcggaaaactttattgctgtcttattttaagaaattgccacaatctccccaactatcaacaaccaccaccctaatcagccagtagccaacagcattgagataaaattctcaaccagcaaaaagattactcactgaaggctcagatgattattaccattttttagtaatgaagtattttaaatgatgtacattgtttttaaaacgtaatgctattgcacacttaatagactacagtatagtataaacataacttttatatatatgcagaaacccaaaagtttgtgtgattcactttattgtgatatttgctttattgcagtggtctggaaccaaatctacaggtatgcctatatgtatatgcctatatttaagactttatgagatatatataatctgtttaagatactcatacaaaaagttacctattgatcagttaatgaaaatgtgaccataggctcataggaacataaaccagtactaccactaggaccaatggttcaatatttgttaattcagcgtttgtgactttacagatatctgttgaaacataacaaaatgtaactgtacatggagataaaatttatttctgcatattgcatatcttattgtgtgactttgccaaagttgtttattactagtagattgtatgtgtagtggtgggggacatgtattccttatcatttaatatacatacaggattatattttctgtaattaaaatacttttactcttcttttaaatattgatatactttatttttcatttttttcttgcttgattgcttgacaagaacatccagtgcagtgttgaattgagtagcaagagtgaatatccttgtcttgtttatgacattagaaagaaggcattctgtcaactttaagtagatgttaactgtaagtttttcatatatatcctttataaggtaaaggaagtttccttctattacaagtttgttgagagcttttgtcataaaagagttttgaattttatcaaatatctttctccgtttattgagatgattacattttttatatttactctatgtggcatattactttattgattttcagatgttaatctatcttgcattgtttaataaatcccatttgtattatggtgcataatcatttctatatgctactggattctatttagttatatcttttgataattttttcacatgcattagtaggggatattggtctatggttttctttccttggaatgtctttgcttggctttggtattggggtaacactggcttcatagaatgagttgggaagtattcttttctcctatgtatactgaaagaatttaatgaagattggtaatatttattctttaaattcttgatagaactcaccagtgacgccatgtagtctcagtttttctttattggaaactttttaatttcttcacttgttatggttctattcatattttctatttgtttttgaattagttttgggttatctcatctaaattgcctaatttaatgacttattattgttcatcatattctcttacagtatttttaaagtttctgtaggataggcagttgtaccccttatttcaatcctgattttaataatcttggccttctctttttttcttcaagagtcataaagatttttaattttgccaatctttccagaaacacaacttttgctttcaatgattttcgtcttttacttcattgatttatactctatttttaaaattattttcttccttctgcttgctgtgaatctcgctggttcttctttttctagtctcttaaaatagaaactaccccattggtttttagatattctttctttctttactatacaggtaattacaggccaatatttataaaattatttatttatttcaaatcttccactctatagatgaaaccttcaccacttcgtcactcaggaagcaacaggagaaacatgagaagctgggatgaaaacaccattttgaggaatctgtttgtctgatgctggtcagaacctattaccagaggaagcttccttatttaatccccttaggacaggggccatttgagagaaagagaataaaaacaaacaaaacacttaggcaatatgacagttttagtggacaaccctaggttggccccatgatacagaaccactggtgttcctaactgtgtaattccctcttcttgagtctgggcagaatttttgacttccttctagcatacacaatattgcaaaggtgaaagtattttgcagatgcagtagtcccaaatcagttgggtttgagttaatcataagggagattattgtgagtggatctgacttaagcaggtcaaagccattaaaagaggaactgagctctccttgttaccaagaaattatcctagctggtttgattattagtagcccatgtggcaggaaacttaagatgttctctaggagcttagggtgatctccagccaacagccagcaaaaagccaggaccctcagccttagagttactatgaaaacaattctgtcaacaacttgaatgatcatggaagcagactctttaagtccctggatgagaatgcagcctggtcaacaccttgactgcagcctgtgagaccttgaagagaggacccagataaactctgcccaggctcccgactcatagaaactgcatgtgaattataaacgtgtattattttaagccactaagtgtgtgataatttgcatgggccaacagccaactaataataaaattttatatgtagtgagatagggttacaagggttacaaatttagaaaccaatgtaaatcttattagactgaaatgctgcaaaagcctattttgccagagtttctctgcttgctttgtggaggatgcagaagactgacggaggccaaggtagggatggaggggcacataatcactaatctttccatgattgtgactatgcacacctgcatttctggagtccactctgcctgtagtgttagagcaattagaaaagcaaaaagagaagatgagaaaaaaaaccttaacaatggacatggaaaatatcatagaaaaaggacatgacctgtaatcccagcactttgggaggccaaggcaggtggatcatgaggtcaggagttcgtgaccaggctggccaacatggtgaaaccccatctctactaaaaatacagaaattagctgggcgtggtggcaggcacctgtaatcccagctacttgagacattgaggcaggagaatcacttcaacctgggaggtggagactgccgtgagccaagattgtgccattgccctccagcctgggtgacagagtgagactctgtttaaaaaaaaaaaaaaagaaaagaaaaaggacatgaacactgcatgaagagtaaaggacaatttattaaaactagagctgagaatctaacttttgggaaagtcaccgagatagagacatctaaattaaataagcagagataactacctcacaagtcttaggtttctaaataactagaaaagccttttcatgtgggttcagcaaataaaagtggagaaaagtcaaaattcaggtgagaaggtcacctatatctgaaagatatagagctaataattttgactattcagagcattttttaaaatgactacaaagttttcttaatgtttaaaattcttctattggtaagggtctttgacataaaaaatatacattgagaagtagaaaacttctgagaggtcctgatacagtaaagaaattattaaattataaaactggctgtgacacacatgcatgcacacacacacacacacatcaatttaaggattttctctttgataatttgacccctttgttcaaacaagcctatgacagcaggctgatggacctgcataaaaagccacatctgagggatttgagcctcagggagcagctgcctggggaggtttttgtttagacctaaagcactgtgggaggaaaattcttactctgcagacagtaataatttgcagtatcattagcttccacaggattaattgtgagggtgaaatcggtcccagacccactgccgctgaacctggctgggaccccagtgtctttattggatgcttggtaaatcaggagtttaggaggttgtcctggtttctgctgataccagtgaattaagtttattcccaagaaactgacactctcactggctctgcaggtgatggtggccctctgtcctggagacacggccaaggaggctggagactgggtcagcacaatgtccccattgcagcctgaaatgataaagacagataaattatatcagatatactgagactgtccccatgtaggcccatgcattggtgacacttgtaaccacagtcatatgcaacatcttgagtaaccagaaaacaaaagataactggggaacttacaacctacaatgagtgccctaaatccaacaaccaagaatccagagacacaaaaaacaatgatggccacatgagtttgcccgatgtttccctataccccctcacttggagcccagagcaggaggatccacagcaaaggagccccggaccctatctctgagagctgaactagaggctgctcctcaggggccctgacaagctgtctttaaggatgctctgagaagcttggaccgttgtctaatggcccaacatgcaaatcagctcagaaaagtttgagttgatgctcaaaggggacacctgctcttatttcacccagtgggagttggggctaacaaaacatttcctagggtagctcaagcatgtcccaagggatttggtgaccttttctattggatctttgcctgccagtctacttgagatgccatgtggaggagtgtactggggctgccctgccatttggatataagttatttcagaaatacttttgatttttcaaaattcatattttatatcattatcaataataatgcattttaagttatcattgtcagaaagagaaagcaagttgggtgggttttatgaaactggttcatatgggaaggagaagtttgttccactgagtaagtggtatttaaaacaagtctataaatgttatcatgatctggaaaggatgaagggggtgagcatgaaaccttgatgaagactggtaacctaaactaatcaaggaacttgcctcattgtggataaggcagggtctctccatctgcttagtcctgaaaccaatgctgtatccaccagaggccctcagaggcagaagagtcattgtagtggatcctattcagagtggagaataaccatcccccaactcccactggttccatctgccttgccactggaagctggggctaaggaagtccatcttctcctacagcaagatatggtgtccacaccagtcagctggcactctcacccatccataggtgaaggttttcccccaacaaaaccaacttaaaatgtctggaagaagggactgcatcttcaaatgtgcagacaccaacacaaggctacaaggaacatgaaaagtcagggaacatgatgccaaccatcacttctctatgagctccactccaggactctattctgttacttgtgatggagttcagggccagagaggtcccactatactgcttccaactgtgcgcttgggtccctgattactcagttatatttttcattgatgttaacatgcatattagctctagttaactaaaagttttcttttatcactctgggaattgtttttatgcttttaaatttttattttatttgatttcaactaaaataaactagtggcttcccaaaggatctaggtagaactaaaataatggtctttctacaccttaaatctacatttttataaacagctgaaaatgaacagctgagaattacagctacaccttagggcaaaggagatgaagagcgggaacttagattagtgtggtgagtttgagtggaaagtactataccctcttgtttttcctaaatgattaaattctgcttacctagctctattcccctagaagaaagcaggaataatggaatttgagtattccttgaaaaaacaaagaacattttcaagaaatttaagaagttttcaaactttaacctttcagatgtctagtagatatctctggaaaacagggcaagcatcaatttgtggattgagaagaaagataaaatatttcagaggagccaatatgccatgagaaaagtcctgaaaaactccccctgaacccttggaacttttgtgccatgattagggttgggacaatccctgagctttgccccctcctacaactctgggtggaggaggacagaagtagaggtgggaagtaaaaggggtgaaatttgcatttttttattaggccacctagatgaccgatcattaagaaggctctagaaaatagagacaaacttgaccactttaagttgttcactgtcccatcctctgtcttctactctttctccagcaaccaagtgataactactacacacaacctgcaaggatacagtcctcagactcagatctggggtggaggtagggaaggtaataataaaatgcacccacatgtgtttggagcaatcaagaaatattgaactataccatattttggcaaataaaagacttgggtaaagcaaccccatcaaggataagtaatttgaaatgaaataatactgaaaattacaaatataccatgggagagggctatatgactgacaaaaatacatagcaagtaaataataaattagataactcttctgaaaatgatgtactctagtaaaacaaaagtattttctgcagcaaatgattgtaaatttagaagacacaccaaaaaaaaaaaaaaaaaagaaaaacacttaaatttattttcaaggatgagatagcaagaaaataataggtaaaataaatgtgtctggttacaggtacaggattaaaaaagtaaagcagaactagtaattttaacatagaaaaaatgtaataaggcaaagaaataaatggagtcaaagacacataaggtaagcttagtaaagggataaagttcagaaaaaaaggcaaaaaaaattacagataattatagaaaggatagaaaataggcacccaatatacatggataattgatgtgttttaattatggaatttaataaaatggcatatgaaataaaatgtaataacataatgaccagaatgtcaatatgtttaagtgaagatatgttaaaacaccccaccataacatatatgtgaattacatatttattaaatacagaaatattaaaagataaatctataacaaagaatttatatgaatatatatctgactttgtatttaaagagactatttataagccagaagaaaaaggaattctaaaagaaacaaaaaaatataaaaagaaagcaacagaagcctaatataaagtttctaagtagaagttttaaatcaatgtcaaacacaaaattatacactgaagaaaatcaatacatgtaaaaataaaagtaaactataacaatcaaagacatctcacaaaatgatgaagaaagcaaatttaaattagaaaaataatccataaaatgaaaaattaataaattggacctcatctaaattgaagtttttgatctgaaaaaaaatctctattaaagggatgtaataaattgaaagtggacttgtgtaatttagcaaatgaactcttgagcaattatctcagagaaataaaacattattatacagaaacttgtacacaaatgttcacagaagctttatttatagtagctaaatcaaggaaattacccaaatgtctttcagtaagtaaacagttaaataaactggggtaatccgtattatagaatacattcagaaataaaaagcaataaacaattgatatacccaactttgatgagcctgaagggtattacgccagtgaaataagccaatctcgaaatggtacttattgcatgatgtcttttatgtggtgtttgccaagggttaaggatggggtagagaaggtgagtgcggctataaaagggtaacaccaggagtcgtgtggtgatgatttagctgaatttcttgattacagtggtggttatagaaggtcacataaatgattcattcacatcgagctacacacacataaacacaatcacataaacaaacaaaaattgtgtgcgtgcgtaacttgtgaaaactgaataagttctatggatgacaccaatgttaatttcctgtctttggtattgtactatagtttgaaagatgtcaacactggaggaagttgccaagatgtatgagacttctgtatatttctttgcaacttcctgtgaacctataactatgttatagttaaaaaataaaaagtaaaaaaaatcttaagctttattacttgaaaaccttgaaaaaaatgaattgccctttttctatcaaatgattggcaaaaaaacttaaagccttatgcctccctctgctggtgggaatggagagggattgaaaagccatactttggtggttgcaatgtggatttctactgtttcctaagtaatctctgctcactattggagtgaaatttaaaatacgtacacttgttggcccaaacttactactaagaaaattgcctatagaactaataactccgtgttgtctaaggaaacatctgaatgcctatcagtaagagatggctaaatatattgtgctattttcatattatgaaaaattatggctgcctctgcctctgcccctctgcccctctgcccctctgcccctctgcctctctgcctctgcctctctgcctctgcctctctgcctctctgcctctctgcctctctgcctcactgcctctgcctctgcctctgcctctgcctctgcctctcgctctccctctctgtacggtgtccctctgatgcccagccgaggctggactgtactgccgccatctcggctcactgcaacctccctgcctgattctcctgcctcagcctgcctagtgcctgggattgcaggcgcgcgccgccacgcctgactggttttcgtattttttggtggagacggggtttcaccgtgttggccgggctggtctccagctcctgaccacgagtgatctgccagcctcggcctcctgaggtgccaggattgcagccggagtctcgctcactcagtgctcaatgttgcccaggctggagtgcagtggcatgatctcggctggctacaacctccacctcccagccgcctgccttggcctcccaaagtgccgagattgcagcctctgcccggctgccaccacgtctaggaagtgaggagcgtctctgcctggccgcccatcatctgggatgtgaggagccccctctgcctggccgcccagtctgggaagtgaggagcgcctcttcccggccgtcatcctgtctaggaagtgaggagtctctgctcggccgcccattgtctgggatgtggggagcgcctctgccccgccgccccatctgagatgtaaagagctcctctgcccggccgtgaccccgtctgggaactgaggagtgtctctgccccgccgccaccccgtctgggaggtgaggagcgtctctgaccggccgccccgtctaagtgaggagcccctccgcccggtagccgcccagtctgggaagtgaggagagtctccgccctgcagctgccccgtccgggaggtggggggcagcccccgcccggccagccgccccgtctgggaggtggggggcgcctctgcccggccgccaccccgtctgggaggtgtacccaacagctcattgagaacgggccatgatgatgatggcagttttgtcgaatagagaagggggaaatgtggggaaaagaaagagagatcagattgttactgtgtctgtgtagaaagaagtagacatagaagactccattttgttctgtactaagaaaaattcttctgccttgaaaaaaaaaaaacagaaaaattatgcaatttttgaaagaaagggttaatttcatacaattgatctgtttattatacaatatcaagtgtaaaagcagaaatacaaaaatgtttttataacacgtaatccagtgtttgagaacctacaataataaccacagaactatagcatacacaatatagtaaatttttttcatatattaaatatgattcacgtttcttggggtgactatagttttctcactaatagaagaacagtaagttgattaaaccaaaaatcatgacacaattatatagggaggaagtcagagcactctgttcttaagctctgctctagggagaaactatttaaccagcctaatgtgctatatacagttttattattatctaactgactggggaaagagaaatactcaactccatccagcactagcatccagtcccacctacatgggtggagaaagaagcaaagagacacttgtgatgtttacagtccacagacataagctcactaaagcactgaaccctaagcatagaagtatagaatgtttctcttcccctacaccttacccccatattattaaaggcctatttctagcacttcccttcacccaatatattttatctggctatcaagtaaaaattataaggcataataaaaggcaaaaagacatggtttgaagataacaagcaagcttcggaaccagacatggcagggatgttgtaatttttaatagaggagcaatgtaaactgaaagatgaagatcccaagaaaaagcaaaaaaaagaaaatgctagagattaaaaaacaaaactaaacagaacactgtaacagaaaggactgggtatggctggaaaaacaaagtctgatcttgagagtatattaatagaaatctccaaaactgaagagaaaagagaataaagactgaaaaccaaaggcccaagaactgtgagacatatacaaaaggtgttacattgtttaactctttttctctttagaaaaaaaaaaaagtgcagtttgctgccagcattcatataattttacataaacacactctttgaggctgaagcaaatctgactgattttcaatgtgaaataaaatataaaatccgttcttggaattatttctaaacagaacttgtctctaatcctaatataacagaaatgtatatgataatcagtatttaataattttttgtgtggtaaatttcaaagcacagaacaacataaagcggaatatcacattccacacaaaaatatcacgtttctcttcagattgtcttgctaggctcgtctttgcacaagcagcaaactttgcagtgaccagttggatttcgctcccctgatgttggtgatatctcttggggaaaggtcttccatacaggtgaagaggtatgacatcttcagagcaaggatgacctggaagactttgctgccctggcctgtgatgctttaagagcattttttcaatcaacgtcagtctgaagtttatatggctaattgtgtgctcaggattgtccttcttgaacagggtgtagaggttcattcagcactgtaatgtttagaaggtggtgaaagaatttcttagaccgaatcttgtgccctttgaagaagtgagcatcaaatcagctgagtccactgctcccatcttctcactatagtccacagtggcatatgacttcttagttttctctccatttctgttgtctacttcaatcacagtatcattgtggaatgttgaccacattctcaccttcttctttttgaggtaaacactgtagctgcaagtgctgccagcaagtattcttgggcaaaaggtaaatgggttaatggacatgaagaaaaaggaggaggacggggtggaggcgtggtaaacaaaaccatattgagtgaaaatttttctaaattaatgtcagatatcgaaccacagatccaagaagatcaggaaacaccaagcagtataactgccaaaataagcaaataagcaaaacaaacaaacaaacaaaaacaaaaaacacttgagcatataatttttaaactataggaagtcaaaaacaaagaaaaagtattgaaaaggagacagagagagagagagagcatgaacataagagaaacaaacctttcatgtagaggagcaaatataaatattgcatccaacttcttctgtgaaacaggaagcattcttcacttcaatgcaagcaagaggagagtagagtgaagtatgtcgtgttgagagaagaaaaccaccaacctaggattctgttttctatgaaatcatccttcaaaaggaaatgataaatgatggctttctcagacaaacaaaaattcagaaaaatttgttgccagtaaacatgctttgtaataaatagaaaaagaaaagttcttttgagagaaggaatatagtataggtcagaaatttgaatttacataaaagaagagcatcaagaagaaataagtgagggaaaaattaaggaacatatttttcttattcttaactgatataatttttttcaaaataatagtaatgtgattattatgcatgctgatgtatacatttacatatataaatacacacgtatgcacatatatgcatacttatttatacttacatataagtgaaatgaatgacaataatgcaacaaatggaaaaaattaggaatactttgttattatcaggtactcacatgacctatgaaatggtataggagtatttgaaagtaggcttggattagttgtaaatgtatattgaaaacttcagagcaacactaaaagaggttaaaaaatctaatatgctaataaaggagagaaaatagaagcgcataagatgctaaattaaaaccataaaaaagcagaaacaagtagaagataaacatagaaaaaaaacacaccaaacaataaatcgaaaacagtgaaagtgtggtagacattaatccaaggcattgataattagttggagcatcaagtgtctaaatgtacaaattaaaagatatgttattagagtgtatcaaaaaggaagattcaactatatggtgtctataagaaacctaattaaaatattaaagcacatatagattgaaaagtatatgaatggagaaagatataccatgctaatattaatcaaaagaaagcacaagtagctatattaattttggaaaagaagatctcaaagcaaggaaatttatcatggacagaaagagcattacatatgaaaaaggggccaattcttcaagaagacaaagcagtgcttaacatatgcgagcttaacagcagactgtcaaaataaatgtggcaaaaactgatagaactacaagaaggtacagctgagtccacgattacagttaaagactttaacacttcactatcagaaatgggtagatccagcgggctgaaaacccataaaaacagtcaaactcaacaacactatcaatgaactatgtataattgccatgtgtacactattttgtccaaacacatattttttcaagatcacatggaatattctctgtgataaacttaatgccaggtcataaaacacacagtaacgtattttaaaaaaatagaaatcattcagtgccttctctcaaaccacaatggtattaaaatacaaatcaataccaaaatgtagacaatacccaaatatgtggagattaaacagcacacttccaaataacaaaagagttaaagaagaaatctcaggagaaatttaagaagattttgaactaaatggaaataaaaacatgactcatcaatatttgtggaatacagcgaaagaggtgctgagagggaaatttatattatcaaatgtataaattagaaagaagaaaaatctaaaatcaataatctaagctttcactgtatgaaagtagaaaaagaagataaaattaaatctaaattaggcagaagaaaggaaataaatattagagcagatatcaaaaaaattgaaagcaggaagtcaacagaaaaaaaaacattaaaagctaatactataaaaatacaaataacattgataagcctcaagccaagctaaggaaacacagaaagcacacacattgctaacagcagaactgaaagaggggacatcactacagatcctatgaagcttaaaaggatactgtacgactattataaacaatgctatgatccaaacttgataactttgatgaaatggatgaagtccttgaaagaagcaatctaccaaaactaactaaaagaaatagacagtataaactgccctatatatattttatatatttaataaactgaataaataactaacaacctttttaaaaataaagcaccagattcagatggattcaatggtgaattctaccaaatatatgaggaagaaattcttcaaattctccatctatttcacaagatagaagcaaagggcatacctcctaagtcattctgtgagggaaatactagtctactaacagaaccaggcaaagacattacaagaaaatagaactacaaatatttctcatgaacatagatgcaaaaatcctccaaaaagtattagcaaatcgactatgacaatgtataaaaaaacactatacagtatagtatgccaagttggatttatgctaggtatgaaaggctgattcagtagtcaaaaattaattgatttaatccaatgttaattcttgtgcatccaacacaattgagtatccagagaatgggatattatttatagcctaaataaacaagctatcaaaccacgaaagaacatggaggaaatttaaatgcatattactaagtgaaaaagtcaatctgagaagactgcatattatattatttcaactatatgatgttctgtaaaagacaaaatcatagagacagtgaaaggatcagtggtagttagggatttgggagggtgggggatgaatgggggaggtgaacagagaatttttagggcagtgaaactgttatgtctgatactacaaagatggatatttcctattatacatttttcaaaacctataacatgtatgacatcataagtgaaccctaatgtaaactaagaagccctaatctaaactctgggtgataatgttgtgtcaatgtaggttcactatggtgggggatgttgataactggggaagctttgcctgtgtcagagaaagatacgagaatctgcactttcttctcaattttgctgtgaacccaaaactactctaaaaatgagctctttaaaaacataacttcctcccctgcccggccagccgccccgtccgggaggtggggggcagcccccgcccggcagccacccagtctgggaggtggggggcgcctccgcccggccgccccatctgggaagtgaggagcccctctgcccggctgccaccccgtctgggaggcctaccgaacagctcattgagaaccggccatgatgacgatggcggttttgtcgaatagaaaggggggaaatgtggggagaagagggagagatcggtttgttactgtgtctgtgtggaaggaggtagacattagagactccattttgttctgtactaggaaaaattcttctgccttgggatgctgttaatctataaccttacccccaaccccgtgctctctgaaacatgtgctgtgtccactcagggttaaaatgattaagggcggtgcaagatgtgctttgttaaacagatgcttgaaggcagcatgctcgttaagagtcatcaccactccctaatctcaaatacccagggacacaaacactgtggaaggccgcagggtcctctgcctaggaaaaccagagacctttgttcacatgtttatctgctgaccttccctccactattgtcctatgaccctgccaaatccccctctctgagaaacacccaagaatgatcaataaatactaaaaaaattaaaaaacaaaaaaacaagaaaaacataacttcttaaaaaataattagttatttccactatctaatacagcaacttgaattgtgggagaatgagtaacagtgaaagatttgtcatattttcttttattataaatcaattattaaaaatattattcttacaaaataatcttttttgaatttcagagtattgctattgccagtaaaagttaatgataaacctttaaaaagtctgccttgtaattggttattttgtctcaaaatctgttgcccttaagtatccagaccatgtaaacttttgtaagaattcttctttcatcagaaaaaggctttgaaattttcttatactatctgggagtataatattcttaattctaaatgggaacctcccctttctgtatgttaacataccgtgccaaaatgttgacaacagcagctagagtggatcactccacactggacaaagataagaattgataaagtttgtaagaacagcctatgtttagatctaggtgggaagcaggccactgtgtgtctccaatcttggtcacattcaactgcatgaggacagacttatataggtcagttttcttgtagttcaactttcttgccaaatcctgtttgggggtccataagtgtaaaagcacatgtaatatatatacatatataatatgtatgtgtgtgtgtaataatatatatattacatgtatacatgtatatatacatgtaatatatataccttatatatattctctctctctctctctctctctctctctctctctctatatatatatatatatatatatatatatatatgacttgggaaagaggagtcttggaagtggaattgcttgtgtccattaagctggattcagtgttcgtagggtggagtttgaccctatttgtaggggatttgggggcttatcaaggaaaaagaggtgaccacagagtagcagtagcacacacatttattgggtgaaactttgaggggctcacagggacaagtccttcacagcaggagtctttgcagatgtgaaggtgccaggttgctattcagaaaggaagggaaacaagaaaacacctgaggaaagggacactggagaaaggggcttatgtgtctaggtgatgtcacacagcagcatgatggagagcctctgggttagaaagctcaagaggacagttgcagtttgggggttttattgcctgaatcttactttatttattggcagcaggtgaggtttcctggcatatgcaaagcaagcagtgtctaaatggcaaaataataataataataaaatttgagggctatttttgaaataattagttgtgtaaaatttgaacttgatgatagtagtttaaaaataaacctgcagtttagcaatacacaactttgagggcagtaaacagagctttgattcatttatataacactgttgcacatcctataatgtttgttctgttgactttatcaacccaaactgtccaaacctataatgctttgcactagaatacatacccagatgtgtggttccttcccatacccaaatggaggttccttatggcattgattgtggtgatggattcatgggtgtgtactaattttcaaactcatgaaattgtgtacattaaatatgtacaattttttggtatgtcaattatctcaataaaatggttttaaaaatctcaactagcagagggatattccccaaatgcagattgtctagagtggattcctggcttcaagacacttgtaatgaaagctggttgtctcttctaaataactataaattgtcacccagaagaagtaaaattcatggctaaccattctgttttacaggttcagagcaggctttgtggatgtgtttatcctccgaatttatatattctctctaaacactgggagacgttagtatgtttacatgtctgacttctctgggttgtcaagatcccatttttgatctacctaatatgaatttgtatccaaatgtttaaattcttttctttccttttacttgaagtaaatactaaaaaatcctacagagatactcaacccaaccataaaaatgagtttgagaatcatgtgttggcgatgaaggctttttatctgtaaatgctaaactttctgctgagcccagctcacccatggactaactggataaagtgagacaataattccattgtctacctgagcattccccaccttaaaatttttaactgcctctaacatctctgctctaggcttactcttgaagacagggtcctctatcttgaaaagaagtttttctcaaaagccagagcttgtttaataattttcagtttttttaatgtgagatttgtctattccaccttgtaagaaaatttgatttgccagacaaatgaaaagtggaaaactcaagaagagtttagagatagaatcaaggacaatagcattttaaactgtgggtacatctgtctttgaaataatttgtataaatatacggaaatgacaaagtaaataatttttttgtatttttaatttagataagatagtttacttgcagaaaaatggagactatgaacctggaattctcaaattcaatgttttttcttccggtttaaataatttcaagaatctataaaatacttacataaactttaaatacagaaattttaagagcttcagaaaaaatcgaccaaattaaatcccttacactagtttctgaaatcaaccaaaattgtgttttaactactgtgttttatttccaatgaacaacaatcaaaaacattagataaagtaagatgcaataggtgaatgaattgtttggtggtcactcttagttataatgagataataatgagacaatatcttcatcagaaagtggaaatggtgactttctgccttaagggagcaggggactcacagttgtaaacttcccctccgtcttgatctttcttgtgcaggagccgagggtaatccactgtttcagtggtctttgagcagcaacagtcctcatctttctgtaattctagaaatgctcatactgggctcttctaaaacactttttatgctaaatagaaaaataaagatcagtaataaaataaaaagaaataaaataaaataacttatgaactcctggaagtagttgtgggataaaattataaagtttaacaaaaaactagaacctagaacaacttactaaaaactaatttagtcaaattttactcttattttgtattcttgccctcacaaattaggaattttctcaacccaaagaatgattgcctttcttatattctggaatcttaacagccataggagaaatttgaaactatgagaatttatactaaccagttatcctaggaaatctggttacacaaaaattaactatttagagtaaaataaaaggaaaaatttgttgatcccatggaaataattaactgaatatttgctggtcaataaagctaatcctaagtatgcccctaaataacagcgacatcgttgtttctggattaatgctaagttttcaagatccattaaaagtaatttgccttggattcagactcatagtattggtcataactgtaattcaactaccaccagaacttgtagaagacaacaacaaaaaagaaggggtaatgagaaatatgttatgaaatgtatcccaatgttaacatttatgaaggagagggaggtgttttatgaatatctattctcatagcactgatatcttcaatttgataagcaaatacaaatctttaaaccagaatttggaacagggtaaatatggctctcatgaatttgacttgactgcgtcctggggttgtattgacataaggactagatggaggtacatacagcagaagtaatgaaaattataatgtcaaattttagagcctcctaactaaagcactagctcagatactgtataaagatgaaaaaaaagttatgtgaaaatgccctggaactgtttctggactgcctagtaacatcctggctgtggttggatggctgatttaccccagctggaagtatcagtattgtacagctgaaatttgtgggcactctcctctgcagttgtcaccaaatggcttatacttttattttcaaaatccacttgcaattctaagagctctccttttctctcacaaaaggcagttgaggcaaatcaaagacttttgggataaaatgttatctccactatgaattgacaaagtctatttagatgtttgcaaactaaacattttcactaattgctgtgagtcacactccccctgagtatagcttgtgtagaatgcaatcacaggtatgtaagtggaggtttggtataaccactaatggagaggtaggaagttagaaagtgggaaaataccaatttctgaatattaccaaacgttatcgtgttaaaaatataacaaaacctgctaatcctaacatatacccaacctttgtagccatgagtaggcctcaattttcttgctgttatgctgactaaatctcattgacaaatgcaggaaacacagggaggatcagaatgcactttccaggtagctctctcttctgtcatgtctagttgctcagagagcactttgatcaccttcattcttctgcttgagccatgtgaaataaggctgttacagtgatggggccagaacagtctggatcttcctgcaaattattccctgcagtcatctaacatctacctgtgaagccaactcagaatctgccatgcagacagtccacgtgcaaacacttgtggatggctgggccatcccaagtagggaggtttgtgttcagggttttaccactgtgtgaggaccttgcagaccctgttcacagcaataaaccccaacatcctcagcctccactttgctgaatttaagtgtgaaacctgtccctgacctgctgccactgaacttgtttgggactccatagaatttgttagaaattgtgtagataagaagctgtggagactggcctggcttctgcaggtaccaatccaaataggtgtttccatcactatgcaggaggctctgactagacctgcaggagatggaggccggctctcccagagggatgggcagggagagcagatgctgggtcatcacaatatccccactggatcctaaaataataacagtgagaagtacaaggttacatacaaacaatgtgagacatttttataatttagttttattgtatacgttaggctacttttttgtgtttgattagattcatacactacatttatccaatatccaaaaataatccaataattaaaggcacaaagtggcctctttgtttttgaagttctcgacagtgaagttctttttccttgtggctcgttcttagttcttacaggtctgaatattaaattccctttgctggaggacaagaaatctgcatctgacatgtagacagaacaacaaatgggaggctgcagattccacagagctcaccctccagtcccattctcctctcttctgtccttaccagggacccagagcattagcagccccaggagctgagcagggagcctcactgtgagaaggtgaactgaggagtcctgatcagtcaaggcaaggttagagctgagcttttatctcagactcacaagggaaggtcttccctaggggacaacatgcaaatcccctggtgagtgaagcagtgaagaaatatccagttggggtcgaagagtgggcttcttatgtaagcaaagtgacacagaatatcttttgtgttgatgaaaccaaaataaaatattggtgttgcctggcttagaagggtgacattctgaaataccatgaatcaatgtggaagacactgtgactgcagcctgtcactcttcattgctgatgcaatggagattgtgatgatgaagatgtgtatcaatctttaggtggtgaataggctttcttcttggctccacccagctaattctgaggaggaactagctctcactaactctggtgctcattgatagaatgtctctaagtatcaggatgaacttgaaacagttccagggttatttggctgtggttgcaaggctgatttccctcagcttgtatttcactgtagctggtatttctgggcacttggctctacagctgccattaaatggcactaaatgatgccccagtgaataagctagctgtaatgtgtgcttcgtaaacaaggagaaaattagagttcacgggaagaggaatgcatattccattccattgtatctaatgcatgtcgttgtctttgaagggaggaaggccttggtaggcctctttggattctagaggcaagaaattctgtaccttggaatactgtactggctcactgaccgactgatacacgagtcagccagccttgagtgggacccggggcaaaaaaagggctctgcagcaggttcagcctgtagcacaagcagtcctgcctctcaggccagtgcagatgcagatgaattggacagcacaatcaaccatctggacataattgacacttcgagaacactccaccagcacagcagattgcataatcttttcaaaaaatttactaaaatagaccatattgttaccagaaaaggggattttgattcaaactccaagagaggattcttggatttcatgcaggaagaaattcaaggaaagttggaaagtgcagtgataagagagaatttattgaaaattactccattacagagtaaggcatcctcagaaagcaagcagaggaacataccgtctttaagtttttcttatataggagtgtcgtctatgtaaagactaaactaagctgtgcctacatgcggatgagcagacattacgacaaaatttattattctgttgatttaagggaaactattcttgacattctagtgtgttatcttggaaataaggactgtgtcttgcaaagaaacatattcattggggcaatgtgttatcaaaaaaaagattttatctacttatgatccaataatttagactgacttcaacagatttttttaatgacaaaaagcagaagatggtataagaggaaaatacaatacaacagaaaacacaagctattataactcttgcttcatggatttttacatatctattagacatatgctgggtatatgtgtgcaatgataatctaaaaactggatgctaactagcttaaggaatgcctgcattacactgagtcttgcccacttttccaattataaacagaaagctacagtactatttgtatgagtatcaaaacttttagctgcctgagatagaggtaaagaagatttactgagataaaagccttggaagtagtagagatttgtcctatgatgttatggctgttgctgtggttgccgttgttaggaaatacagtgggagtgaaagcaagattgacaagctctgctcttcctcatactcacaaccccctctagagatggacagatggtggtacaggaatctctgacacctcttagaagtcttttgctctttccagaatgtttcctgacaagtattgttttgagtcacagattaggtgaaactgggtgtagaagaaaggactagagcaagggaagaagttttccatcccagatagttgttgtaggaacagggaaatggaatttttcatagatttatgccacatttctatcatgttggggagagaggcatcaaaccaggctcattcctgaaagaatcattacattattttagagagaaagaactacaaatttcttgtcaaatagatgtttaaaattcaaagctactgatttttttttttttttttttgagatagagtctcgctctgtcatctgggatggagtgcagtggcacgatcttggctcaccacaacctctgtctctctgattgaagcaattctcctgcctcagcctcccaagtagctgggattacaggtgcaggccaacatacctggctaattttcgtatttttagtagagacggggttttgccatattggccaggctggtctgaaactcctgacctcaggtgatctgtctgcctcagcctcccaaagtgttgggattacaggcttgagccactgcaccaggccctgctgatgtattaatattattcatcttcttgaatacaccaaatggtaaagtgcaaatccacactttaaacttgagatttctactcctatgtaaattatactagtgaggaacaaaaaaattctctattggttgggagatgatgtttgacagtggtcagtttgtgaagtggaggcttacgtcacagtactttttacagtattgcatataaacatgaatgtcctcatacccagaagaatcagcatttctcatgagccatattaccaccaagaaagaagtgaattgaagcctgtgactacttgatgaagggtgtatagaagagggaaagaaaaaggacacaaaacacaatattgtaagtggaaaggagaaagtcattacacagcctataagagtaaaaaaataaagagaggatattatgagtaattttatgtcaactgacttgacaaaagtggtgcagggcaggttcttggcttcactaggaaggaatgcagcgtaagctggtggtagaagaaaacagctttactgaggtggcagtgttacacctctgtgactgctcttgtggagcagagctaccccataggcagtgtgccaagagcagtagcatagggcagttttgcagtcatatttatcactgcttttaatgacgtgctaattaaggagtgggttattcagaaataactagaaaatgggcagtaactttcaggttttgccatggcaatggtaaactgatacggcactggtgggcatgtgttatggacaggtgcttccagtgtctcttccttgtgtcacccactcttcaatctggtccagagttgagtcccacctacctcctacctcattgccccttggagattagatactcctccttaatcttaaggggactgcagaagagcagagtcccttttctgtgagtgcttccttctgactttatgggggcaggccttccctagcatttgaagagtaaaaatctttggtatctgaactaaggggcccagtggcaggatgctttcatttgtggggtcagaagacagaatggattgaaagacttatgacggaccgtatcatttttacatgaaatttagaagatataaactttactaggaggttaaacaagaaaattataattggaagagagagaaaaattaatgctcctatgtccacccacagaaccaagttgttaatctatgtgtttgcaaaacaacagccttaagttttctaggttttataaatggaggttgtggtgtccaccttttgtgcctgcaggatctcataagaaacaggtttaatcctggacagctagtggcttcctgaagcctaacagtagttggaataattaagaatatctggtaagggcccctttattctgattattattgattcttgggggatcattttgttgttgttgttttttaagacagagtctcgctctgttgcccaggctggagtgcagtgacacaatctcggctgggctcactgcaacctctgcctcctggtttcaagctattttcatgcctcagccttctgagtggctgggattacaggcatgtacccccatgcctaggtaattttttgtaattttagtagagatatggttttgctatgttggcaaggctggttttgaactcctggcctcaagtgatccacccacctcagtctcccaaagtgctgagattataggcgtgagccactgcacccagccagttccttctttttaagtttttcataagactaagtcttttggttaaacagaggagctattattttgttttgtggaaaagggcactattttattttcataattttaaaagcccttttgaatctggcctacatttcaaacaggggtggagcaaggtgtgtctgactccctgtttcccaccatggcttgagttagattttttttaggtttctttggtagttcctttggccacagagcttggaatgaaaacatttatagccaattaaatattttaggccagacagcatggaggtgggcaggcactcattagcccttaagcaggcagatcatgaggtcaggagatacaggccatcctggctaacatggtgaaaccccatctctactaaaaataaaaaaaattagctgggcatggtggcatgtgtctgtagtcccagctactcgggaggctgaggcaggagaatcccttgaacccaggaggcaggggttgcagtgagccgaggtcgcaccactgcactgcagcttgggtgacagagtgagactccatctcaaagaagaatatatgtatttttaaagctgtataaaaataaaaaagtaaggccccaaataaggttatatatgttaaaaaaccaagtacgtagaataatactatactgggggaaaacattgcttccagagacgcctaagacaaaacactttagcatcaagtccgcaacaacagtcagaaccggaggtgaaaaagccacaggagctgatgaagaagcaaaaggagacagcaatgatctcaggcctttttaaagggagaataagctgaaagcagcaaaacaccacagttgaatctctaagacactaatctcagaagttttaaaagaaactcattattgcatcaaaggcaaaattttctgttttactttttgtttgtttgtttttcgagatagtctcactctgtcactcaggctgcagtgcaatagcacaatcttggctcaccacaagttctgcctcccgggttccagccattctcctgcctcagcctcccaagttgctaggattacaggtacgtaccactgtgcctagctaatttttgtatttttagtagagatggggttttaccatgttggccaggctggtcttgtactcctgacctcaaatggtccacccgcctcagcctcccaaagtgccgggattacaggcatgagccactgcacctggcctgtataattttcaataatgtagcaaattaataacttaagaaaacccagtttcaatatgcagacgattttctagaaagtgactgggccatcattgttctcatctcagatttccacttcctgtatagaaggtgtaagaagaggtagcaagacattatgaaactaaattgtaagcatttgttagtgaacaaaatatgactaaagcgctactttttttaaaaaatttttatttattgttattattttttgatacagggtgtcactcttttaccaggctggagtgtagttgtgccatcttggctcactgcaaccttcgcctcctgggtttaagcaattctcatgcctcagcctcccaagtagctggaattacaggcatgcatcactatgtccagtctatttttagtagagacaacacttcacagtgttggctaggttggtcttgaactcctgacctcaaatgatctacccacctcggcctcccaaagtgttgggattacaggcgtgagccaccatgcccggccttaaagcagtatttttattaaataaagtgtagaagaaaaagtgtaaataaagtgacaaaaagaaaacacaaggccgttatggaaaatgataactttagggaagaaaacaagaaaaggcaaaccaagattcccatagggtgagtctccaatccacaatcctcagacaaatgtcaatgctggaaaccctggagcatccagggagtgaccgaaaataccaaatgctgaaaacccagagtacccgcgtatcagcctatgagtgtcccacaccaaatgccaggaaaccctggagtatccaggggctgaccagtgcagaaaatcctggagcctcagtggggtggccaacagtgagccccaaaggcctggttggggccacagaacaatgtgactctggcttcttagagtcaacagaacaggagaattcttacatccaagtgtcctgccttaaacaattgcacaaacataattagtagggacccaaagaaaaaactgcaaagcaaacacatatatcagggtagaaaataagataaattggctaatggatagataaaatggcattagaggagaaatgactaagagaaggagcaatgaggatgtagtcaggtgtgctatgggggacttcaaatggactatttagccaaaggccttatttcctggatcatctgacatagggcaggtgggtagatgggacacttacaggtgtgcaggagccaaaatggtgccaagcagtgtctaacgtggggcctgtgtgaagatctctccaggccccccagcttgggtgggttgagctcccgtgggtgaactggtgcatgcagcagctggcctgcatgaagcagtggctctgtggccacttacctaactgctcagctccaccgcctgtcaggaaagatgatggctcttaaaacagcctttggctagtgttaacagctctgcaatgttagcaactctgtagctttgctcgctgtagtgctgatccccatcacaccctctctcactgatcactgtcttgccacttctccaatagctgtcttgcccattgctgatcgctatgtccatcttctcacaaaatgccatctcttgctgtctcttgctgtcttgcttctccgctgtttccactgactcactggcacatcaaacgctgcctctcaccatgtcacatttatcctccctcctcattaaacatccatcttcatgtccagcccttgcatcaccaggctgatgtctctgtactgggccaggtactggagagtattgttcctccatcttcaccattaagccatggttctctcaaatcaaaccttctcactgcaccaattttgccaagaaggtttgctgtgcactggttgccaacttacccaaatccggtgacacacagcacccatgcacaaccagttacatgaagtggattactacttacagagagtcagccagagagagcacaaagctgcggggacctgattgacactagactgtgtgtaccccacaaggactgcagctgagggaccctggaatacagcccaccctgggttttatgtcttagaatcacatgacacactgggctagagtgttgaaggaattcctgtttctagtagggacagaaacggaacccaggctgttctggccaatcatgccctatctcagaatgttacatttccagaacattctacagttattccagaaaactacaatcaagaaagggaaggggactgggttgattcaagacaaaatgaaaactattctgcaaataccatagtgaaatcacagctcagtaatctttttgtgactggcttatttcatttagcgtaatgtcctctagtttcatccatgttatagcatgtgtgagaatttccctttttaaagctaaataatatgctattgtatgtatatatcacatttggattaccagttcactcctttgtgaacatttgagttgctctacctgttggctactatgaataattcggttctgaatgtgggtatacaaatatctcctcaagttaatgtcttcaattacttgggtatatgtccaaaagtggaattgctggattatatagtatttccattattaattcttcgaggaattgccatctggtttcccacagcaggtgggccatttacatcaccacgacagtgtccacaggagttccagttccctaagttctcaccatgactggtcattttctgttggaaaaaaaaatcctaataggtgtgaggtgggttttgtttttatttttctaaggattaataatattaagcatcttttcctatgctagttatctaattatctctaaagaatattctccagagaaatgtcgattcatatacttttctcgtttttaatcaggtattttattttaatgttgacatgtaggacttatttttatgtactagatattattaaccccttatcagatatacgatttacaaatattttcttctattccacatgttgcattttcactgtgttggttatgtcttttgatgcccattttacatttttatgtagtccaatttatcttcttttctacttttgcctgtattatggtattaaaggtgttagtattcaaatgtctataaatactgacttactatgctgagaaggtcactctagaccatctctctgatggtggagctaagaattttacactctctcattttgtaccagggcacagtgcagctaggtgagaacacagtggctttctcgagcttatttgtcttgcatttttggcgacaaggattgttgttcacattggcctcctctggcaggtccacctggaaagcattatatttagcaagaaaaaaggaggctgtgaatgatgtcaactgtgtatattccctgttgcaagtgtcaaatccatgaagcataaaaggatttactagaggatattaaattccttgcaaagtgttgaaaaacctgaaggaataggctccaggcaaagcctctagaacaattccaagaatggcactgctggcgcaggctggggaggagctcctgctgcctgagactccacattcaagctgtctcctgcaggaaagagagcagctcttctcactactgccccctgaaggacagcagctctgctatcaactactagagacctgacccctttccctgcagccctgcctgtgttgattatatcttcatgtcagactcatgtagattcatctgttttcaagggtacaggggttatttctgcccaagtccacactgtggctttctatcataaatacacgtttctacacttgaatttccaggaattactagtatcaacagcaaaatgctacaacccaacataaagatttcctttacaaagaacatcatgctccccatgtagcattgtgctccccaaaatgtggggaaactccaatctgttcatcccaacaccatctaggaaaaaatgttcttctctcatgagccattaatctgtctacttattgtttaatttttggcctaaattgtaaaggtggctaaaaatagcactttgaatttttttaaagaaagggtatatagaaaatattaaattatttaaaatacatatatgcatgacacatttagttattgtcaccagcttctttcacatttattttattctgtagtttctggcaatactttctctatggtagagtctggaaatgctactcctcatgtccttggcttcctaagtcccagatgtggtgaagaatgcacatcagctgtgttactacagaatgcttttggattgagatgggggaggggacgtgcttgatctcactcaaatgtgctcaatttcctggtctgggtcacagccaggcagcccagtcctatgggcacaatatcttcactcgccaggtttctatcaaaatgagagtgtccttcttgactgtggaaaacacggggcagggagaggatcaagaaatagcaaaaggagtatttggacttgcctgagctgccactctggtttccccaaatgttttcattccatttcattcatgataataaacacctttctgcctaaccagccataatcacttttcttagatccagctgattcagtgataaaactaaagggaaaaaataaatacagttttcaacgtttaagctgaccaggtggctgtctctggtgtttatacctccatatcccactatgcatttcatcttccctttgcctcactggagatccaagtgcagggaatgcttcacgtgactgtgatccctagaacttcatcttcatgactgttgaaatcttctctgagttttaccagtggaaatggcaataaatagaaagattccagaaggtcccctagggtccatattttctgtacttcttctctaaaataagtaaaatcaattccatttgctcttgctttatattggctacatctatgtgcccaggacacaccctaaagccctgtgttgacaacttatccagtattgtattaagtctaaatggtcacatgcttatcatatcatttcttccaatttcatggaataattgtcatgtcaactctttggattaagaaccatcaaccagataaccacagccctgaataaatagaaacagaatatttcaagctgttcagttggcataacagtgatgagtctatagctcattttcaagatataaatattctatttatgggagtaaaagcacgaatcatggttagtgtttcagagcctccaccacatctgacagcatagcaattcaacagcacaaggtttgtgtgccagctgtgcctgactaataatgtttttttcccctgtctatagggaaatctgcacctgtgcacatgacaagagcatgagctacacttttttcactttttctgaggtaaatacattgcttgatccaaaaccgtattatggaataatttcctgactctgatgaaagcatttggaaaatcctcaaataatatttgtgcagaaatacaaccaaaaagaaaggcaaattcatatataggaaaataaccagtgctctcctcatgttacatgaggtccactagtatcacctgaccccagctgttcatctgatccctgatgtgttgtacaatgttaggggttcaggaggggtcattcttcttggcaaatgaggtgttcagaagagccagtagccctttaagtctcagttagttgaaattcataattgagtccccaaagggacctccataacattggttcatgagactccctggtaaagctgggaaaggtgactgactgaagtccatgtgttgaatcatcctcattattaaaagcccctgctcattaatagcattttgattaatattcactgggaaagcattttttttttattttggctcatctttgaaaagtctagtcatagcttttcaatcactttgtctgcaatcgttttgttgcatttctttgaaggcctgatgatctgtcaaaaccaacagccaatattattacattgccgttatgttgggaaaagctgaatgttgggagaagctgaggcagggcttgcatgtctgacgtaatgtaaaagagtcttggaacacgtccggggtccagggtctaaaaccccttgtggcctttagtacaccaagctctgtgctaaagggtggaaggctaccctgacgcaccataatctaagcccagggcataaaatcccttgtgacttggatagaatccaggactcgtggctctggagtgtgtctacacttgctggctcctttctctttgctctccaaggatcgattgtatcttgagttaaaagaacctgctctccattatctcaagtagtagagcaaatgctaaaccatcacaggtgtaaatcatgtgcttaatgcaatgcatccttttggcctccacattcttaccacgtgtttctttgttggattaccaataaatagcatgggatcccagggctcagggccttcttagcctccatacactacgatggtccctggtgcccacatttctctctcaaactgtctttttctcaatctttgactccaccagactttgtcacccccacgacctggtgttgggtctgatcaccccaaaactgttatcgttgcaatgtgatcatcagatataacccttgcagtttactcattgttatgatttttacatttgcagggcttccttgacaatggcactaatgtgacgccatccagcatccattattgtgagaactctatttggaatatcaccattgtgggcatgaacagaatggagactttcataggatgcaatgtttaatattcaacattagtcaaaatttgttctagtcctacccttggagctccattgagttggaaaaatataaataaatttattttaaatataatataaatgtaaatataaacaaatttaaatataatataaatataatataaatatacataaatttaaacataatataaatataaatataaataaataaataaacaaaaaaattttctgtagcaagagtaagaactacatgtggtccagaataccattattttatggaaggttacaaaaaattttaaatgtatttaattcagataagaattttataaatatgcatatattgcatatatgatagaataaatgtacttaaatatgaatactatatatatttgtagccaacattttatcaaaaacatatatattcacttctatgtatcttatatacatgtatgcatacttttccgtaagataaattttaattttttattgaaatactaattagttttaattttgtctttaattttcttttaataacttcataatttgattactggatattcacatttaaatcaccaatttaagaaaaaatacatgtgtgtacatataggtagaggtgtaaatactgtatcaggaagcttttatgcattactgattggtaactggttaaatacacaactcagtgactgataacagtaaacatttgttttcatgttcacggatgctcatgttcacaatcctctgactgatcaaggaagggctcagctgagtggatcctctgaaggacacagacctcatcttcagcctatagatatcaattgtctgaggactaagctgaacaccagtgactacacatgatacaagattcttgtggcaggtcacaggagtgaacatcccaaaccaaactggacagttgaatttaagtccaataatttctaacatagcttcagatatttaaaatatattcctttatttcagtgagtacaaattttcaagaaaatgtttactccatttaattatagaggtgtttgatcattccatggacaaataattatgttttcatcctttacaatcttgaaaatatttgcaaatgtaaatttgcattaataagaaaataaagctggatgtgttttcaacatgtggctttaaatataattttttaaaatggcctcattgggggaaaatcattttaacttatatgaatatccttttttgcctctcttgtgttctatagagtggcccaataagaggtcctcccatgagatttggaatcaggaaaggatggctcaatattctccattggtacctaggacagacacagggacagagatgaggactggagaaacacctggaaagatgctgtaggaagctgagagcatcagcacccccacccctaagcttccagacaggactgaggaccacatggttagatagcccatacttcaggggaagatgcattcagttttctgagggagcaacagagattcctgcttctaatatcaactttcctgactactatatccttggctttgaaaggttgtagtgggaaagttaatcgtaggaattgggtcattcttgtcatacccaacagagccaagaaaccaggagggaaagacactcagggtgcaaaatattgtctgaagaatgtaattgaaataggccctattatcccatggaactaatgtttatggttttttgaaggaacatagaaattgactcctccagtcttaaaaactcaagatagttatatttttcttatctgaggagttcttttgtcaggaaaccaaccatcaggcctccagatactatcaaaaggagctgaaacttacatatcactgaatcgggacagtgagacatcagactcttcacccattgtgattgcctaactgacctcctgcttcctgttgaccaaatcatcttccttacccctccctaattcctgttttcccacatttcttccctgatatatatacccctcattttagtagttcagggagatacatttgagaatggtgtcccatctcctcggctgcagcacctgattaaagcctgttccttggcaatacttgtcttagtgattgtttttctgtgtggtgagcagcaggatctacactgaatccctggcatttcagtaacaaaattctctgcaagcttcactgcctttggcttattgtaacctgaaatcaaatttatccacaacttctgatataacttgatataactgtaggattcactttgtccaccactgcttcccagtctgagcttgccagctcccaacccttcctagtgcccatgaactttctcaaagagccataggtaacatgttccctttttcgtaaaactctaaccttctctttgttcttccaacatattgaagaccactgagttttcctgtatgccccatttggcaaatatttctttgcacgtaaaacattaaatttagagattcatctctacattttatttagacttcagtagtttagactctaattgtctgtattaagacaattcctgctttgaatatctatagtggcctcttctctgttatataaagtccagctgaagccataaactagactcttcaggtgtcatgatctctgtctttattaaatcaggagaggcattgctagatctgtgcagttggggctgagaaagagaaaagaattagggtgcagaggtgactccatgtccccctctaccaacaccatcagagtgtggctgcatctgaggaccactctcagctgatagaggcatcaggaggagcagctggggcagccctgcctcacacatctgcttccctgggggtttatgttcgggtgtgtaacactgtgggagaataactattatactgttggcagtaataagttgcaaaatcatcaggctgcaggctgctgatggtgagagtgaattctgtcccagatccactgccgctgaaccttgatgggaccccactttctaaactagacgccttatagatcaggagcttaggggctttccctggtttctgctgataccaggccaaccagctactaatactctgactggcccggcaagtgatggtgactctgtctcctacagatgcagacagggtggaaggagactgggtcatctggatgtcacatttggcacctgagattggaaatagaaacacaaatattcatactattgatcatattataggaagacttccctgaataaccaggcagtactgagcacactgggctgagtaaattcctagtgttctccttccttacctgggagccagagcagcaggagccccaggagctgagcggggaccctcatgtccatgctgtgtcctgactgggtctgactcctgcacaaagtgtgaccagcctattaataaggcttcagggcaggaggttgtgctctgggaacatgcaaatgagcaggggatggggcaggctgggcacagctgcagagctggctcatctcagtaactcagcaccagctcagtgtccccaggtgtcccaggtaagaccagggtagcacaaatttgtctgcagagaatgtgtttctactggggactattttattatgagaaacaatttttaggtatttttttgagaattttaaatattcctcaggagccgatagagtaatgtatttcattggtgtatcaggattatttaggagaatattcttgtttgtaggaaacacatagtaaaatgttagatggtaggattctcaagtcttcaaaagactctcataagattccgggtagggaagggggtaattgtgctatacctgcaacatttctgtgagtttaacattgttcctttctaaaaaaaattaaaaataaaatgtatcggcatgatgctatatatttgtaagtattaggtaatggtgttatgcctttgttcttactagtattagatcaagcaatttattacagatatacaaagatgataccgtgttgtctccatgcatgcagcactcacagatccaccactatcaagaactgcaggtctctttaatacccagagactaaatgaggtgcaccttattcttgttttgggtaccttcatagtctaccttcttttctgccattgggtattatttcccaaagttcatctgtcttagtgagggtggccactgcacggagcatgtccctgccatgcaccatcaatgacactttcttcttatactttttatcagtgcatggggacatcatcctgacccagacaccagcctccctgttaacacctttaggaaaaacatactcaatctcttatcaagcaattgtctatgtacatggagaaatcagttggatccagatgaaactggacatggatttgcattcattatatctcatatctctaatgtaccctgaacgtcccagcctgactcagtagcaggggaagtggatgtaaccacatcagcatcagtgggctgcagcctcgggctccacaaaattttactgatgcctgactaggggagcaaaatcacagtgctgcagcccatgcacaaacatttctgctgctttgtaagcagcctgaattttaagggaacttgcttatattggaagaaaggaagaaagttccatttgtcctctaaatgtttgctgaaaatgaaccgacaaaagaataatgaataagagaaaaggcaaacaaaattcacttagagtgcggtgggatatcatagtggggtgattacccagataactcaatgagatccagttgttcatatttcctttctagggaagagggaattgggaagtgtaggcaacctggagagaatagatgaaaaaagaaatgcatcctcaaaagaacaggcaatagcctgcctggataaagcatcaacttgcagtctcttctatttttgattcatgttttgtgttaatcttccctgatataaaatttcccaggaagaatttccttgacaattgtttttcttctggagaatttgcttttaggcagataagggatatttaggaaaagacttcttgtgcatttgctgctttctaaatgcctttggctttacataatcatcataccaatgcagcatagtttgagatgttattttctggattcctttacttgcagccacctgccaagatcctgtttcagagagatgcagctgcagattgagtgagcagttgacccctgaacaacatggaggttggggcactgaccacaggtgcagatgaaaacctgtgtagaagttttgcatttctaacttaagtactaatagcttacttttgactggaagccttagtgataaaataaatagttgattacacttttttacattttatatatattttatactctattcttccaataaagtatggtaaagaaaaaaatgttcttaagaaaaccataaaaatgagaaaatatatttactactgattaagtacttgctttcaggtgacacagaagaaaatataagtgtatctgcaaacttcaaacccaagttattcaagggttaactgtaccatgatgaatgtagcagtccccatctgtagtctagggctttctcctttgctgtacctctgctcacttccaatggccatatatatgtcttatgttctttatgatcttgggcagagaggtctgcctacatgcattgctggccagatgtcctggaatgtgtatctctgaggaaagtgctatggtttgactgtgtcctccaaaatccatctgttgtaaagttcattctcagtgaaatggtttttgccaggtgggccctattgggatgtgtttaggtcatgagggtggagccctctagtggaatacattaatgccagtataaacagggtttatagggctggaatctttctctctcttctgctggtctgtcctgataagacatggccttccttccattgaaggactcaatgccccaggcatcgtcttgaaagcagagaaagctgaccttaacctgcccatgccttgatctcaaactttccgtactccagaagtgtgagaaaatatatttctgttttttatgaattacacagcgacaaggaacctgttatagcagcttgaaagagaacaggagagacagctcacaatcagtgaggataagatgaggtatatacatatcccagctttctcatctctcaggtggaatagcccagaggaatttagtccatgtttccacatgtggttgatcttcagttatcctgagtcaggtgggtggttgatgtgtcttttaccattcatcttctgctcctgcctcactttcttcctttcctcccagtgtaaatttgctgcctaaacaggaatactcattgctggtggacccaaaataagacagaaaaaaaaaatcattgtacttttgtatgagggatatttctcatctgaattcttatcacttctctttctttgacatctaggaatattcagaaaacacttttttttaaccaatctattttagattgaatttattgattttttttcctgtgtgttttgtgaaccaaaaattaagttgtaagccaccaacgagctaaatggactccccttttggcagagagaacttcaaagaaatctgaaaaactaggttaggccatgactggcaggtgggtttggatgtgtctcattatgctctcttccctttggagttcaggcacaactgaccagcattatcattataacagagatctttggactgaggaaacagatgcttgtagcaataagataccatactccaacatgacagataataggccctgaagaaaatctaaaaattttactctaaaaatatttctttttctttttcttttttttgtttttttttgagatggagtcgcgctctgtgcccaggctggagagcagtggcgcaatcttggctcactgcaagctccgcctcctgagttcatgccattctcctgcctcagccttccaagcagctggaactacaggtgcccaccaccatgcccgactaattttttttgtatttttagtagagatggggtttcaccctgttagccaggatggtctcgatctcctgacctcgtgatctacccacctcggcctcccaaagtgctgagattacaggagtgagccaccgcacccaacctatttctctgaaatattctgaagtggccctgcaaagctgcgcgttgtgggagaaatttgcattctgtagagaatctcctatgcttactaatcattttccaaaggtctgactttttttttttaaggtctgacaagcaacgtctactttttctgctacccataggattcatctacacgaaaagaaccttggcttatctaaactcaagcacaccccgttatctaaactcaagcatttctttatggtgaattcaactctttaggcagagcttaactctttcaaccagttgccaatcaggaaaactttgaagccacctgtgacctggaagcccctgcttcaagatatcccacctttccagtacaaactaatgtatatcttatatgtattgatttatgtctttgcctgtaatttctgtgtctccctaaaatgtataaaaccaacgtgtaatccaaccaccttgggcacatgtttacaggaccccctaaggctgtgtcacaggccataatccttatctttggcaaaataaatctataacttgattgagacctgtctcagatactgttttgcttacactgggtcacaaaatttaaaaatcctctaaaactatctacacatccataaatctacattagaggcagtggagtgagcacactccaacagtcaaaactcacaagttagaggaacctgagtctaagattttgtccagctctcttgcttcataaaaataatttgtgatttttttaaattttactctagagaaggacaattttggggaatatgtttatggtcagtggaatgaataatgtccccaccccaaaagatgtccatatcctcgtctctggaacccatgttatacgagttattaagaaactattttaggcatatagagaggaaacagggtccttgggaaggttttgtttcttttaaagcagctccagaaatgtttcttgtttagcaggaaagccctggctcttagagctggtccggcaagcttttttttcttttttagagagggagtctcgctctgtagcccaggctggagtgcagtggcacgatctcggctcactgcaagctccgccctctggtttcctcatgcctcagcctcccaagtagctgggactacaggcgcccgccaccacggccggctaattttttgtatttttcagtagagacggggtttcactgtgttagccaggatggtctcgatctcctcacctcctgatctgcccgcctcggcctcccaaagtgctgggattacaggcggcaagctttgatatacaaatactggccattagaaactgggtccagccaaacatggagattcccacattcttcttctttttttttttttttttttgagatggagtctcgctctgtcgcccaggctggagtgcagtggaacgatctcggctgactgcaacctctgcctcctgggttcaagcgattcttctgcctcagtctcctgagtagctgggattacaggcacatgccaccacgcccagctactttttgtgtttttagtagagacggggtttcaccatattggccaggatggtctccatctcttgacctcatgatccaccttccttggcctcccaaagtgctgagattacaggtgtgagccacggcgtccagctcccacggtcttcttccttgccccgacatttgcctgacaacatggctgcccccacatatccccatgtgtgtagaactttatggcaccctgcatttgcatattaaaacactagggtgggagggccagttttttctcaagctacatgaatgacatgcttggtaaaaccaatcccctaagccctatgcaaatcagacaccacctccttcagcctcctcatataagcagccacttttccaccgcacatggagttttctcttagttctaatctcccctctctctgtctctgtacggtggagctgttttcttcttccttccttcttgcgtattaaacttttcgctccttaaaacaaccccacgcatgtccgtttctttttaaacaaacccgcgtgagactaagaacggtggtggtcctccagtcatcagagccctatcataaggattctaccttacatagcaaaagaagaacttgacaggtgtaagttaacgactttgagaataagcaacctggttatccagatgaaaccaatataatcacaaaggtcattaaaatagaggaggaggcttgcagagaggagctgggacaatatggaaggatgtggtttgaggagggaaggggccatagagccagaaatgtgggagcacctggaagataaaagcagaggattcagttctttcctctggagcctccagaaggaatgcagccctactgacaccttaacattagctcagtgagaatgctgacctccagaactacagggtaatacatttatgttgtgtgaagccaataagactgtggcgatttaaacagcagcattggaaactaatgcaaggggaagaaatgtctttcagctcactgagcgcgtgcttgtcttctgttcttggaaatatttccaccttgttttctggtgtcagttatgacaagagacagagaaaatttttccgagagaagagctaccacgagaattcgtttttagctagaaaatctcctgggtaaaatctcatgattatctgttatacgatctgggtatcacagagtttggggtcagatctcacaacatgtgataggaggaagagggttttgttagtttgttttcatattgcgagggaaaattagattttcaggacacaatctgagaaggacagacagagtcagagatattgtaagagaaagaggagatgtggaaggagtcagggcaatgaaacacgtgtcccagctcccaaatctaaaataaagtcattgattttacaaggtgaagaaaagctcttcaccttccatcttcttaggaaggatcaaattcttcccagagtccctgcccctccttcacccccctgacattgcattgtggagctaatcacatgtgcccttaatccctgctcctgtcccaggctgggagaggctcactgtcctcaccatgcccagcaggctagagctggtgccctaagcaccaaaggagaagaggatgatttctgtgcaggcaataagagctttaccgcattttacatttccctaaaattctaagcaaagttctgtggagagaagagaacatggggcaactttatctggtggggctggaagagaccaggctctgagaatgacaattaattcacatttctacttttccagatgccaaatgctagctttatcaattgtggaaatgtggactttgagtttaagaacaggtttcaggtactgcaataattgaggagacatttggaatagagtccttagtctagggctaaagtcagactggcagtgcctgagagcttccaggcgctggccctgggctgtgagggaagcagcagttctcctgagccacagggctgaggacctgggagcaaccacaggccttggccacagggctgcctggcaggggcttgagggaaggaaactgctcacaaattcacaggagctgcattaagcatatatcccgcagcctggcaagagtgaaagtctcagagacccagaccttagggctggggctgggattctgggctggctgctgtcggctctgccctcccttgtcctgaatgactggcaccctgctggagccaaaaatggagggtcggccaatgtcctcaaagtctttactcagccagaccctgttctgcttggaaagaaaatgaacacatggtatacaaataaacataaaatcatgtgtatctgtaataagaatttctaatataaattttacatattgaatacatatattttagaaataagttgtacttatacatttgcctatactatgtgtctatttatggataaatatgtggtacatgtttatatataaagatatataactttggttgctagtataaggtatagttttaaactttaataaagtaaacacgaacattgaaaatgagcactgggtgcaccacttcatggccctcctcactccagggcctaagggtgataaagctcaggaccctcttccatgtcccccggcatggacagcagtgaactacccattgctgaggatcatgagtgacctgagggggatctgcagaatcacagagcagcagatgcccagaagattgatagtttggaccctgaatggagggacattttgatcacagggctcagcatagacaagtactcttctggtcatttctgtcaaacaaaacagcacatgtagctcagaggctgcatgatcacaggatgaagcacctccatgagtcattgccagcttcccctctgactggggtgatgtgggatctctctgccccactttcatggctcaccagctgctgggactctgttgacagtggtctacatctgtcccacgcacaaacttctcaatagttgtcattttacttactggtctccaataaccacaaattgccagccatgacccttccacaaaaattgatggagtggggttggaactatgggttcagcaatgtgccagggcatgtatataagagaaacaaggtgtggccagcccatgtctgaagtgaggatgaattttcaccatgaattcggagtaggaggtggaagaaaacatcctgacatgctccaggcagtgatgcccacaagatacactagaagcgcccacagaggaggtgggaagggggtgtgagaaaaagagggagtgtgaatttacaggtgtctccagactgttcacctgaaaagagatcagacccttaacaacacctgggaccccaggcagagctgttgctatggaagatttgtgcaggacagggataggaggagggagcacctacctgtgatggcatcttggttgctgttggccagaatgacatcttttcaggcctactgtccctgacccaggcagggatcatgtccaggagggcagcaggagctcagagccaggccctggttctgctagtgccaggctaggatgttcttcatactctggccagctctacaggtgacagtgaccctctcccctgagacacaaggaggaggacaacgatggcatccacataacatgctcactgtcatccaagtgggggaacaaacatgcagatccccaaatattaataccgagtttgtagttcctccaacttggtgcaattctgatcagaaggaaaaacaggctaacaacttcatcagcagggaaagttcatgtttaatacaaactatctgaggctgaagcctgagtttcccttcctcaccaggcagtcaggacagcaggagcaaaaggagaaaagctgggtcccaaagtccacaaggtgcctcctgagactgatcctgcttagagaaggtggtgacagtggatgagtcttctgggactcccacaccaacataccctgagctggatggcttgagccatagacatttattgctaatttattaaacgtttattgtgaatgtattagaaccctggaaagttcaagatcaaagtccagaaggatttgctttctggtgagaaccctgcttcttgttttcagatgtcacccctggatacatcctcacgtgtgttcagcaatgtgccgggcatgtgtaagtaggagaagcaagtacatgctttcttcagtgcatgcttggaggctggtgaggggttaaggaacagatcgatgatgtttatttttactaggacacaaatcctattaaatcagagccccaaggttttcacttcatttcaccctaattaccccttcataacctctatgtctaaatacagtaattttgcaggttggagattcaaaatatgaatttgtgaaacacaattcagttcatagcaggtgtgctttgaggacatgcccaaggcagtaggaagggcaaggcgaggcttccagtctcagagcacagaaggcgttttcccaccactcagcacactggcagctcctcttaggtgatccaggtcacacatgagacgccattcccgccttgggggctgcctgctgataatggaacaatatcacccttaattttcactatttctaagatcagacttctattttatgtttattatggagtttgtccaatggccaggtttgtaacataacctccaatgtttggtttgtgacataacatcttatagaattttagatgctggtttccagtgagacttgatggagttttttcatgggttttcatggagttgatcttattacatccaccattatgctgcattctgtagggaacacaaaatgattcctctcctcaataaaccagtcacctagttgaagataaagggtgttcagaaaagatggtcacaaaacaattaggggctagattctgtgatccatgtgagatgccaatgatgtgattctggaaagcagaaggtgaggttgtgagataccctgcagcacataatgcccaaggctagggtggcgagtagagggcccctggtctggatctgtctacccagcttcattcctcccattcgtgaaacagtggctgcaccagccaggaagcatctgagaccacctgattctctggaataatagctgctgaggtttgtgctgtgagctataacactgtgagtctctaactgtaaccatttagattagcactaatgaaaataatttttaagatggtgaaaatgtctatatctatgctttgcaagtgtagccgttatatgtcatatgtgactcctgaacacttgaaatgtagtgaaaacaactaaggaactatattgttaattttaattaattccaatatacatgtttgtggctgggtactgctaatgttggccatgtgagtcagggaagttttagatggtaataaacagcaatgtcatcaggacaaccaatctgctaaatgttaagcaaagatgatcccaggaccattgcaccaagctggagtggacaaggtggaaagagcacgtaggtggatctttggaacccagattctgcttcctccaggtgaatgatgtaaactctctgtcttgaagacactgacattgaagctagcgactggggagctgagtgtttctcctggaagctgcagtggaaacagaacatagatcttccttagtattactcatgtccctctccataggcttcccagcagagaggtgctgtctgatcaagtgggaggtgaatgctgtgctccctaatcaatagtctttctcagtcccatgggacatatgaaccctgtcacatgcagcccacgcagttgaagccagagccccatgtccagtgtccagtgttgcctctgccttcggtgatcccaccctacaggacccagtgatgaaggcttgagtggcagggaagagctttggggagcctgccaactagcaataagggtgcagacttgggcttccagcttctgagcaagggaacattgtatgtcctaggtgtgatccaggtcaaggtgtttgataaaagatattacaataaattattttcttaagaaaataaaaacacagaaggcatctgattattataggactgtttgggttttataccactaaagtggtaaaaataaatttttcaatgcgcagtggtttatcaggaatctcccagcccctgcccttcccgtgatgattctgtagtctttgcaggttgtatggtcacttggtggcctccttaccgatcagatgcatctacagcacaaccctaagatcttccccgattaacatagatgagcaacttcaacctccagataccacataccattggctgatttttatgcaatttatcaacactgaaagtattctattccatttcattatgtagttattattctgtgcatggctcattcccctactgagtatcagtatttgcgatcaaaaattgttttatttacttacatgcactaaaccttaaatgatagcatttattagttctgaaaactctgacattaagttaaaatcccttaaaagcaactatatgcttctttttttaattagaataaatatggtgcaatcacctcaactaaggatactaaactacttttacagttgaaaatgattaattggacatggggaaacatattgacaaaagtaacaagcattattatgatgttgaataaacacagtttgcatgtaaagtgtacagttatgattaattgtattaaaacacaggaggaagaaaggtggggattgctggattggttggtgattcagtccttagaagcaagggggagctgatgagtgatctcaggcaggcatccaatataaggtccaaatatgattaattacaatgttcttttccttaaggtttgatattttaagctggtcctgctggggaagttttgagcacattcatggaatatgtggaataaagattaaaaacagtatatttcaaaatactcttaaaaagctcagaaacacccaaagaaaactattttataaaatatcatgccttcctcgcccattcttgatatttgtgtttaaccaagcatgactcacaattcaacttttctccacattgttgcctagagtgttgaagaaattcctctaataggacagaaatggagtcaatcttgcaatatctggccaatcgtgttctggccagtcttgctttatctcagaatgttacatttccagaaacttctacagttattcctgaaaactacaagcaagaaagggaaggagactgggatcattcaaggcaaaatggaacctgttctgcaaatactgtagtgaaatcataactcagtaatcgttttgtgactggcttatttcacttagtgtaatgtcctctagtttcatccaagttgtagcatgtgtcagaatttccctttttaaagctaattttgcctttttaaagctacaatatgctactgtatgtatataccacatttggattaccagttccctcctttgtgaacatttgagttgcttctaccttttggctattgtgaataattcggttctgaatgtggatatacaaatatatcctcaagttaatgtcttcagttacttgggtatatgtccaaaagtggaattgctgaattatatagtatttctatttttaattcttcgaggaattgccatctggtttcccacagcaggtgggccatttacatcaccacgacagtgtccacaggagttccagttccctaagttctcaccaagactggtcattttctgttggaaaaaaaatcctaataggtgtgaggtgggttttgtttttatttttctaaggattaataatgttgaccatgttttcctatgctagttttctaattatctctatagaatcttctttagagaaatgtcgattcatgtactttcctcatttttaatcaggtattttattttaaggttcacatataagacttatttttgtatagtagatattattaaccccttatcaaatataagatttacaaatgttttcttctattccacatgttgcattttcactgtgttgattatgtcttttgatgcccattttacatttttatgaagtccaatttatcttcttttctacttttgcctgtattttggtattaaagttgttagtatttaaatgtctataaatactgacttactatgctgagaaggtcacactgcaccatctctctgatggtggagctaagagttttacactctcccattttgtaccgggggacagtgcagctatgtgagaacccagtggctttacccagcttatttgtcttgcatttttggtgacatggattgttattcacattggcttcctctggcaggtccacctggaaagcattatatttagcaagaaaaaaggaggcagtgaatgatgtcactgtggactgtgtatattccctgttgcaaatgtcaaattcgtgaagcataaagggatttactagaggatattaaattccttgcaaattgttgaaaagccttaaggaacaggctccaggcaaagcctctagaacaattccaagaatggcactgctggcacaggctggggaggagctcctcctgcctgagactccacaacattcaagctgtctcctgcagaaaagagagcagctcttctcactactgcccccagaaggacagccgctctgctatcaactacgagagatctgacccctttctctgactgcccatcagatgtgttactacagagtgcttttggattgagatgagggagggaaaatgcctgatctcactcaaatgtgctcattttcctggtctgggtctcagccaggcagcacagtcctgtgggcacagtatcttcacttgccaggttcctataaaatgagagtatctttcttgactgtggaaaatatggggatggtaagggtcaaggaataggaaaaggagtacttggagttgcctgagctgccactctggtttccccaaatgttttcaatccattaaattcatgataataaacacctttctgcctaaccagccataatcgcttttcttagatccaaatgattctgtgataaaactaaagagaaaaaataaatacacttttcaacgtttaagctgaccaggaggctgtctctggtgtttacatgtccatatcccactatgcatttcgtcttccctttgcctcactggagatccaagtgcagggaatgcttcatatgactgtgatccctagaacttcatcctcatgactgttgaaatcttctctgagttttaccagtggaaatggcaataaatagaaagattccagaaggtcccctagggtccatattttctgtacttcctctctaaaatatgtaaaatcaattatatttgctcttgctttatatgggctacatctgtgtccccagcacacaccctaacgccctgcgttgacaacttatccagtattgtattaagtctaaataggcacatgtttatcatattatttcttccaatttaatgagataattgtcatgtcaaatctttggattaagaaccatcagccagaaaaccacagccctgagaaaatagaaatagagtatttcaagctgttcagtttgcacaacaatgatgattctatagctcatttacaagatataaatattctgtttatgggagtaagagcaacattcacggtgagtgttgtagaccctccgccacatctgacagcatagcaattcaatagcacaagggtttgtgtgccagcagtgcttgactaataatgggttttttttctatagggaaagctgcacctgtgcacatgacaggatcatgagctacactttacttcactttttttgaagtcaattaccttcttgatccaaagccacagtatggaagaacttcctgactctgatgaaggcatttggaaaatcctcaaataatattttatgcagtaacataaccaaagacaaaggaaaattcatatataggataataaccactgctctcctcatgttacatgaagtgcacttgaatcacctgacatcagctgttagtatgagccctgatgtgtggtagaatgttaggggctcaggaagggtcaattttcttggcaaattagtgttcaagagagccagtagccctgtacatctcagttagttgaaactcatattattgagtccccacagggacctccgtaacagtggttcatgaggttacctgggaaagtgggcaaaggtgactgactgaagtccatgtgttcaatcatcctcattatgaaaagccccctgctcattaatggcatttggattaatattcactgagaaagcatgtttttcgattatggctcatttttgaaacatctagtcatagctcttccaaaatgactttgtctgcaatcatcctgttgtgtttcttttaaggcctgatgatctgtcaaaaccaacaaccaatattattaaattgctgttctctttgcaatgtggcaatgtgatcatcagatgtaggccttgcagtttacccacggttaggatttttacatttccagggattccttgacaatggcactaatgtgacgccatctagcatccattgttgtgagaactctatttggaatatcatcattgtgggcatgaacataatggagactttcataggatgcaatgattaatattcaacattagtcaaaatctgctgtagtcctacccttggagatctactggtttggaaaaatattttaggtaaggacaacaatttggtaaagttttaaaaataaaggctaaaaagaaattttctttagcaagagtatgaactatctgtggtccagaataccatttttttacagatgcaagaaaaaattatttaaatgtatataatttagataataattttgtaaatttgtatatattgcatatataatagaataaacataattaaatatgaatactatatatacttatagccaacattttatcaaataaatatatattaacttctatgtatcttatatatatgcacatttttccataaataaggtaaattttaattttttaatgaaatactaattagttttaatttcatctttaattttctcttaataacttcataatttgattacttaatgttcacatttataccaccaatttaagaaaaaacacatgtatctatatataggcagaggtgtaaatactgtatcagtaagcttttatgcattaatgattgataatcggttaaatatacaactcagtggctgataactgtaaatatttgttttcatcttcatggatgctcatgttcacaatcatctggctgattaaggaagggctcagctgattgattcctccgcagggcactgagcttgtctttagcctacagataccaattttctgaggacgaggctgaacagcagtgactacacgtgacacaagattcttgtgacaggtcacaggagtgaacaacatcccaaaccgaactgcacagttgaatttaagtccaataatttctaacatagcttcacacattttaaatatattttttgatttcagtgagtacaaattttcaagaaaatgtttactccaattaattatagaggtgtttgatcattccatggacaagtaattatgttttcaacctttacaatcctgaaaatatttgcaaacgtaaatttgcattaataagaaaataaagctggatgtgttttcaacatgtgcttttaaatataatttttgaaatgacctcaaagggggaaaatcattttaacttatgtaactatccctttttacctctcttgtgtcctatagagttgcccaataagaggtcctcccatgagatttggaatcagaaaaggatgactcaatattctccattggtacctaaggcagacacaggaacagaggtgaggactagagaaacacctgaaaagatgctgtaggaagctgagagcatcagcacccccacccctaagcttccagacaggactgaggaccacatggttagaaagcccttacttcagggacagatgcattctgttttctgagggagcaccagagattcctgcttctaatatcagctttcctgactactatatccttggctttgaaaggtcatagtgggaaagttaatcataggaattcggtcattcttgtgatacccgacagagccaagaaaccaggagggaaaggcactcagggtgaaaaatactgtttctagaatgcaattgaaataggccctattatcccatggaactaaagtttatggttttttgaataaacagaaatcgactcctccagtcttaaaactcaagatagcaacatttatcttacctttcttttttttttttttttttttttaaatttcaggaaagcaaccatcaggcctcccagatactatcaatttgctgaaacttatatatcactgaatcgggacagtgagacatcagacccttcacccattatgattgcctaactgacctcctgcttcctgttgacccaattatctttcttaaccctccctaactcctgtttttccacatttcttccttgttatataaacccctaatttcagttggtcagagagatacatttgagaatggcatcccatctcctcagctgcagcacctgattaaagcctggggcttgaaaatacttgtcttagtgattggctttctgtgtgacgagctgcaggatctacaccgaatccctggcatttcagtaacaaaattctctgcaagcttcaccgttttggtttattgtaacctgaaatcaaatttatccaaaacttctgagataacttgatataattctaggattcactttgtccaccactgcttaccagtctgagcttgccagctcccaacccttcctagtgccaatgagctttctcaaaagagccataggtaacattttccctttttcataaaatgctaaatttctctttgttcttccaacatattgaagaccactgagttttcctgtatgccccatttggcaaatatttctttgcaaataaaacattaaatttagagattcatctctacattttatttagacttcagtagtttactctaattctctgtattaagactatatctgcttcaaatatctatagtggcttcttctctgttatacgaattccaactgaagccataaactagactcttcaggtgtcatgatctctgtctttattaaatcaagagaggcattgctagaactgtgcagttggggctgagaaagagaaaagaattagggtgcagaggtgacttcgtgtccccctctaccaacaccatcagagtgtggctgcatctgaggaacaatctcagccaatggaggcatcaggaggagcagctggggcagcccagtctcacacatctgcttccctgggggtttctgttcgggtgtgtaacactgtgggagggtaattgtaatcttgtagacagtaataagttgcaaaatcttcaggctgcaggctgctgatggtgagagtgaaatctgtgccagatccactgccgctgaaccttgatgggaccccactttgtaaactggatgcagcatagatcaggagcttaggggctttccctggtttctgctgataccagcctaaatcatttctaatgccctgacttgcccggcaagtgatggtgactctgtctcctacagatgcagacagggaggatggagactgggtcatctggatggcacatctggcacctgagattggaaacacaaaaacaaatggtccacacaattaatcatgtagtaagagaatttccctgaatagccaggctgtgctgagcaccctgggctgagtaaactgccagtgttctccatccttacctgggagccagagcagcaggagccccaggagctgagcggggaccctcatgtccatgctgtgtcctgagtgggtctgactcctgcacagggtgtgatcagcctgttaataagtcttcaggtcaggagactgtgctctgggaacatgcaaatgagcaggggaaggggcaggctgggcacagctgcagggctggctcatctcagtaactcagcaccggctcagtgtccccaggtgtcccaggtaagaccagggtagcacaaatttgtctgcagagaatgtgtttctactggggactattttgttatgagaaacattttaaagatattttttgacaatattcctcgagagtcaatggggtaatatatttcattggtgtatggggattattttggagaatattcttgtttgtaggaaacacagtacatattagatggtacgattctcaggtcttcaaaagactgttataagattccatttagggaagggggtaattgtgctatacttgaaacatttctgtgagtttaacattgttcctttctaaaaaattaaaaataaaatttattgacatgatgctatatatatttgtaagtattaggtaatggtgttatgccattgttcttaccagtataagatcaaacaatttactacagatacacacccctgatgccgtgcttcttcaatgcatgtggcactaacagccccaccattatcaagagctacaggtctttttaatacccagagactaaatgggctgcacctgtgtagaatttttgcatccctaacttaagtactaatagattgcttttgattggaagccttagcaataaaataaatagttgattaacatgttttttaatgttatatatattatatactctattattccaataaagtatgctaaagaaaaaaatgttattaaggaaaccataaaatagagaaaatatatttactacttattaagcatttgcttacaggtgacacacacagaacaaaatataagtgtatctgcaaatttcaaacccaagttattcaagggttaactgtaccatgatgaacgtagcagtccccatctgtaatctagggctttcccctttgctgtacctctactcatttccaatgaccatatatatgtcttatgttctttatgatcttgggcagagaactctgcctggatgcattgctggccagatggcctggaatgtgtatctcttaggaaagtgctatggtttgactgtgtcctccagaatccatctattgtaaagttaattctcagtgtaatggtttttgccaggtggggcctattgggatgtgtttaggtcatgaggctggagccctctagcggaatacattaatgccactataaacaggaattacagggctgagatctctctcctgctcctctgacatgttaagacatggccttccttcctttgaagaactcaacgctccaggcatcatcttgaaagcggagaaagcagaccatgtggttgatcttcagttatcctgagtcaggtaggttgttgatgtgtcttttaccattcattttctgttccctccctcactttcctcctttcctcccagtataaatttgctacctaacaggaatccttattgctggtggatccaaactgagagagtaaaaaagaaaagtcattaatcttttgtatgaggggtatttctcatctgaaatcttaccatttctctttctttgatatgtacaaatattcaggaagcacctaatttttttttttttaccaatgtatcttagattgaatttacgctgtgattttttttctgtgtgttaaaacaaaaaatcaagttgtaagccaccaacctactcaatgggcttctcttttggcagagagaacgtcaaagaaatctgaaaaactaggttaggccatgactggcaggtgggtttagatgtaactcattatactctcctccctttggagttcagacaaaactgaccagtgttatcattacaacagagatctttagactgacaaatcaaatgctttgtagcaataagataccatactccaacatgacagataataggccctgaagaaaatctaaatattgtaccctaaaaatattttttttgatgtattctgaagtggccctgcaaagctgcctgttatgggggaaatttgcattctgcagagcatctcctcctcttactatgtcttttccaaagagttggacatttctttaaaggtctgataagcaacattcaccatctactttactgttacctgcaaggttcatctaagtgacaagaaccttgacttccacacccccttatctaaactcaaggatttctttatgatgaattcaactctttaggcagagcttaactctttcaaccagttgccaatcaggaaaactttgaagccacctgtgacctggaagcccctgcttcaagatatcccacctttccaggacaaactaatgtatatcttatatgtactgacttaggtctttccctgtaatttttgtgtctccctaaaatgtataaaaccaacgtgtaatccagccaccttgggcacatatttgcagggcctcctaaagctgtgtcacaggccataagccttatctttggcaaaataaacctatacattgattgagacctgtctcagatactgttttgtttacactgggtcacaaaagttaaaaatcctctaaaactctctacacatctataaatctacattagagacagtggagtgagtatacctcaactcaagtcatactttgagtttaagaaccagacagattttcaggtacttcgataaatgaggagacatttggaatagggtccttagcccagagctaaggtcaggctggcagtgcctgagcgcttccaggccctggccctggtctgtggaggaagccactgttctcctgagccacagggctgagaacctgggatgagccacaggccttggccgcagggctgcctggcagggtcttcagggagggaaactgctcacaaattcgcgggagctgcattaagcatatatccccccagcctggcaagagtgaaagtctcaggacacagaccttagggctggggctgggatcctgggctggctgctgtcagctgtgtcctcccttgtcctgaatgactgggaccctgctggagccaaagagggagggtcagcaaatgtcctcaaggtcttcactcagccagactctgttctgcttggaaagaaaaggaacacatgctacaaaaataaacataaaattatgtgtatttgtaatatgaatttctagtataaactttacatattaaatacatacattttagaaataagttatatttatatatttgtatatactatgtatctgtggataaatatgtgatgcatgtttatgtataaagagatgcaagtttcattgctagtataaggtatagttttaaactttaataaattgaacgtgaacattgaaaacaagcactgggtgcaccacctcatggcccctcctcactccagggcctgagggtcataaagctcgggactctcttccatgtgccccctgggccgatagcagtgagctacccattgctgaggatcatgagtgacctgagggggatctgcagaatcacagggcagcagatgcccaggagatggatagtgaatttggaccctgaatggagggacgttttgtccacagggctcagcacagacaagtccttttctggtcatttctgtcaagcaaagcagcacacatggctcagaggctgcatggtcagaggaataagcccctccatggctcattcccagcttcccctctgactggggtgatgtgggatctctctgcccagctttcatgactgaccagctgctgggaccctgttaacaatggcctatgtcagtgccatgcacaagcttcttgatagttaccattttactttctggtctccaataaccacaaattgccaaccatgaccgtttcacaaagattcatggagaggggtcagaattatgggttgagcaacgtgccggggcatgtatgtaagagaaacaaggtgtggccagcccatgtggaagtgaggatgaattttcatcatgaattcagagaaggaggtgggagaaagcatctgacatgcttcaggcagtgatggccacaagatacattagagatgttcatagaagaggtggcaagtgggtttgagatgaaaagggaatgtgaattcagaggtgtcccccagcctgttcccctgagaagatttcagacccttagcaacccctgggcccccaggtagagctgttgctagggaagatttgtacatgataggggacaggaagagggatcacctacctctgaaggcatcttggttggtagtggccagagtgacatctgttcaggcccattattatccctgacccaggcagggatcatgtccaggagggcagtaggagccagcaggagctcagagccatgccccagttctgctggtgccaggctaggatgttcttcatactctggccagccctgcaggtgacagtgaccctctaacctgagagacaaggaagaggatgaagatggcatccacataacatgctcactgtcatccaagtgggggaacaagcatgcagattcccaaatattaataccaagcttttatttcatccaacttgatgaaattctgatcagaaggagaaacagtctaacaaattcatcatcaaggaaagttcatgtttaatacaaactatctgaggctgaaacctgacttccccttcctcaccaggcagtcaggacagcaggagcaaaaggagaaaagctgggtcccaaagtccacaaggtgactcctggggctgatcctgctcagagaacgtggcaacagtggataagtctgccgagaatgccacaccatcatactctgagctggagggcttcaaccacagacatttattgctaatttattagacatttattgcgaatatattagaaccatggaaggttcaagatcaaagtccagaaggatttgctttctggtgagaaccctgtttgtttccagatgtcctctctggatacatcctcatgtgtgttcagcaatgtgccaggcatgtgtaagagaagcaagtgcatgctttactcagtacacgcttggaggctggtgaggggttcagtaacagctcaatgatatttctttttattaggacacaaatcctattaaatcagaaccccgatgttttcacctcatttcaccctaattacctcttcataacctctatgtctaaatgcagtaatattggaggttggagattcaaaatatgaatttgtgaaacaccattcagttcatagcaggtgcactttgaggatatggccaaggcagtaggaagggcaaggcaaggcttccagtctcagagcacagagggcattttcccaccactcagcacactggcagctcctcccaggtgatccaggtcacacatgagaccccattcctgccttgggggctgcctgctgataatgaaacaacatcacccttaatttcactatttctaagatcaggcttctattttgtgtttattatggggtttgtccaatggccaggtttgtgacataccacccaatggcaggtttgtgacataacatcttatagaattttagatgctggtttccagtgagacttgatggagttttttcatgggttttcatggagttgatcttattacatccatcaataggctgcattctgtagggaatacaaaacgattcctctcctcaataaaccagtcacctagttgaagataaagagttgagaaaagatggtcacaaaacaatcaggtgttaaattctgtgatccatgtgagatgccaacaatgtggttctgggaaagagagagtgaggttgtgaggggccctgcagagcacaatgtccagggctagggtcgggagtagagggcccctggtctggatctgtctactcagcttcattcctcccattgttgaaacagtggctgcaccagccagcaagcatctgagaccacctgattctctggactaacagctgctgaggtttgtgctctgagctataacactgtgagggtctaactgtaaccatttagatcagcactaatgaaaataattttttaatatggtgaaaatgtctgcaaatttctaacagaaaaattgatgaaaagatggtttttcttaggcccccacagcagtctctgcctgggacctgactttgtctttgagccagtggaatctatgctgagattgtaagctgggcagggaaatcacagcagggcaggctgtgctctgggtgctgaggaggacaggaggacactccttcagggttagtgatgctgggagttcgaggggagagactgcatggagctgcctgtgaatcgccctagcaatgccctctggacactgctcatctcacaagtgtactcggatgccagtggatggcccaaacatgggctcaggttggacaaggacaaagatttagggatgaatatatggggctcatttgatactctgaagtttcagcacaagcataacgaattatatggggagagaaagaagtcacaaggttgtgatttttcatttggtattaaaatatatcccctctgctcatttttccctgcagaatgtaactactgatacatatttaagcaaagtcactgtttttaattgttttagtaactgacagcctgtgtgcacagttcctaagtaactgggtagccagaccatcattcctatggtaaagccaggaagtgactgtggatgtgaacaaatgtgagtttaatgtacatgtctccaaagccacgggccactgatctagggagaacctgcagtcagtttgctttcccatgcccagatgagaggacaccttgatctgtgttcttctgatgaactctaaaaactctaaaaactgatgaactctaaaaactaatattctgaaggtctagttcatacttcttttctttgctagagggactctctcactcacatgtattgtactctctgcatagaacagtatgtgatacatacaacttgttttctgctaaatacccatcaatcatgtcattcatgagtcttccatagatgttacctgccctatgaatctgggctcttccaaaagaatgggccagaggtggagctgtgctttcacattctcttgtgcttccctcgtggacaacctttgctagttgtcacccttcccacccagcaaaagtaactgtctttctgacatctacacaatcatttaggttttcctgtcttaaacttcatataaatagcattatgtgtatttttatctttttagtcttggtattattccttactacttttgaggccttcatttcttccagtggactcaaggtcctgtctgatgtcatttcctgtgattctgaaggattttctctcaaatgttttataagacatagctgctatgaatgaatgtattttgtttaccaaaatttttttttttgcctttttgttagatttgaaggatattttcactggatagatttcctggctgccttcttttttttccttttcagcatttaaatatgtcattttactgcttctagcctctattggtcccgatgaaaacttagccaatggctacgttgttgtgtctctgtatatagtgtctgcttttattctgatgcaatgaagattttttctttgtctttcaacattttaatatagtgtgttcacttattaatttctattgactatctaaaagggttttattgaattatttcatctaagaatattttttattacttttgaaaagtttttgtcattgtatctccaaatattttttcagccactttctctgtctctccttctttgtgactctcattatacatttgttggtatccttcactctgagctataaatctctgacatttcttcctttttttctaaacattttctttaggctcaaacatttccattcctctattttcaagttaactgattgttctgtcatctcaatttgctattagacctagctaataaatatttaaattgtattatggtacttttcatttctagagttcccatttggtcattttttatactttccatttcttttcttgaggtcctacttgctgaatcttctttttaaaaatattttcgtttttatgtcaatgatcatagttttaaaaataattatttgaacatctgcatattaactgctttgtagtctttgctaaagccaataatgaggacaagttagaatcagctttcattggctattttctgttgtcattattgtagttgctttactttgttccttcaatataaatcatactcctctgtttttttttcaggattttttaaaactgaaagctgcacacttttgataatatattatagtacctctctttagattgtggggtttttattttaattttaatttttttagaaacagggtctcactctgtcacccaggctggagtgtggtggtgtgatcatagctcgctgcagcgtcaacctcttgggctccagtgatcctccagcttcatcctcctgagtagctgggactataggtgcatgccaccactctctgctatttaaaaaaaaaaatttgtagagataagggtgtcactattttggccagcctggtcttgaactcctggcttcatgtaatccttctgcatcaggctctaaagtagtgggattacaggcttgagctaccatgtcaggcctggaactggtttcatttttctgagcattttaaaatttttttcttagttacttgtcagaacttacttctggtacctgacttatgatagttggagttatcattttttgactttcagatggtgtgaaagtgatatgcattcaagtagaaatagtacttctagtatttatacaactattctatcttctctttcaatagagtattcaataaattgcatgagatattcaacactttgttgtaagataaggtttgtgttagataatgttgccctactgtaaactaatgtaagtgtactgagcacatttaggatagaataggctgagctagtggattacatatattaaatgtattttcaatgcatgatattgaaaaatctatatctcatatggtgtttgaccactgatatctctgctttttattcttaatatttagtttgaatttatagaaactgcacatgtatctgcacagcttagtggtcaccaatgatttgagaagaagttttgctcaaatatctggaggttataaatctatcttctgtcaatccatctgtgtgtagtttaaaaagctcctgcaaaatgcagctagttcttacctccctctggttttactttgcaccgggcacttctgggtctcatcactcatatctatagcttctaagtcaccaggaatgtgtgtagagattgtttcagcaatatggctctatcttacccaggaatctgctatttactgttagcaggtgtactacttgccccaaacagggcatcatctttgactaacaaagctgtgggctttttctgttcattccctatggagttctgcatgtttagctggaaacactgaagaattttacttcattccttggctttactcaagttcacccgctttggcagcaagctgctagctttatttgctatcctcatattggtaaaactccagttctgtatttcatgctgactgagctgggggtagaagggtgctgtcacaggcaaaaggctacagactttttctgtccttactcaaagcactagtacttttttttctataaagaatatacatctttaattattttatgcttcaccaattttcagagtgctgaaatagttttgatattttagctttatatgtgtgtttgttatttatttttgcacagaagatttattaaactctttgtgatgccataaacagagatgccttctaaaatgcatttaaatgaacataatagccatgctgaaatggaatgaggttatttactaacataagtaattttggacttgagaacttgaactcttcaccctcagtttaaagagaaaccaaggacttaaaaaatagagaatcctggtccctggatttcacattcatgaagaaatgcacagtcaatttttaagatgccttctttgtattctagaactgagcaaattagtgattacactctacataatgggagctatgattgtctttaatagagataagaattagaaataggaaaaggtagctgggtgcggtggctcatgcctataatcccagcactttgggaggctgagacgggtggatcacgaggtcaggagatcgagaccatcctggctaacatggtgaaaccccgtctctactaaaaaaatacaaaaaaattagtcaggcgtggtggcgggtgcctgtagtcccagccacttgggaggctgaggcaggagaatggcgtgaacctgggaggcagaggttgcagtgagccgagatcatcataccactgcactccagcctgggtgatagagcaagattccatctgaaaaaaaaaaaaaaaagaaagaaagaaataggaaagtgcaaaataggaggaaacttgtggaattgtttaaaaactacctttttcttattttttagttacttgtgtgtgtgttttaagtttatgtggaaatacttttagacctaaaatttgaaaaatatggtaaaaatgattcccatatgcgcctctttcagcttgctctaatgtcagcatcataaataaccacagtataagtatcacaaccatgaaatgaacatagatataatgttatttgttaactcatttaaaataccatatggatttcactgatttttcctgttgatgactttttttatgttacaagataaaattcaggtttctgtattttatttggttatcctgtcctcaatatctttaaatctgtgatagtttttcacttttgtttctctttcatggccttcaaacatttgaagtttactgtccaggtatgttgaagaatgtcctcctagttgggtttgtatatggtgtttactactgattcaattcacaccattaatttttggcaagaataatacagacaggatgtatcctcagtgcttcacatcagatgttacataatgtcaacatgtcttataggtggtaataaacgaatatgatcaatgaaatcccatttggaaggaagttttggacaaaaataatgaaaacaactgcttctatcactctttctactaggtcattgcagacgtcattaggaataatctatttcttccttatcgaatatgtactttattttaacaaactttaatctttttacagtctactgcatcacagagaaaattgaagaaataatttagttaacttttaaatggcaaatgtttccataataaccatttgccactgaaatgttgatagcctgaagaaagaaaaagaatgggatttattcagccatggtagtatcttcacatgaacagcttttaccgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaacagagtccaagaatcaaagtccaaattgttcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgctagtggccctggtggatgcaccatagatgaggagcctgggcgcctggccaggtttctgctgataccaggttaagtagctgctgctaacactctgactggccctgcaggagagggtgactctttcccctggagacaaagacagggtgggtggagactgtgtcattacaatttctctggtggtatccaagattggaaataaaacagaaatgcactcatgtaatctagatcaaaccagctgtctttgagtagagccaaaattgttgatctacattgaattttaattatatttcttgctgagcagaggtggcaggagttttcactgatgtgcaaaaccacctcatgttcccctcacctgggagccagagtagcaggaggaagagaagctgagctggggcttccatggttccgtctgggtcctaactgagcagttccttcccagggctctgacccaggcattgatatgggctctggaaggtagggcagctgggagggacatgcaaagcagctgggtgggagctgagcttccagctgcagagaccacctgcttcttcctctctgcactgagcgtcctgtgcctccctggttgtcaggccagaaaagtctgttggctcagtctgagtgtagaactcctcccttgtgctcacataatttcactcctgtgcctttcttctcttcaatcacctaaatacacccgtatgatatttggcacaagtctgttaagaacaatataaaaggctgtgttttcatttctctcttcctgtcctcagtatgcccagtcatctccctaagtgcattattggatctatggaaatgaagagtctgttagaacttaatcttccagatagacattttttttttttttttctgagacggagtctcgctctgtcttccaggctagagggcagtggtgcgatctccactcactgcaagctctgcctcccgggttcatgccattctcctgcctcagcctcccaagtgcctgggattacaagcgcctgccaccacgcccagctaattttttgtatttttagtagagacggggtttcaccatgttagccaggatggtctcgatctcctgacctggtgatccacccgccttggcctcccaaagtgctgggattacaggcatgagccaccgcgcccggcccagatacacctttcatttgcttattagtaatgttttctgagggtcctgaagctttccattaacccagacacataccctctttgagttaaaaacttctgtttacagtcacatgtcctggcagccctgacatagatgctccatggcttgccgattgcttgaaattaatcaagtaacttaacttccctgtgtctcggtttccatatctgtgtaactgtgacaatagtggtacctgccttacagtgctgtagacagtttaaagaaaataagataaaacatttacaatagtattcaggacattatgtatgtggcaattaattttgttttcattgtttaaatattcagcactacagtcatcatcattataaatatacttagcatggaaaatagtcttaaatctaatccaagaatgttttatccacagtcaaattaaattctaaggcattttcttcagtaactgtacacaactcttaaaatcctaatgatttgatcttaatctgtgctaaagtactcagaccttccatcattcccatccatccctgtctaacgcattacttctcatcatccattatttaaatgttaccctataaacggtccccatgtcctgttgctgtccttctttcttatgtaatctttattctaccttgttatcttttatgttattcttgccccaggactgacaataaggaaaagctaccatcatttcttgtagacttgctccagtataattttttcaggcttgttgtcttggaaatgaggattgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacgcttgcttcatggatttttacatgtatattagacatatgctgggtatatgtgcgcaacgacaatctaaaaactgaatgataactagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggctgtggttgccgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgttgtaggaacagggaaattgaatttttcatagatttatgtgacacttgtatcatgttggggagagaggcatcaaaccaggctcattactgaaagaattattacgttatttaagagagaaagaactgtgaatttcttgtcaaatagatgtttaaaattcaaaactactattttttttttggagatagaatctcactctgtcacccaggctggagtgcagtggcacaatcttggctcgctgcaacctccctctctccatttaaagcaattctcctgcctcagactcccaagtagctgggattacaggtgtgtgccaacatacccagctaattttcatatttttagtagagacgggattttgccatgttggcccggctggtctcaaactcctgacctcaggtgatctgcctgcctcggcctcccaaagtgctggaattgtaggattgagccactgtgcctggccctactgatgtattaatattattcatcttcttgaatacaccaagtggtaaagtgcaaatccacactttaaacttgagatttctcctcctatgtgaattatactagtgaggaacaaaaaaattctctgttggtggggagatgatgtttgacagcggtcagtttgtgaagcagaggcttatgtcacaggactttttacagtattacatataaacatggtgaatggcctcaaacacagaagaatcagcttttttcatgagccatactaccaccaagaaagaactgaattgaaacctgtgactacttgatgaagggtgtataaagaagagggaaagatttgggaggccaaggcgggtggaccacgaggtcaggagatcaaaaccatcctggctaacatggtgaaaccccatctctattaaaaatacaaaaaaattagctgggcgtggtggagtcccagctactcgggaggctgaggcaggagaatggcatgaactggggagtcggaggttgcagtgagccaagattgcaccactgcactccagcctgggtgacagaacaagaatctgtctcaaaaaaaaagaagagggaaagaaaaatgacacaaaacacaatgtcataaatggaaaggaagaagtcattacacagcctacaggagtaaaaaaataaagagaggatattatgagtaattttatgtcaactaacttgacaaaagtggtgcagggcaggttcttggctacactcaggaaggaatgcagcgtaagctggtggtagaagaaaacagctttactgaggtggcagtgttacagctttgtgtctgttcttgtgaaacagagctaccacataggcattgtgccaagagcagtagcgtaggggcagttttgcagtcatatttatccccacttttaatgacatgctaataaaggagtgggttattcaggaatagctagaaaatgggcagtaactttcaggttttgccatggcaatggtaaactgatatggcactggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacggaaccatgttattaatccatgtgtttgcaaaacaacaaccttaagttttctgttttataaatggaggttgtggtgtcccccttttgtggctgtaggaccttgtaagaaacaggtttaatcctgggcagctgtacccaactagtggcttcctgaagcctaacagtaattaagagtaataaagaatatctgataatggctccttattctggttattattgattcttgggggatcattttgttgttgttgttgttgttgttgttgttttttgagatggagtctcgctctgttgcccaggctagagtgcagtggcacaatcttggctgggctcactggaacctctgcctccagttttcaagctattttcatgcctcagcctcctgagtggctgggattacaggcatgtaccaccatgcccagctaattttgtaatattagtaaagatatggttttgctatgttggcaaggctgatttcgaactcctggcctaagtgatccgcccatctcagcctcccaaagtgttgagatgaaaacgtcacaggagctgatgaaaaaggaaaaggagacagcaatgatcccaggcctttttaaagggagaacaagctgaaagcagcaaaatacaacagttaaatctctaagacactaatctcagaagttttaaaagaaactcattatcgtatcacaggcaaaattttttgttttacttgttttttttttttttttttttttttcttttttttgagatagagtctcgctttgtcacccaggctggagtgcaatagcgtgatcttggttcactgcaacctccacctcccaggtttcagccattctcctgcctcagcctcctgagttgctagggttacaggtacatgccactgtgcctggctaatttttgtatttttagtagagacaaggttttactatgtttgccaggctggtcttgaactcctgacctcaaatgatcctcccaccttgggattacaggcatgtaatcccaaagtgctgggattacaggcatgggccaccatgctcagccttaaagctgtatttttattaagtaaagtgtagaagaaaaagtgtaaataaagtgacagaaggaaaacacaaggctgttatggaaaatgataaccttagggcagaaaacaagaaaaggcaaaccaagatttccatagggtgaggctccaatccacaatcctcggatgaatgtcaatgctaaaaaccctggagcctccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattcttacatccaagtgtcctgccttaaacaattgcacaaacataattagtagggacccaaagaaaaaactgcaaagcaaacacatatatcaggacagaaaataagataaaatggctgatggataaataaaatgtcattagaggagaaatgactaagagaaagatcaatgaggatgtagtcaggtgtgctatgggggacttcaaatggactatttagccaaaggccttatttcctggaccatctgacatagggcaggtgggtagatgggacacttacaggtgtgcaggagccaaaatggtgccaagcagtctctaacatgaggcctgcgtgaagatctctccaggctccccagcttgggtgggttgaactcccacgggtgaactggtgcatggagcggctggcctgcatgaagcagtggctctgtggccacttacctaactgctcagctccaccgcctgtcaggaaagatgatggctcttaaaacagcctttggccagtgttaacagctctgcaatgttagcaactatgtagctttaatcgctgtagcgccgatctcgccctctctcactgatcgctgacttgccacttctccaatagctgtctcgcccattgctgatcgctatgtccatcttctcacaaaatgccatctcttgctgtctcttgctgtcttgcttctccactgtttctgctgtctcaccaccacatcaaacactgcctctcaccatgtcccatttatcctccctccttattaaacatccatctgcatgtccaggcctggcatccccaggctgatgtctctgtcctgggccaggtactggagagtattgttcctccaacttcaccaataagccatggttctctcaaatcaaattatctcactgcaccaattttgccaaggtttgcagtgtactggtcaccaacttacccaaatctactgggacacaattcccatgcacaacgagtaacatgaagtggattactacctacagagagtcagtcagagagagcacaaagctgccggggcctgattgacactagactgtgcctaccccacaaggactgcagctgagggaccctggaatgcagcctaccctgggttttatgtcttagaatcacatgacacactgggctggagtgttgaaggaattcctgtttctagtagggacagaaacagaacccaggctgttctggccaatcatgccctatctcagaatgttacagttccagaacattctacagttattcctgaaaactacaatcaagaaaaggaaggagactgggttgattcatgactaaatggaaactgttctgcaaataccacagtgaaatcaaaactcagtatttttgagactgggttatttcacttagtgtaatgtcctctagttccatccatgttgtagcatgtgtcagaatttccctttttaaaactaaataatatggaatagtatgtatataccacatttggattaccagttccctcctttgtgaacatttgagttgcttctacatttagctactgtgaataatttgcttctgtatgtggatatacaaatatctcctcaatttaatgtcttccattacttgggtatatgtccaaaagtggaattgctgaattatatagtatttctatttttaatcctttgaggaattgccatcttgtttcccacagcaggtgggccatttacatcaccacgacagtgtccacaggagttccagttccctaaattctcaccaagactggtcatcctctgttggaaaaaaacattctaacaggcatcaggtgggttttgtttttatttttctaaggattaataatattgagcatcgtttcctatgctagttatctaaatatctctaaagtatcttctttagggaaatgtctattcatatacttttctcatttttaaccagttattttatttttactgttcacatgtagaacttatttttgtatagtagatattattaaccccttatcagatatgattttcaaatattttcttctattccacatgttgcattttcactgtgtaggttttatctcttgatgcccattttaaatttttatgtagtccaatttaattttttcttcttttgcctgtattttggtgttaaaggtgttagtatttaaatgtctgtaaatattcacttactacgctgagaatgtcacacttcaccttctctctctgatggtggagctaagagtgttacactctcccattttgtcctaggggacagtgaagctaggtgagaacccagtggcttttctgagcttatttgtcttgcatttttggtgacatggattgttgttcacatcagcttcctctggcaagtccacctggaaagcattatatttagcaagaaaaaaggaggctctgaatgatgtcactgtaagctgtttatattccctgttacaaatgtcaaatccgtgaagcataaagggatttactagaggatattaaattccttagaaattgttgaaaagccttaagcaacaggctccaggcaaagcctctggaacaattccaagaatggcactgctggcgcaggttggggaggagctcctgctgcctgagactccacattcaagctgtctcctgcaggaaagagagcagctcttctcactactgccccccgaaggacagctgctccgctatcaactactagagacctgacccctttctctgcagacctgcctgtgttgattacatcttcatttcagtctcatgtagattcatctgttttcatggattcaggggctatttctgcccaagtccaccctgtggctttctatcataaatacacatctttctacactcgaatttctagtcattactagtatcaacagcaacatgctagaacctcacataaagatttcctttacaaagaacatcatgctccccacgtagcattgtgctccccagaatgtggggaaagtccaatctgttcagcccaacaccatgtaggaaaaaaggctcttctctcatgagccgttaatctgtctacttattattaatttgtgggctaaactataaagactggtaaaaatagcacttcgaattcttttaacaaaagggtgtaaagaaaagattaaattatttaacatgcatatatgcatgactcatttcgttattgtcaccagcttctttcatatttattttattctctagtttctggcaatactttctctatggtagagtctggaaaggctactcctcatgtccttggcttcctaagtcccagatgtggtgaagaatgcccatcagctgtgttactacggagtgcttttggattgagatgagggaggggaaatggctgaactcactcaaatgtgatcattttcttggtctaggtcacagccaggcaacacagtcctctgggcacaatatcatcacttgccatgtttctatcaaaatgaaagtatctttcttgactgtggaaaacataggggtgggggcggggagggtcaagtaatagcaaaaggagtacttggagttgcctgagctgccactctggtttccccaaatgttttcaatccatttcattcatgataataaacacctttctgcctaaccagtcataatgacttttctcagatccaactgattcagtgataaacctatagagaaaaaataactacacttctccatgtttaagctgaccaggatgctgtccctggtgtttacacctccatatcccactatgcgtttcatcttctctttgcctcactggtgatccaagtacagggaatgcttcacatgactgtgatccctagaacttcgtcctgatgacggttgaaatcttctctgagttttaccagtggaaatggcaataaatagaaacattccagaaggtcccctaggttccatattttctgtacttcctctctaaaatatgtaaaatcaattatgtttgctcttgcttttatggactctatctatggccccagcacacacgctaatgccctgtcttgacaatttatccagtattttaataaatgtaaatggtcacatgcttatcatatcatttcttccaatttcatggaataatttcacatcaactctttggattaagagccgtcaaccaaaaaaccacagccctgaataaatagaaatagagtatttcaagctgttcatttggcataacaatgatgagtctacagctcattttcaagatataaatattctgtttatgggagtgacagcaccattcatacagttactgtttcagagcctccaccatatctgacaggacagcaattcaatagcacaagggtttgtgtgccagctttgcttgactaataatgggtttttctctgtctatagggaaagcacatgacaagagcatgagctacacttcacttcactttttttgaggttaataagttgcttgatccaaagctatattacagaagaacttcctgactctgatgaaagctcttggaaaatcctcaaataatattttatgcagaaatataaccaaaaaggaaggcaaattcatatataggaaaataaccagtgccctcctcacgttacatgaggtctactagtatcacccgacaccagctgttagtctgagccctgatgtgtggcgcaatgttaggggttcaagagacgtcattcttcttgacaaattaggtgttcagaagagccagtagccctgtatgtctcagttagttgaaactcatattattgagtccccacagggacctccataaccttggttcaggagacaccttggaaacctgggaaaggtgattgactgaagtccatctgttgaatcatcctcattattaaaagcctcctactcattaacggcatttcgattaatattcgcttggaaagcatgtttttattttggctcatttttgaaacgtctagtcatagttcttcctgaaccactttgtctgcaatcatcctgttgcatttcttttaagggctgatgatctgtcaaaagcaacagccaatattattacattgctgttctctttgcaatgttatcatcagatgtaacccttgcagattaaccactgttacgatttttacatttccagggatttcttgacaatggcaatgatgtgacgccatccagcatctatttgtgagaactctatttgacaaatcatcactgtgggtgtgaacataatggagactttcataggatgcaatggttaatattcaacattagtcaaaatttactctagtcctacccttggagctctactgggttggaaaaatattttagataaggacaatcatttcatagagttttaaaaataaaggctaaaataaattttctgtagcaagagtatgaactatatgtagccagcatacccttttttagtggcatataacaaaaattatttaaatgtatttaatttaaataattgtataaatatgcatatataataaacatacttaaatataaatactatacatgtatatttgtagccaacattttatcagataaatatatgtaacttttatgtatcttatatacatatatgcacattttccataaataaggtaaattttaattttttattgaatactagttttaattttgtctttaattttctcttaataacttcataatttaatactaaatgttcacatttataccaccaacttaagaaaaaatcgtgtgtgtaggtagaggtgtaaatactgtatcaggaagcttttatgcattactgattggtaactggttaaatccacaactcagtggctgataacagtaaacatttgttttcgtgttcatggatgctcatgttcacaatcatctggctgatcaagaaagggctcagctgagtggtttctctgcagggcactgagctcatcttcagcctacagatatgaattgtctgaggacgaggctgaacagcagtgactacacatgacacaatattcttatggcaggtcacaggagtgaacaacatcccaaaacaaactgcacagttgaatttaagtccaataacttctaacatagcttcacatattttaaatatattcctttatttcaatgagtacaaattttgaagaaaatgtttactccatttaattatagaggtatttgatcattccatggacaaataattatgctttcaacttttacaattctgaaaatacttgcaaatgtaaatttgcattaataagaaaataaagctggatgtgttttcaacatgtagctttaagtatatatatattttaatggcctcagtgggggaaaatcattttaacttatgtaaatatccctttttgcctctcttgtgtcctataaagttgcccaacaagaggtcctcccataagatttggaaatcagaaaaggatgactcaatattctccattggtacctaaggcagacacaggaacagaggtgagggctggagaaacacctggaaggatgctgcaggaagctgagaacatcaacactcccacccctaagcttccagacaggactgaggaccacatggttagatagcccatacttcaagggcagatgcattctgttttctgagtgagcgccattcaatcctgcttctaatatcaactttcctgactactatatccttggctttgaaaggttgtagtctgaacgttaatcataggcatcggttcattcttgttatacccaaaagagccaagacacccagtggggaaaggcactcagggtgtaaaatattgtttctagaatgcaattgaaataggccctgttatcccatggaactaaggtttatggttttttgaataaacagaaattgactcccccagtcttaaaactcaagatagttacatttgtcttatctgagttcttttttcagtaaaccaaccatcaggcctcgtagatactatcaaggagctgaaacatacatatcactgaatccggacactgagacatcagaaccttcacccattatgattgcataactgacctcttgcttcctgttgaccaaattatcttccttacccctcccaaattcctgttttcccacattttgtccctgttatataaagtcttaattttagttggtcagggagatacattcgcaaatggtgtcccatctcctcggctgcagtacctgattaaagcctgtttcttggcaatacttgttttagagattggctttctgcgtggtgagcagcagggtgtacaatgaatccttggcattttagtaagaaaattctctgcaaccttcactgctttggcttcttgtaacctgaattcacatttaactgcaacttctgagacaacttgatataattgatataattagtgaatcctaattcactttgtccaccactgcttaccagtctgagcttgccagctcccaacccttactagtgccagtgaactttctgaaaatgcaaaaggtaatattttccctttttcataaaacactaaccttctcttcgtacttccaatatattgaagaccactgagttttcctgtgtgtccaatttggcaaacatttctttgcaaataaaacatgaaatttagagattccgctctacattttatttagacttcagtagtttagactctaattttctgtattaagacaattcctgcttagaatatctatagtggtttcttctctgttatttgaattccaaccaaagccctaaactagactccttaggtgtcaagatctctgcctttattaaatcaggagaggcattgttatgtctgtgcagctggggcttacaaagaaaaaggaattgggttgcagaggtgatttcaggtccccctctaccaacaccatcagagtgtggttgcatctgaggaacactctcaggcgatggaggcatcaggaggagcagctggggcagcccagcctcacacatttgcttccctgggggtttttgtttgggtgtgtaacactgtgggagggtaactataatactgttgacagtaataagttgcaaaatcttcagactgcaggcagctgatggtgagagtgaaatctgtcccagatccactgccgctgaaccttgatgggaccccactttgcaaagtggatgcagcatagatcaggagcttaggggctttccctggtttttgctgataccaggctaaataactgctaataccctgactcgcccgacaagtgatggtgactctgtctcctgtagatgcagagaatgaggatggagactgggtcatccggatggcacatctggcacctgagattggaaacataaaaacaaatgtccatacaattaatcatgttgtaagagaacttccctgaagggccaggctgtaccaagcacactgggctgagtaaattcctagtgttctccttccttacctgggagccagagcagcaggagccccaggagctgagcggggaccctcatgtctatgctgtgtcctgacagggtctgactcctgcatgaagtgtgtccagcctattaataagtcttcagggcaggaggttgagcaggggatggggctgactgggcacagctgcagggctggctcatctcagtaactcagcaccagctcagtatccccaggtgtcccaggaaagaccagggtagcacaaatttgtctgtggtgaatgtgtttctactggagagtagtttgttatgagaaacattttttatgtatttttttgaaaatttgaaatattcctcaggagtcgacggagtaatgtatttcattggcacatggggattatttggaatatcttgtttgtaggaaatacatagtaaaatgttaaacagtatgattctcaggacttcaaaagactctcatatgattcgggttagggaaggaggtactttgtcctatacttcaacatttctgtgagttttaacattgttcctttctaaaaatattaaaaataaaatttattgacatgatgctatacatatttgtaagtattaggtaatggtgttatgccattgttcttaccactataagatcaagcaatttactacagatacagagagatgataccgagtttcctcaatgcatgcagcactcacacatccaccattatcaagagctacaggtctctttaatacccagagactaaattcacttcaccttattcttgttttgggcaccttcattgtctaccttcttttctgtcattgagtattactttccaaagttcttctctcttattgagggtgaccactgcatggagcatgtccctgtcatgcaccaacaatgccactttcttcttttacgttttatcagggacatcatcctgacccagacaccatcctccctgttaacatctttaggaaagagacaatcccttatcaagcaattgccaacttacatggagaaatcagctggatccagatgaaactggacatggatttgcagtcattatatctcacatctctactgtgccaaaaatgtcccagcctggcttagtagcaggggacgtggatccaactacatcagcatcagtgggctgcagcctaggactccacaaaattttactgatgcctgactaggggagacaaatcacagtgctgtagcccatgcacaaaccttcctgctgctttgtaagccacctgaattttaagggaacttgcttatattgggagaagggaagaaagctccatttgtcctctaaatgtttgctgaaaatgaactgacaaaagaaagactaataagagaaaaggcaagcaaaattcacttaaagtgcagtgggatatcatagcggtgtgattactcagataactcaatgagatccagttgttcatacttcctttctagcgaagaggtaattgggaagtgtaggcaacctggagagaatagatgaggatagaagtgcatcctcaaaagaacaggtaatagcctgtctggataaagcatcaacttctaatctcttctatttttgattcctattttgtgttaatcttccctgatataaaatttcccaggaagaattttcttgacaatcagtttccttctggagaagctgcttttaagcagataaaggagtgagataaaggagtggagtgagcataccccaacagctaaaactcacaagttagaggatttataagtcagactctaagtctcagattttgtaccgccctcttgcttcataaaaatgctttgttattttttaaattttactttaaagaaggacaattttggagaatatattaatttttggtggaatgaataatgtccccaccccaaaagatatccaggtccttgtctctggaacccaagttttataggagttattaagaaattattttaggcagatagagaggaaaaggcatccttggtaagattttgtttcttttaaagcaactccagacatgtttcttgtctaataggaaagctccggctcttagagccaggctggcaagatttgatatgcaaatgaaggccattagaaactgggtccaccctaacatggctattcctaccttcttcttccttgcccctacatgtgcctggcaacatggctgcccccacatatccccatgtgtgtagaacattatgatgccctacatgtgcatattgaaaggctagggtgggagggccagtttttgctcaggctatgtgaataacatgcctggtcaaaccaatcccttgagccctttgcaaatcagacaccacctccttcattctcctcatataagcagccacttttccaccacagatggagttttctctttgttggaatcccctgtccctctgtctttgtacagggtagctgtttagctgttttattcttccttccttcttacatattaaacttttctctccttaaaaccactccacatctttctgtggcattttatccaaagcagtgtgaaacagcaagaaccctggtgttcctccagtcattggagccatatcataaggattctaccttatgatagatagcaaaaaatgaccttgatagatgtaagttaaggactttgagaataagcttcctggttatccagatgaaatcaatacaatcacaaaggtccttaaaatagaggaggaggattgcagtcagagaggagctgggacaatggggacggatgttgtttgaggaaggaaggggccatggaaccagaaatatgggagcacattgaagataagaagcagagaatccagttctctcctctggagcctccagaaggattacagccccactgacaccttagcattagctcagtgagacttctgacctccagaactacagggtaatacatttatgttgtgtgaagccaataagactgtggcaatttaaacagcagcgttggaaactaatgcaaggggaagagatgtctttcagctcactgagagcatgcttgtcctctgttcttggaaatatttccaccttgttatctggtgtcagacaagagacagagaaaattttttctgagagaagagctcgtacaaaaattctttttagctagaaattctctttggaaaatcccatgattatctcttatacgatctgggtatcacagagtttaggggtcagaactcacagcacatgataggaggaagagggttttgttagtttgttttcatattaggagggaaaattagattttcaggacacaatctgagagggacagactgggacagggatattgtaagagaaagaggagatgtggaaggtgtcagagcaatgaaacatgtgtccctgcttccaaatctaaaataaagtcattgattttagaaggtgaagcaaagctcttcaccttccatcttcttatgaaggatcaaattctacccagagttcctgtccctcctttactcccctgacattgtattgtggagctaatcacatgtgccttaatccctgctcctgtcccgggctgggagaggctcactgtcctcaccatgcccagcaggctagagctcatgccctagacaccaaaggagaagaggatggtttctgtacaggaggtaagagctttaccacatgttacatttcactataattctaagtaaagttgtgtggagagaagagaacatatgggcaactctgtctggtagagttggaagagggcagtttctgagagtgacaatgaattcacatttctaaattttcagatggcaaatgctagctttagcaattgtggaaatgtggactttgagtttaagaacaagacagactttcagatactgcaataaatgaggagacatttggaatagggtccttagcccagggctaaggtcaggctggcagtgcctgagagatgccaggcactggccctgggctgtggaggaagcagctgctctcctgagccacagggctgagaatctgggaggaaccacaggccctggccacagggctgcctggcagggcttcagggaaggaaactgctcacaaattcaggggagctgcattaagcatatatcccccagcctggcaagagtaaaagtctcagagacccagaccttagggctggtgctgggatcctgggctggctgctgtcagctctgccctccctggtgctgaatgactgggaccctgctggagccaaaaacggacagtcagcaaatgtccttaaagtctttactcagccagactctattctgcttggtcagaaaagaaacacacgctacacaaataagcataaaattatatgtatctgtaatatgaatttctattgtgaactttacatattgaatacatatttaagaaataagttgtatttatatatttgtatatactatgtatttatgaataaatatgtgatgcatgtttatatataaagagatataactttggttgctagtataaggtatagttttaaacttaaataaatttaacatgaacattgaaaatgagcactgggtgcaccacctcatggccctcctcactccaggacctgagggtcataaagctcagtaccctcttccatgttccccctgggctgagagaagtgaactgcccgttgctgaggatcatgagtgacctgaggggggtctacggaatcacagaacagcagatgcccaggaaatggatagtgggtctgggccctgaatggagggacgttttgtttccagagctcagcatagacaagtcctcctctggtcatttctgtcaaacaaagcagcatatatggctcagaggctgcattgtcacaggatgaagcccctccatggctcattccagcttcccctctgactggggtgatgtgggatctctgcccagctttcatggctcaccagctgctgggactctgttgacaatggcctatgtctgccccatgcacaagcttctcaatagttgccattttactttctggtctccaataaccacaacttgccaaccatgacccttccacaaagattcatagagtggggtcagaactatgggttcagcaacgtgccggggcatgcaggtaagagacacaaggcgtggccagcccgtgtctgaagtgaggatgaatttgcatcatgaattcagagtaggagatgggagaaaacatcctgacatgctccaggcagtgatgcccacaagatacactagaggtgcccatagaggaggtgggaaggggatttcaggcagaggggatgcgaatttagagatgtcccccagcctgttcccctgagaagatttcagacacttagtagcccctgggcactttgagagaccgaggagaaaggaccatgtaaggccaagaatttgatgccagcctgggcaacacagggagaccccatgtctacaaaacacacacacacacacacacacacacacacaatttgttaaaatgtgtgaaaaatagcatcacaaagtgattatgtatgaacatttgctcagaaaattagaaaacaaagcaatgtcttctgagctaacaatactataataaagatgtcaattttttagctatagtaatacagagaacatgatattgtctatcttaaccatttctaagagtgtagtgcaatgccattaaatatattcacattgctctgctattattactgatactaaatccagaaccattttcatctgaataaaattaatatctatatcctttaaacaatactcccccccatttcctctatccctaccgccagcaacctccattccagttctgtctctatgtcattgacatatttgaagcaggttcactctgcactggttaccaacatacttgagtgtggggaacacaacacccccacacagcaagttacatgaaatgggtttattatttacagataagcagcaagggaacaccacaaaagtcttggacttattatgggtcagtccctcaaggcacaggaaagccatgtggagctgatggagttgactatgtgtaccccacatgcaccacagctcaggaatccaggaaagcagccactcagggttttatatcctgagctaagaagacacacagggctaaagtgctaacggacatcctattctatgggaaactggtatagagcacaggtaggttgttctgctcagttcctctccatctcaggatgttacgattccagcaaattctacaattattcttgagaactcataaaataagcaagaaagtggagagaactaagtcagtccagggtcattggagaactgttttgcaattaccccaccacctagacatcccccttagcaaagctagcatatttcatatgcccaccaacttcccttgaactggaggcagaagtttatcttttcagattgatgaagcaccttgactaacacaacttcaatgcagattatgaagccatagtgagagtacatttcactgggccacgaaaagctagtaccactggtgtagggtccagccctgtggggcttagtgggggttctccccatgtgcagagatgagagattgtaataaagaaagacacaagacaaagagataaagagaaagcagcttggcctgggggaccactaccatcaagacgtggagactggtagtggctctggacggctgggcacactaatatttattacatacaagacaaggggggcagggtaaggagggtggatcttccaagtgattgataaggtgaagcaagtcacgtgatcataggacagggggcccttcccttttaggtagccgaagcagagagagagaagacagcatacgtcagcattttcttctacgcacttataagaaagatcaaagactttaagactttcagtatttcttctaccgctacctactacgaacgtcaaagaggaacccggagtatgggaggaacatgaatgtggacaaagagtgtgaccattgaggcacagcaccacagggaatggtttaggcttccggatgactgtgggcaggcctggataatatccagccttccacaagaagctgggggagcagagtgttccctgactcctccaaggaaaggagactccctttcgcggtctgctaagtaaagggtgtcttcctagacactggcattactgcttgaccaaggagccctcaagtggcctttatgcaggtgtgacagagggctcacctcttgccttctaggtcacttctagcaatgtcccttcagtacctgacactatactcttaggttattcctaggttatattagtaatgcgacaaagagtaatattaaaagctaatgattaataatgtttataatagtgattgataattgtccatgatcatctctatatctaatttgtgttatgactattcttattctaactattttctttattctactgaaacagttttgcctgcagtcttttcctcggcacctacgtaatctttcacacacacactggcaggagggtaagactccccaaagcagtgactaagatgttaagaagtgaaagggggatctttcagatgccctattctctgcagccagtgggcctgctttaggatcacctctacttgtatttctagaatacccgaggtgtttatccaggcacagcaggtagtattgggtgttggtaattgcgtggaaagtctccgttgggttcctcaagaatgtgcccattgtcatgcggattgggcggttgtttcttggtcagagtgaagtctcatggggtatccaaaaacatgacataaattcctttcaaaggtcaccatggtagccccagcatctaactgagtgacatacatttagctgtccaggaagcaagctatggccatagtccttttccctacacaggggatcctttaatagttctgccactcagttgctattttcctgaccagatggctgggttgttggcaatggcccatgatttagtggaaatggagcaaaatatagtgttgggggcagcctgcatggctactatcattgcatgaagtttggcccactgggcagaatgtccatgttcagtgtcagtcaaaagatgccatcccctggctggatggtggcctcacccagtggacccactggcatgtattttgtacaatcatcagggccccatgccatactgacataggcatgtctctgaatcgttggctcattgtggccaaaggaaaaacaaaattgtcccctatgggtcatttgttcccttctaggaagcttgctatttgtttatgggcattcatccatttgcacatggatcctgtgggaactgggttagggcgaattctgactgtaccagttccatttaataatttggatctgttgggcctgtccagttttattgattgtgtttgtaggcaccaaagtgagaatgggtagttaaggtagcagcgtcatccctgatgctctagctatgagataatcagcccctatcagtttcctacagcaagaagttgccattcaaaagaggcacaactggtggcttctgttgccacaggctccagtcagcatatatagaaatagtggacacctggatttccattgagcaagcagcctctgaaggtcttaaagaagtgcctcagtcatgccttgttgaacagattccaagggtgattttgactaacatgaccaaaagaacacccaggtaaggtttctactgtccccagtaccccaaaatacctactagcttctgggtctccatcttattagtggacgccaccaggaccagcaatgattaaatatacctgggatacctcctaggtttctttttcaggtggccttggcattcagccttcaacaatccatcattggtctgccaaactgggttgttccattgtgacaccaggctttgtgacattttaatctttttgtagcaactattaaatttactaggtagtgttccgatcttcactgaatatgcagtcctgctttgtgaacaacactctgggacacgggaagcttaggtggcaggcaggagtggatatgccccactgtcgtgtcttgaatacttagctatgagtgcggatagcccctcaggcagcagtgatgttttgtggcacagcagcaaaatgtcagtacctctattgcactctgcagtgagaaccatggtcaccagcacccaacatagcccaaagggtgtggtccacatgcagatcagcacacaagcacatactcaccatggggtcctcatttgtcttgacaccttctgatgtcttcagtttatttttttccagggaggacctggtaatattgtcaggtggattgcagcatacaaaaatcccagaatagtctgaattcttttttttttttttcaccttttatcttgagaggaatatagggctggtagcctctggtggagaccttggccctgttcctacctgtgccattcagacagacatttgggtctgcaatgtggcttaaccaaacaaacacaccgaccaggctgcataagacttccctcgtgtttttccatgtctcttttatagagagtgagcctccttttctgtgatggccattgttgttcattttggttccttatcagatgcttcagggaccattgagattatctttcttgtgtcatcttgggtgactcagggtccatctgattacccatgtcttgagctctcttgcctcaggaatgagcaatcatgcaactgtctaacaactagaaaattgtgtaccccattcctatttccacattcttttttctatgtctcaattcagtcagccagctgatccatattaatgggaggaggacaaatgtcctgtttatcctccctcctcattaaacatccatctgcatgtccagcccttgcatctccaggctgatatctctgtcctgggccaggtactggagagtattgttcctccaacttcaccataagccatagttctctcaaatcaaaccttctcactgcaccaattttgccaagaaggtttgctgtgcactggttgccaacttacccaaatctagtgagacagaacacccatgcacaaccagttacatgaagtggattactacttacagagagtcagcatgagagagcacaaagctgtcagggcctgattgactctagaccatacatacccaacaaggactgcagctgagggaccctggaatgcagtccaccctgggttttatgtcttagaatcacatgacacactgggctagagtgttgagggaattcctctttgtagtagggacagaaacagagcccaggatattttggccaatcttgttctagctcagaatgctacatttccagaacattctacagttattcctgaaaactactagcaagaaagggaaggagactgggttgattcatgactaaatggaaacttttctgcaaataccaaagtgaaatcataactcggtatttttgagactgggttatttcacttagtgtagtgtcctctagttttatccatgttgtagcgtgtgtcagaatttccctcagtaatgtgcttttgtatgtatataccacatatggattaccaattccttcctttgtgaacatttgagttgcttctaccttttggctactatgaacaattcggttctgaatgtgggtatacaaatacgtcctcaagttaatatcttcaattacttgggtatgtgtccaaaagtgtaattgctgagttatatagtatttctatttttatttctttgaggaattgccatcttgtttcccacagcaggtgggccatttacatcaccaagacagtgtccacaggagttccagttccctaaattctcaccaagactggtcattttctgttggaaaaaaatcctaatatgtgcaaagtggggtttgtttttatttttctaaggattaataacattgagcatcttttcttattctagttatctaattatctctaaagaatcttctttagggaaatgtctattcatgtacttttctcacttttaatcagttattttatttttactgttgacatgtagaaattatttttgtatagtagatattattaaccccttatcagatatgatttaaaaatatttttttctgttccacatgttgcattttcactgtgttgattatgtcttttgatgcccattttaaatttttatgaagtccaatttatcttcttttctacctttgcctgtattttggtgttaaaggtgttagtatttaaatgtctatacatactgacttactatactgagaaggtcacactccaccatctctctgatggtggagctaagagttttacactctcccattttgtaccaggggacagtgcagctatgtgagaacccagtgactttcccgagcttatttgtcttgcatttttggtgacatggattgttgttcacattggcttcctctggcaggtccacctgaaaagcattatatttagcaagaaaaacaggaggcagtgaatgatgtcactgtggattgtgtatattccctgttgcaaatgtcaaattcgtgaagcataaagggatttactagggatattaaattccttgcaaattgttgaaaagtcttaaggaacatgctcctggcaaagcctctagaacaattccaagaatggcactgctggtgcaggctggggaggagctcctgctgccttagactccacattcaagctgtctcctgcagaaaagagagcagctcttctcactactgcccccagaaggacagccgctctgctatcaactactagaaaactgacccctttctctgcatacctgcctgtgttgattacatcttcatgtcagtctcacatagattcatctgttttcaaggctgcagggtttatttctgcccaagtccatcctgtggctttctatcataagtacacatctttctacacttgaatttccaggcattactagtatcaaccacaacaggctacaatctaacataaatattttctttacaaagaacatcatgctaccaatgtagcactgtgctccccaaaatgtgaggaatctccaatctgttcagcccaacaccatccaggaaaaaatgatcttctctcatgagccattaatctgtgtacatattatttaatatgtggtctatattataaaggtggctaaaaatagcactttgatttttttaaagaaagggtgtattgaaaagactaaattatttaacatacatatatgaatggctcatttcgttattgtcaccagcttcttccgtatttattttattctctagtttctggcaataatttctctatggtagagtctggaaaggctattcctcatgtccttggcttcctaagtcccataggtggtgaagaatgcccatcagatgtgttactacagagtgcttttggattgagatgagggaggggaagtgcctgatctcactcaaatgtactcaatttcctggtctgggtcacagccaggcagcacagtcttgtgggcacagtatcttcacttgccatgtttctatcaaaatgagagtatcttccttcactgtggaaaacacggggtgggcagggtgagggaatagcaaagggagtacttggagatccctaagctgccactggtttctccaaatgttttcaatccatttaattcatgataataaacacctttctacctaaccagtcataatcgcttttctcagatccaactgattcagtgataaatctaaagagaaaaaataaatacacttttccacgtttaagctgaccatgaatgtttccacctccatatcccactatgcgtttcatcttccctttgcctcactggcgatccaagtgcaagtaatgcttcacatgactgtgatccctagaacttctacctgatgactgttgacgtcttctctgagttttaccagtggaaatggcaataaatagaaacattccagaaggtcccctagggtgcatattttctgtacttcctctctaagatatgtaaaatcaattccatttgctcttgctttatatgaactagacctatggccccagcaaacaaactaacaccctgtgttgacaacttatccagtattgtctttaagtctaaatggtcacatgcttatatcatttcttccaatttcttgggataattgtcatgtcaactctttggattaagaatcatcaaccaggccaggcgtggtggctcatgcctgtaatcccagcactttgggaggcagaggcaggcagatcacgaggtcaagagatcaagaccattcctggcccacatgttgaaaccccgtttgtagtaaaaatacaaaaattagctgggctacaggtggtgtaccccctgtagtcccagctactcgggaggctgaggcaggagaatagcttaaacctgggaggcagaggttacagtgaagccgagatggcgccattgcactccagcctggcagcagagtgagagaccgtcttaaaaaaaaaaaagaaccatcaaccagaaaaccacagccctgagaaaacagaaatagagtatttcaagctgttcagttggcgttaacaatggtaagtctacagctcattttcaagatatatatattctgtttaagggagtaaaagcacccatcacggttaatgtttcagagcctccaccacttctgatcgtatagtaattcaacagcacaagggtttgtgtgacagctttgcttgactaataataggtttttccctgtctatagggaaagttgcacctgtgcacaagacaagatcataagctacacttcgctcttcttttttgaggtaaataacttgcttgatccaaagccattttatggaagaatttcctgattctgatgaaagcacttggaaaatcctcaaataatattttatgcagaaacataaccgataagaatggcaaattcatatataggaaaataaccagtgctttccttatgttacatgaggtccactagtatcacctaataccagctgttagtctgagccctgatgtatcatacaatgttaggggttcttcttgacaaattagatgttcagaaaagccggtagccctgtaggtctcagttagttgaaagtcatattattgagccccccagagacctccataacattggttcatgatactccctgggaaagctgggaaaggtgactgactgaagtccatgtgttgaatcatcctcattattaaaagccccctgctcattaatggcattttgattaatactcacttggaaagcatttttttggattgtggctcatttttgaaacatctcatcatagctcttccagaatggctttgtctgcaatcatcctgttgtgtttcttttaagacctgatgatctgttaaaaccaaaggccaatattataaaaatcctcttctctttgcaatgggatcatcagatgtaaccttacagtttacccacggttaggatttttacatttccagggcttccttgacaatggcactgatgtgactccatccagcatctattgttgtgaggactctatctggcatatcatcattgtgggcatgaacataatggagattttcacaggatgcaatggttaatattcaacgttagtcaaaatttcttctagtcctacccttggagctctactgggttggaaaaatattttcatgtaaggacaaccatttggtagagttttaaaaataaaggctaccaataaattttctgtagcaagagtatgaactatttgtggtccagaatacaattttttatggaatgtaacaaaaattatttaaatgtattcaatgtagataataattttacaaataggcttatattgcatatataatagaagaaacacaattaaacataaatactatatatatgtagccattttaacaaataagtatatatttatttatacatatcttacatacatttatgcatatttttccacaaataaggtaaattttaattttttattgaaatattagttttaattttgtcattaattttcttttaataactttataatttgattactaaatattcacatttataccaccaatttaagaaaaaatacatgtgtgtatatataggtagaggtgtaaataatgtatcagggagcttttatgcataatgattggtaactggctaaatacacaactcagtgactgataacagtaaatatttgttttcatgttcatggatgctcatgttcacaatcatctggctgatcaaggaagggctcaggtaagtggtttctctgcatggcactgagcttgtcttcagcctatacatattaattgtcttaggacaaggctgaacagcagtgactacccatgactcaagattcttctggcaggtcacaagagtgaacaacatcccaaaccaaactgcacagctgagtttaagtccaataatttctaacatagcttcacacattttaaatatattcctttatttcagtgagtacaaatttttaagaaaatgttcactccatttaattatagaggtgtttgatcattccatggacaaataactatgatttcaacttacagtattgaaaatatttgcaaatgtaaatttgcattaataagaaactgaagctggatgtgttttcaacacgtggctttaaatataatatacttaaatggcctcatgggagaaaattcattttaacttacataaatatccctttttgcctctcttttgtcctatagagttgcccaataagaggtccttccatgagatttggaaatcagaaaaggatgactcaatattctccattggtacctaagacagacacagggacagggatgaggacaggagaaacacctgaaaagatgctgtaggaagctgagagcatcagcacccccacccctaagcttccagacaggactgaggaccacatggttagatagcccatactttaggggcagatggattctgttttctgagggagcaccagagaatcctgcttctaatgtcagctttcatgactactatatccttggccttgaaaggttgcagtgtgaacgttaatgtaggaattgggtcattcttgacatacccaacagagccaagaaaccaggagggaaagacactcagggtgtaaaatattgtctgaagaatgcaattgaaataggccctattatcccatggaagtaatgtttatggttttttgaataaacatagaaattgacttccccagtcttaaaactcaagttagttacatttgtcttatctgagttcctttttcaggaaacccaccaagaggcctccagatactatcagagagctgaaacttacatatcactgaatcaggacagtgagacgtcagacccttcacacattgtgattgcctcactgaccttctgcttcctgttgacaaaattaacttcattacccctccctaattcctgtttgcccacatttcttccctgctatataaccccctaattttagtttgtcagggagatacatttgagaatggggtcccatttccacagctgcagcacctgattaaagcctgtttcttggcaatacttgttgtcttagtgattggttttatatgtggtgagcagcaggatctacaccaaatccctggcatttcagtaacaagattctctgcaagcttcactgctttggcctcttgtaaccggaaatcaaattcaaccccaacttctgaataatttaacataattctaggattcagtttgtccatcagtgcttaccattctgagcttgccagctcccaaaattttctggagccaataaactttctcaaagagcaataggtaacattttccttttttcatgaaactctaagcttctctttgttctttcaacatattgaagaccattgagtttttctgtatgccccatttagcaaatatttcttagcaaataaaacatgaaatttgagattcatctctatatttttatttagacttccatagtttatactctatttctctgtatcaagacaattcctgcttagaatatctatagtggcttcttctctgttacttgaattccaactgaagccataaactagactcctcaggtgtcatgatccctgccttttttaaatcaggagaggaactgttatgtctgtgcacctggtgctgagaaagaaaaagaaattgggatgcagaggtgacttcacatccccctctaccaacaccatcagagtgtgcctgcatctgaggaacactctcagctgatggaggaatcaggaggagcagctggggcagcccggcctcacatgtctgcttccctgggggtttatgttcaggtttgtaacactgtgggagggtaactattaagctgttgacagtaataagttgcaaaatcttcaggctgcaggctgctgattgtgagagtgaattctgtcccagatccactgccgctgaaccttgatgggaccccactttgcaaagtggatgcagcatagatcaggagcttaggggctttccctggtttttgctgataccaggctaaataactgctaatgccctgactggcccggcaagtgatggtgactctgtctcctacagatgcagacaggaaggatggagactgggtcaactggatgtcacatctggcacctgagattggaaatataaacacaaatgtccatagaattaatcatgttgtaagagaacttccctcaagagccaggctgtacggaacacactgggctgagtaaattcctagtgttctccttccttacctgggagccagagcagcaggagccccaggagctgagcggggaccctcatgtccatgctgtgtcctgactgggactgactcctgcacaggtgtgaccagcctattaagaagtctttagggcagggggtggtgctctgggaacaagcaaatcggcagggggtggggcaggctggatacagctgcgtggctggcttatctcagtaactcagcacaggggcagtgtccccagtgtcccaggtcagaccagggcacctagatttgcctgcagagaatgtttcttcctaaaggatattttgttaccaagtacatttttgagcatttattggcaaatctcgaagtggttgtgagaactagatggaataatatatttcaatgccgtattgggcataagtaggagaatatccttgtttgtagagaattcttaataaagtcttagagagtggggctatcaggtcttcaacacactgtgaaattgttccagttgggagcgatactttgtgacatacatactacatttttgtaagcatgaaattgatctttttttaagtaaaaaagaacacttagtcatgagcaagtaaaatgttctcaaaagcattttgtaatggccctaaaccaatgttattaccagtctaagctgaagaggtttactgcagattgacaaagaagatgatattgggattccttaaagcatatgacatccacagttcctgcattgtccagagctataagtctctttaatgctcgagttttaatgggattcattttattctctgcttggggacccccatattctacccccttttctgtcattgtgaattatttcccatggtccatcagcataaaagtctgactagcaatgctaaatctgattactttaaaacaattttttttcttcttctactacaggagccttgattagcataaacttgaatctttgtgttagtttgcttaggataatggcctccagcaccatccacagtgttgcaaaagacatgatctcatttttcatagctgtatattaagtattccatgttgcatatgtaccacattttctttatccaatctacaactgatgggcatttaggttgcttccacgtctttgctattaggaatagtgcagtgatgaacatacacatgcatgtgtctttatggtaaaatgatttatattccttagagtatatatccaataaagagattgctgggtcaaatgatatttctgttttaagttctttgcaaaattgccaaactgctttttataatggctgaactgatttatattcccaccagcagtgtataagcattctcttttctccataaactcactagcatctgtcatttttaagtttttaataatggccattttaactggtgtaagatggtatctcactgtggttttgatttgcatttttttaataattagtgattttgagcactttttcatacgctttttggccgttaatatgcttttttgaaaagtgtttggtcatatactttgtccactttttaaaatagtttttttttgcttgttaatttgcttaagttagttggaggttttttaaggaaaaaaccagaataagagaaaaagaggaaaatataataccacagaaaacacagactgtggtaagtattgcctcatggatatatatgtgtgtgtgtgtgtgtgtgtgtgtgtgcatatatatatatatatttatgatacatgctgtgtttatgtgtataatgatgatccagaaactaaagggtgactggtttaaggactgcctatgttgcactgaggcttccttcttttcaaattatgaactaaagggtacagcagtacttgcatgactctcaaaaattctagcagcatgagatagaggtagaggagatttactgagatagatgcattggaagctgtagaagctcgtcctgtgctgttgtggatgttgtgattgtagtagttgttgttagtacagtgggagtaaaagcagcttgaagatttacaagctcttctcttcctcatacttacaactccctctagagatgcatcagtgattgtacaggcatctctgacacctctggagaaatcttgttagctcaatccagaatcttacctgataaatgttttgagtctcaaattatgtgaaactagggtgtagaaaaaggactagagcaagggaaaataatgttcatgcctgcacagtggttgtagacaggtaaatggggggctttataagtgtgatgatgtgccaaacctctgtcaccacggggagagaagcatcaaaccaggatcacttctggaagaatcattaggttattttagatggaaggaactgtgaattccttgccaaatagatttttaaaattcaaagctactcattacgtgttaatattatttaacttctttaaatataccatgtggtagagggcacatccactatttcaattcagggtttgtatgcctatgtgaattacaccattaaaaacacagcaaattccatattggttggggaagaatgtttgaacagtaatcaatttcgtgaagaagaggtttatgtcacagcactttccacagtattacatacaaaaacagtgaatgatctcatatccacaagaaccagcatttctcatgtgccacatatgccctcccagaaagaattgaagcctgtgacaagttgatgaaaggggtagaaaaaagaataaaaccccaaaacacagcactataaatggaaaggggaaaatcattgcagagcctatgattataaaaatacaaaaggtggatattctgagtatttttatggcaactagcttgacagaagtaacaataactttgtattataaatttacccagaacgaaatttccaattttatatctgcctgactggtgtcttgataccttatcaaaattacacaaattttcaagagattcaaaaagaataaatactcccaaacttatcatatgagatcaccatatactccagtccaaaaacaaacaaggacgtaacaaacggagaaattaaatgctggtatctcttgtgaacataaacacaaatattctgaaaaatagggaaagaaggaaaatataatcatttttatacctatatgtttgtgaacacacatggttaagtgtattacagtttttatgctaagaacacttgatatgtaattacaagttctaaaaaattgatatgaaacggaagatgtgacagttccattttcctaacttttaaaagaatatttcatcttatttaaatattatttttatttttgtatgactttttgttttgcttagacttttagttgaaatgaataatgaatgtgtattaaaagcctaccattttgatttaatctatgaagggtatttaaattctcattctatagaagaaaaatccaaactccttagaaaagagagatcttgccaagagctacacagttcttgtttcggagctgagattttctctcagatattctggctcatacaattttcagtacactacagatagaagatgcaaagacaacattacccaattggtcttgcacttactttgttcactgttaactaagtttactgaaaaaaaattacaataaaatacactgtcaaagaactgtcacaaataaatacatctgcagaaccacctccaaaatccagacatagaacatttctataactcccaaaagttttgacctactcttttggaatccacttgctttccaccacacagatcagggaattcttgatctgcttattgtcagtgcagattccaatttctttttaagggtttcatataaatgaaatatagcatgtgctcttttgcatctggtgaattttgtgcagcataactgcttctcagattcattgagatgtcatgtgttccagttatgtgctcctttttatttttgagtgttatttaactgtttggtaattttataatggatcctttcacctgttgattgccatgtaagttgtttccactttgggctattacggataaagctgctatgaatgttcttgaacaagactttgtatgaacatatctctttatttcttttgggctaattcctaggcgtgtagttgctgggtcttacagtaagtgtttaatactctgttcaactttttccaaagtggctgaaacattttacatgtccaccaataacttattatagctccacaccctccaactgctgttttgattttttttttaagatttcacctaattgtcactcaacagtaaccagaatagctagtgattattaagctatgtttttctgactattttcttgtcaattttggtggttgatgtgtttcaggatattgagaatagaatcaatgccatccaagctccttttcaaataattttatcaagccataatatttaagatggtaacaaggtatatacaaggtgtgttgggagtagtaataagtgttttcaacatttattattatcgtactccataaggcaatatgtcttcaatgaaatagtgtttaactagacttaggatagaaaggttctcatctcaaccctagtattcaatattaggaaaagtttaaggaaaaaaaaaaacatccaggaaaataagtcagagagtgttttgctagtcaagaaaaactgcaacactgatgctcttttaatgccagaccttcacaataatttccactcagatcatttggtggcctccttgccttgttctccttatgggacttcattctgagggcatgtgacatcacagagggagcagtgcacttgggtacagaaatatggcttaggggattgtctggccttagaggtggctgcaatggaatatacattttcaaggaagttccctgttaaagctgataaattgttagttaaggcaaggtgcaggggcttatgcccgttatcctagatgtttgcaaagtcaaggatggaggacagctgaaagccaggagtccaagaccagcctcgaaaaaataaggagatccccctgtctgtagaaaaaaaagaatgtttggtaagatgtggtgtgaacaatgacatctataagagattatttattaacatttgctcagaaaactagaaaatagaatgatgtcttataatccatcaatatcataataaaaatgctaagtttttcaactatggtaaatatagagaacataacattgcccatcttagccatttttaagtgtacagggcaatggcattaagtaagtcacattgttgtgctatcatcaataatagcaatctccagaactctttccatcttctaaaactgaaactctatttcaattaaatgacaaccctctccccatttcccctgcttcaagttcctggcaacctccattcaagttctgtctctatgacagtgactactctgaagcaggttcactgtgccctggttaccaacttatcagagtccagggagacagaacaatcatacacaacaagttacaagaatctggtgtagtatttataggtggccaacaagggactgcagaagcctaggatgtattgtgggtctgtcccctgaggcacaggcatgtgggtctgatggaatcttgactgtgtgtaccccagttggaccacaactcagcaaccccagaaagaagatgctctgggtttttaatcctggtgtcacaggacacatggagctaaagtactggaggactaaagtactggaggacagtactaggagaagctggaacaggggcaggctcttctgaccagtctctccctatttcagaatgttacatttccagcacattctacagttgttcttgagaagtgtaagaaagagagtggggagaactaactgagtcgagaaccattagaggactgtactggagtcacccccaacccaaacacccccgttagaaagccattccattttatatgcctactaataaccctgaactggtggcagaggtgtgtcttgtttgactgatgaagcccctcgacgaacacaatgtcaaagcaacatcatagagccagagccagaatagatttcactgggccaatgaaaactactaccagaggcaggatgatcaggcccacctgaagcagttatgtagcccaggatccaatgatccacagaagaagttgctaaaggggtgaaagaagaatccttcaggtgggaccattttcttcaattacgagcctgtttccagatctcctctcttgaatttctaggatacctgaggtgtttgtccaggtacaacagaaagtgttggaaattgtatacaatcctcccagttgggattttaaaaaagtctagagcaacactgttatctaaaacatccatcccgatggagttaagggatgtctgctgggctaccaaggcagtggctatggaggaggagccatatctgccatggtcagggacacatttcttatcatttctcttttttacatgagcactgactcctatacatagtaccaaaaatatcacaaaagacataaacccatagtctgttataccttctggcaggtccctagtaagtctgaggtacagctttgggctgcaggctcaatggttcacctaattccaaggagtaatatccagagacaagcccagcatgcccaacatgcagaatctcaccatcccacagttatccagagatggcatcacacatcctgcattttgttcactcccagaccattcacagagaaatatgtagcccttgggtgcatacagccccctttctcccattttattgtttaatcacccagtcatggttatgcaggtattggtgtgttcattagccaagtctcactgatggcagagttgaaggagcaaagttttgctcagacaatattgttcatagacagagggtagcattagtcctctccttgtttttgtctttgccattggggcatttcttatctatgcaatcaaagaaatatggtacatcaaaatatcagtccaccaatgttttttttagttgtggtcatgacatttgccacagagtcaatttagttaaatggggggcctccagttttctcccatgtggtaggtatcacatcctcagttggtaggccagtgcccgggtcctgttgatgtacaccatgatatcagtaatgttggtgtcatttgccttcagtagaatgaaaggaaacctctagttagtgacagaacgaggtcaagaatggcagattcagtattttgaaagattacactcggtgacttgcaagaagctaacaaagatgttatgcttctaggcctttgctgcctcattcttgccaaaatgcagtgtgacaggttagtgcatcatctctcacccatcccagggtctcaggtgtctcctacccatctacaagggttaggctgtgttggtgtaagaatgcggcctggctgtccttgctctgtgaaaaatccattgcctttgtcacttgacccagacatttcagtcctgattgtccactgcaggaagggagattatgccctgtaaaaacttgacatatttcataatatcaccaatactaaaggaaggataagatggccctggcaccagaagagggcccctagctccctgatatttcttagtcttgtcatccatcctgtgggatcttgtagaaaagaggcatttagaggaaacataatccccatattagagttagggggcctgtctggggtaagatgatggcctgaattgaaaatcaccccagggcatgcattctaaaggaaaaaaagaaaaagaatggttaggaacactgaaatagctttcacaggtccagactaataaagggtctgcctggtctaccttcgtttccactcagcattatgttccttaacattcattatttcccttgttctggagtgcgatatttaatgcccatattgctctagtaagatggggtaccaccccattagcagactttctagatgtcctttctagatgttgctgtgtgagtccattgttctagcattcactagattcattggcctgtggatgcagggtgcatggaaagttcatcgtgttccatgagagtgtgcctattgtcatgttgcttgggcagtgaaagatgctccttggtcagtgtgaagtgtcattgggtatccaaaaatatgatgtaagttcctttcaagggtgaccttggtagtcccggcatccaattgagcatcgtatctctttttcctgcaggtggaaagctgtggccatagtcctttcctccacaccagggattctttaaaagtccagtctctcagttgccattttcctgaacagatgttgaggctgttggcaatggcccatgatttagtgggaatgtggcatggtacgatgttggaacagcctgcatggccattaccactgaatgtagtttgacccactgggttgaaatcccatgctaagtttcagttaaaaaagtggccatccattggctgaatggtggccacacctggtggacctgtcagtttgcgttttcctcagccatcagtgactcctgccatatggaaatctctgaatcttgggctcgacatgggtaaatgaaaatccaaattatcacctacaagtcatttggtcccttcaacaacctctccatttgttcatggagccacagatcctgtggggtcctgactaagcctgatcaagaatgtgccatttccatttgataacctgactctgttgagattgttactgccttgaaagccaggcaggcgcttctcaactctgtgattcttcccaggaaatacgtgagaacttccatctgggttcatatctcaaacacaacccaccagtctctcacttgctgccctctgctcaaaatcttcacattgtaatttttcatggggtaaaaagttagcttatatattatcttgtattcattcaaattctgtttaaataacatacatatgttcctttattctttcgaactttgtccttatttttgaaacccagctttggagttcagaaagctacttttgtacttcaatatgctgtgagtgagactgtgcaaacactttagcaactaggtctttatttttgcatacatttgccacaacatatctagtaattaaaaaatctagactgtgaagagttttatttggcttctccctgaaaaaagtaggataaaatacagtgcttgctgctgttctggtcaagggtcggccttacaaaaagtggaggggggaggtggaggaggggagggaaactgatttaatatcaccagatcttatcaatgtacatgtactctggtaactgctaaaccaaatcaaaagaatgtgttagttttgtgttgccagtaatcagtctcaattaggtgcctgttatgcagaatgaatttagttgatgaatgaacatagggaaggaagagaggattagaatgagctctcattgagccttctcttctcttgtgtctcattgctcagagggcacgtggacctcctccatactgcagactctgtcatgcaaaggctgctgcagctgacgggaccttaaaatgtggtgcctgaggtgtagccaagaaatttatggtcatgagccctcagctgcaccaagtcctctgagttctccaacatcttggtctttaggcatctaagagaatccacagtgcctgctctccacagaaacagcacatctgggcagctaggccacagcaagtgggggggtttgtgttcaagactataccattgtgggaggataatgtgtactttgctggcagcaataaaccccaacatcctcagcatccatcctcctgatttcagcatgaaatctgtccccaacccactgccactgaacctgtctgggactccagggtcgtgattggaaaccaaatagattgggagccaaggaggctggcctgtcttctgtaggtaccagttgaaatagatgtatccattactgtgaagggggctgtgactagacctgcaggagatggaggctggctctccaggggtgatgggcagggagagtggaggttgggtcatcacagcatctccattggatcatgaaataatgagagagaagtgcaaggttatgtgcaaacattgtgagtcattttaatcattttctgtctgttatttatgttttgctcaattatttttgtgtgtgtgattttgattaatcctcccaaaacatacagatttaaaaagaaccaatatttacatatccttgctccttctggaatcttcctcactctcacagatctagacatcacatgccccatcctggaggacaagacacatctaacacgaggacaggacacacatgggaggtggcggggtccacagagttcaccctcccaccccatcatcctccctcatttcccttctgcccttaccagggacccagagcattagcagccccaggagctgagcagggagcctcactgtgagaaggtgaactgaggagtcctgatcagtcaaggcaaggttagagtgagctttcgtctcagactcacaaggaaagtcctccctaggggacagtatgcaaatcccctggtgggtgcagtggggtggaaagagccaaggagaaggtgggggcgtctcttgtgagcaaaatgacataaatatattttatgtttttaaggaaatcaatagaggtaaaatctgtgttgcctgagtggcagaagggacgtatttagattttcctgctgtttcctctactagacttctagttctttaggactttctcgggcatgttttatgtttctttttaataagcttgatctttcataaatatttgatgattcttatttctttgtttaggtttatttaaaagagtctaggtttgtttattttattttattttattttattttattttattttattttattttatctaaggtaaaacacacagtgcaaagggtgcaactcttaagggtgcaaatgaatgtcaagatccagatcatttcatatcatgatccacatagaaacgcagaaggtttccaattctctcgctgctttcattatgcaccttcccagtcaaaaactgctgctcaaaacacaatcaatgtaaatgatattctgacatataattgttttagtcctggacttaatctttatatcaggtaaagtaaacattttttgtagcttctttctaacttttttcattttttgaggccttggttccttcttgtcaatttgagttgctgtctgctgtcattctctgttattctgaagaattttctcttgaatctcttacaaggcatatatgctattaatgaattaatctttgtgtatgaaggaatatttctaccttgcttttatatttaaacgattgtttttctggatatagaatttgtggctgagaatttgtggctcagtatttaaaaatatcattccactgtcttctcacctccatttgtaatggtgaaaatttagccaatgattttaatattgcttcttagtataaagtaagtcggtattttagtgatgcatttcaaattctctgggtctttgtctttcaacactggtactataatgtgtatagttatgaattgtactgtgcttatcctaaaagggtttcactgagtttctttcatgtatagattaaggtgtctcatcactgtaaaaaatgtttttcattatttctccatttttttctttttcaatttttattttaaaatcagagcatacatgtacagatatgttacaaagttattttgcatgatgctgggatttggggtatgactgaacttattaaacaggtagtgagcactgtaccccataggtattttttcagcctctgcccttcctccctttgtctcccctctagtagttcccagtgtctattgtgcccatcaaccgtggattggataaaaaaaaaaactgtgtatagatacaccatggaatcctatgcagccataaataagaagaaaatcatggtcctgcagaaacttggatgcagctggaggtcatttacctaagtgaactaatgcagaaacaaaaaaccaaataccatgtgttctcacttataagcgggagctaaacatggggtacacatgggcgtaaagatgagaacacagtttttagcctcttcctgtcttctcctttgtgattcctaatacaaatttgttggtattgttcacagggacctataatgtctgaggttttattcattcttctttataatttttcccttctttatatgaggtcatttctattgacttctttttcagatcactgactctcgcgtcatgttaaattgctgttgagtctatctaatacatttttcaattgagttgtacctttcatttttcggattcccagtaggtctgttttcatagttttgtgtctgtttgagagcctctatttgttgaatcattgtctttacaaattcctttttaagtcttttattataggttaaaataattatttgaacatatatttgataagggtggagcacacagacaccatggagatggaccataaggcagggagctcagaattggattagttgaatttggagtctctgactagatggtgctcttgtgagatttaattattttccatgtttcatgtttctcacaatacaaatagcttttattttttaagatggtaactatgaacagaaattcagcttataaattcctgggaattcctaataggaaaattgatgaaaaaatggtttttcttaggcccccacacctgcctctgcctgggacctgactttgtctctgagccggcggaatctatgatgaggttttgagttgggcagtgaaatcatggcagggcaggctgtgctctgggtgctgtggagaacaaggggacactcctgcagggttagtgatgctgggagttcaaggggagactcagcatggagctgcctgttgagtcaccccagcaatcctgtctggacagtgatcatctcacaagtgtacttggatgccagtggatggcccaaatgtgggttcaggttggacaaggacaaagctttagggatgaacatatggggctcatttgatagtctgaagtttcagcacaagcgtaatgaatcatatgggaaaagaaaggagtcacaaggttgtgacttttcatttgatattaaaatatattccctctgctcatttttccctacagaatgtaactactgttacatatttaaccaaagtcattgtttttaattttcattttagtaactgacagcctgtgtgcagagttcctaaataactggaaagccaggccgtcattcctatggctgaagccaggaagtgactgtggatatgaagaaatgtgagtttcatgtacatgtctctaaagccacgggccactgatctggtgggaacctgcagtcatttcactttctcatacccagatgagaggacaccttgatctgtgttcatctgatgatctgatgaactctaaaaactggaccatattctgaaggtctagttcacacttcttttctgtgctagagggactctactcacatgtattgtacactctgcataggacagtctgtgatacatacaagtttttttctgctaaatactcatcaatcttgtcatttatgcatcttctatagttgttacctgacctatggctatggggtcttccaaaagaatgggccagaggtggagctgtgaaactgtagctgaataagaagtgtaagtgtcaagatagggtaaagaagtgttgataataataatatttcaaattagtctgggctcttggctgtgattactggtaagtgggaaagagtctaggtttgttttttttaagttttattttaattgataaagtagccagggtaaagtgcacaaatcttcaatgtgcaactgaataaagtttatgtgtaattcattgtccaggtggaatgatagaatatttcacatactcttgtgcttccctcatggacaatctttgtcagttttcgcccctcccacccagccatagtaactgttattctgacatctaacacaatcacttaggttttcctgtcttgaacttcacataaatagcattaagtgtatttttctctttttagccttggtattgctccttacaatgtttgaggccttcatttcttccagtggactcaaggtcctgtctgatgtcatttcctgggattctgaaggattttctctcaaatgtcttataagacatagctgctatgaatgaatgtacttttttatcaaagaaaatttttttttgctttttctttagatgtgaaggtattttcactggatatagaattcctagtgacttttttctcctttcagcatctaagtatgtcatttcactgcttctaatctctattggtcctaatgaaaacttagccaataacaatatgttgtttctgtgtattggttgggagatgatgtttgacagtgatcagtttgtgaagcagaggcttgtgtcacaatactttccacagtactacatttaaaaatggcgaatggcctttcattcttgatgcagtgaagattttctgtctttcaacattttaatataatgtgttcagttattaatttctattatctaaaagggttttattgaattttttcatctaagaatattttttattacttttgaaaagtttttgtcattatttctccaaggatttttttttcagccactttctctgtctctcctcctttgtgactctcattatacttttgttggtatccttcactctgagctataaatctctgacgtcttcctccttttttttaaacattttatttagactcaataagttctattcctttattttcaagttaactgattattctgccatctcaaattgctattagacctagctaatacgtatttaaattggattattttacttttcatttctagagttccaatttggtcattttttatattttccatatcttttcttgaggccctacttgccaaatcttcttaatattttcttttttatgtcaatgatcatagttttaaaaataattatttgaaaatctttgtagtctttactaaatccgataattacggcaagttagaatcagctttcgttgactattttctgttgtcattattgtagttgctttatttttgttcctttaatattggtcattcttctagtttttttcccaggagctgttaaactgacaattttacatttttgataatacagtacctctctttagattatgggttttttaattttaattttaattttttagaaatagggtcttactctttcacccaggctggagtatggtggtgtgatcatagcttgctgcagcctcaacctcttggggtccagtggttctccagcttcatccacctgagtagctgggactataggggcatgccattactctctgctatttttttttttttaaatagtaagatattttgcccacccagcctggtctcgaactcctggcatccagtgatccttctgcctcagcctcccaaagtactgggattacaggcttgagccaccacgtcaggcctggaatttgttttgtttttctgatcattttttaattttcttcttagttacttgggtgaacttactgatagtacctgacttatgatgcttggagttataactttttgactttcagatggtatgaatgtgatatgcattcaagtagaaatagaaattctagtatttatacaactattctattttctctttcaatatagtattcaataaatgacatgaggcattcaacactttattggaagataagctttgtgtaagataatgtcgcccaagtgtaagctaatgtaagtgttttcagcacatttaggataggataggctgagctataatgttaagtggattagatgtattaaatgcatgttcattgcatgatattgaaaaatctatctcacgtggtgtttgaccactgatatcactgcttccttttattcttaatattaatatttagtttgaatttataggaactgcacatgtatctgcatagtgaagtggtcaccaatgatttgagacgttttgcttaaatatctagaggttataaatctatcttctgtcaacccatctgtgtgtagtttaaaaagcaaactgcatgcaaaatgcagctagttcttgaatccttctggttttactttgcaccggaaactccttgttctcatcactcatatctatatcttctaggtcactaggaatgtgtgcagagattatttcagcaatatgggtctatctcatccaggaatctgctatttactatcagcagatgtactacttgcctcaaacaggtcatcatcttggacttgtaaagctgtgagatttttctgttcatttcctatggagttctgcatgtttagctggaaacactgaataattttttttccactccttggctttactcaagtccacccactttggcagcaagctgctagttttttttgctacgctcatattggtaaaacttcagttctgtaattcatgctgattgagctgggggtagaaggctgctgtcacaggcaaaaggctacagacattttctgtccttactcaaagcactggtactttttttttctataaagaatatgcatccttaattattttatacttcaccaattttcagagtgctgaaatagttttgatacttcagctttatatttaaatgtgtgtttgttgtttatttttgcaccgaagatttattaaactctttgtgatgccataaacagagatgccttctaaaatgcatttagttgaacataatagccacggtgaaatggtacgatgcaatggactaacataagtaattttggacttgacaacttgaactccaaaatggccaaatagagctgagatgctaacactgagtggccaccccactagctgtctgtaaaggaagcagctggtataataatctagtaaacactgatggtcttgttggggtttttgtttcatgtggaatcactgtgggaggccagttgctacgctgctgacagtaataaactgcaaaatcttcaggctctaggctgctgatggtgagagtgaagtctgtcccagacccactgccactgaacctggctgggatgccagtggccctgttggatgcatcatagatgaggagcctgggagcctggccaggtttctgttggtaccaggctaagtagctgctaacactctgactggccctgcaggagagggtggctctttcccctggagacaaagacagggtggctggagactgtgtcaacacaatttctccggtggtatctgaaattggaaataaaacagaaatgcactcatgtaatcaagatcaaaccaactgtctttgagtagagccaaaattgttgatatactttgaattttaattatatttcttgctgagcagaggtggcaagagttttcactaatgtgcaaaaccacctcatgttcccctcacctgggagccagagtagcaggaggaagagaagctgagctggggcttccatggttccctctgggtcctaactgagcagttcctccccagggctctgacacaggcattgatatgggctctggaaggtagggcagctgggagggacatgcaaagcagctgggtgggagctgagcttccagctgcagagaccacctgcttcttcctctctgcactgagcatcctgcgccaccctggttgtcaggccagaaaagtctgttggctcagtctgagtgtagaacttctcccttgtgctcagagaatttcattcctatgtctttcttctcctcaatcacctaaattcacccagatgatgtttggcacaagcctgttaagaacaatataaaaggctgtgttttcatttctctcttcctatcctcaatatgcccagtcatctccctaagtgcattattggatcgatggaaatgaggagtctgttagaacttaatcttccagatacacctttcatttgcttgttagtaatgttttctgagggtcctgaaactttccattaacccagacacataccctctttgagttaaaaagttaaaacttctgtttacagtcacatgtcctggcagccctgacatagatgctccatggcttgccgattgcttgaaattgaccaactaacttaacttccctgtgtctcagtttccatatctgtgtaactgtgacaatactggtgcctaccttacagtgctgtagacagtttaaagaaaataagataaaacatttacagtagtactcaggacattatgtatgcggcaattatttttgtttttattgattaaatatttagcactacagtcatcatcattatcataaatatacttacttggcacagaaaagagtcttcaatctaatccaagaatgttttatcaacagtcaaattaaattctagggctttttcttcactaactgtacacaactcttaaaatcctaatgatttggtcttaatctgtgctaaaatgctcagaccttcaatcattcccgcccatctctgtctaacgcattaattctcatcatccattatcaaaatgttatcctatgaaagtttcccatgtcctgctgctttccttctttcttacataatctttagtctaccttgttatcttttgtcttatttttgccccaggactgacaataaggaaaagctaccatcattacttgtggacttgctccagtataattttgtcaggcttgttatcttggaagtgaggactatgtcttgcaaagaaacatattcattgggtcaatgtgttatcaaataaaagattttatctacttatcatccaataattaatttagactgacttgaacagattttttttaaggacgaaaaggagaagatgatataagaggaaaatacaatacaatatcaaatgctagctattatgactcttgcttcatggatttttacatatatattagacacatggtgggtatatgtgtgcaatgatgatccaaaaactgaatgctgactggcataaggaatgcctgcattacactgagtcttgtctacttttccaattatgaacagaaagctgcagtagtatttgtatgagtatcaaaacttctagctgcctgagatagaggtagagcagatttactgaaataaaagccttggaagtaggagaggttcgtcctgtgatgatatggctgttgctctggttgctgttgttaggaaatacagtgggagtgaaagcaagtagaagattgacaagctctgctcttcctcatactcacaaccccctctagagatggacagatgctggtacaggaatctctgacacctctaaggaagtctctttgctttttccagaatctttcctgacaagtattgtatgagtcacagatgaggtggaagtgggtgtagaagaaaggactagagcgagggaagaagttttcagtcccaggtagttgttgttgccacggggaaactgaatttttcaaagatttgtgccacacttctatcgtgttggggagagaggcatcaaaccaggctcactcctgagagaatcattacattattttagagagaaggaactgtaaatttcttgtcaaatagatgtttaaaattcaaagctatcgagaccatcccggctaacaaggtgaaacaccgtctctactaaaaatacaaaaaattagctgggcgtgctggcgggcacctgtagtcccagctacttgggaggctgaggcaggagaatggcatgaacccgggaggcagagcttgcagtgagcgagatcgcgccactgcactccagcctgggcgacagagcgagactctgtctcaaaaataaataaataaataaataaataaataaataaatataaaaacattcaaagctactgattttgttgttgttgttgttgagatggagtcttgctctgtcacccaggctggagtgcagttgcatgatcttggctcactccgtttcccaggttcaagcgattctcctccctcagcctcccaagcagctgggattacaggtgtgtgccatcacacctggctaaattttgtatttttagtagggacggagttttgccgtgttggtcaggctggtctcgaattcctgacctctggtgatctgcgcgcctcggtctcccaaagttctgggattgcaaacatgagccactgccccggccctactgatgtattactattattcatcttcttgaatacagcaagtggtaaggtgcaaatccacaatttaaacttgagatttctactcctatgtgaattataccagtgaggaacagaaaaattctgtattgtttgggagatgatgtttgacagtgatcagtttgtgaagcagaggattatgtcacaatacgttccacggtattacatataaaaataacgaatggccttaaacccagaagagtctgcatttctcatgagccatactaccaccaagaaagaattgaattgaaactcgtgactacttgatgaagggtgtataggaagagggaaagaaaaaggacacaaaacataatattgtaaatggaaatgagaaagtcattacacagcctattagagtaaaaaaaataaagagaggctaaatgagtaactttttggcaactaacttgacaaaagtggtgcaatcttcacctcctgggttcaagcaattcttgtgactcagcctcccaagtagctgggattagaggcgtgtaccaccacttatggcccttttttttttgcatttttagtagagacatggtttcaccatgttggccaggctggtcttgaactcctgacctcaaacgatctgcccacctcagcctccgaaagtgctgggattacaggtgtgagccactgtgcccggccttaaagcagtattttcatttagtaaagtgtagaagaaaaaacataaataaagtgacaacaagaaaacaaaatgccattatgaaaaatggtaactttagggcagaaaacaagaaaaggcaaaccaagattctcataaggtaagcctccaatccacaatcctaggaggaatgtcaatgctgaaaaccctggagcatccagggagtggccaaaaatactaaatgctgaaaacccagagtacccgagtatcagcctatgagtgtccccacaccaaatgccaggaaaccctggaatatccaggggctgaccagtgcagaaaatcctggagcctcagttgggtggccaacagtgagccccaaaggcctgattgggaccacagaacaatgtgactctggcttcttacggccaacagaacaggagaattcttacatccaagtgtcctgccttaaacaattgcacaaacacaattagcagggagccaaagccaaaactgcaaagcaaacacatatatcagggcagaaaataagataaaatggctgatggataaataaaatggcattagaggagaaatgactaagagaaggaccaaggaggatgtagtcaggtgtgctatggaggacttcaaatggactatcgagtcaaaggccttattccctggatcatccaatataggtcaggtgggcagaggggacacttacaggtgtgcaggagccaaaatggtgccaagcagtctctaacgtggggcctgcgtgaaaatctctccaggctccccagcttgggtgggttgggctcctacggggaactggagcacggagcggctggcctgcatgaagcagtggctctgtggccacttgcccatccccagggctccaccgcctgtcaggaaagatgatggctcttaaaacagcctttggctagtgttaacagctctgcaatgttagcaactctgtagctttgatcgctgtagcactgatcaccgtctcaccctctctcactgatctctgtcttcccaattctccaatagctgtcctgctcattgctgaccgctatgtccatcttctcacaaaatcccatctcttgctgtctcttgttgtcttgctttctctgctgtttctgctgtctcactgccacatcagacgctgcctctcaccatctctagagttgagtggctggcttaatcctgatgcaaggcaagttcttggatttgctcgggaaagaacgttagagtaagccggtgattgaataaaacagctttattgatggggcagcagtgttacagctctgtgactaagcctgtggagcaggcataattcataggcagagggccaagagtagcagccaggtgcagttttacagtcacatttatacccacttttaatcatgtgataattaaggggtgggttatcgagaaatagctcgaaaatgggtcgtgttgccccaacttcccggtgttgccatggcagggcagcaatttccaggtgttgccatggcaaggcgctgcgacttctggatgttgctatggcaatggtaaactgtcatggtactggtgggtatgtcttacggagaggtgttttcagaatcctattcctgttttggccagcctcacatctggtccagagtgaagtgctgcctacctcttacctcaaaagtaacaagaaatctgtaataacaagttacccagaaaaaactccaaattttatttggtggttagtgacatggtacttatcaaaattacacaaactttcaagggaataaaaaaaatactcagaattattataggaggtcataatgtcctccagtccaaaaattaatgaggacataacaaaaaaaggatattaaaggctggtatctcttatgaacatagacacaaaaatcataagaaaaaataaaaatggaatccatctgtgtatctacacatttagtgaacacacgttgtaaaaagtgttacagtttttacgataagaactcttgataggtaattttaatttctgaaaaatttatatgaactataaggtatgttggatctctttccctaacttaaaaaatatttcctcgcatttaaatattttccaatttttaataactttttattacttagacttttagttgatataaataagaaatgtgtattaaaagcctaccattttgatttaacctatgaaacacatttaaattcttggaaaaatccaaaaatacctagaaaagtgagctcttgctagaagatacacagttctttagtgtcaggctgagattatctaccagaaataacttttggctcatgtagctttcagtacactgcaagaataaaagatgtgaagacaacattacttaattggatttgcaattactcactattcactattaaccaattttattgaaaaaaaatgattccaatcaaatactctgattttaaatgtactgttgaacaagtacactcgtgtaaatgcctccaaaatcaatacacacaacatttctataactccaaaaagttttgtcctgctcttcaggaatcaacttgctttccacctcacagaacagaccatccttggtcagcttattgttagtatagatttcactttctttttaagaattttacataaatggaatatagcacgtgttcttttgtggctggtgactttcatgcagcataattgtttcctaggctcattcatgtcgccctgtgtcctcatgatgtgttactcttcacttttgggtactatttaactgtgtagtaatttcacaatgtatcccaccacctgctgatagatatgtgggttgtttccactttgggctattatggataaagctaccaagaatggtattatacatggctttgcatgaatatttctttatttcttttaggcaaatacccaggagtgcagttactgggtcttacagcaagtgtttaatactccaccaaactgttttccaaagtagttgtaccattttacatctcagcccagaattgatgagtgttctcaatgtttcagctacttgtttttaagaatttttcttaatcttcactcaacagtgaccagaatggctaatcatcattaagtcatgttttccttacaattctcttgacttttatgggtgcttgacttgtattaggatattgaaaacaggatcaatattgtctaaaccccctttcaaacacttttcctaagtcatgatatttaggatgataagaggagatctaaagggactgctggtagtagtaacaggcattattcaatatttattatcatactccataaggcaatacattttgagtgaaatagcattcaattagactcaggataaaaagcttctaatctcagctttagcattaaatattaggaaacctttgagaaaacaatccaggaagacaaatcagagtgttttgctagtggagaagtgctgcaacacctaaaccctattaatgccagatctttgcagtgatttccactcataaagttgggttgactccttgccttgttctcctatgtgtctgtgtgacttcatgctgaggggatgtgacatcacagagggagaagtgcacttgtgtacagaaacatggcttaggagattggctttggaggtggctgcaatgaaatatacgttttgaagaagttccctatgaaatgtcttataaactgtttcttctggccaggtgctcgggctcacacctgtaatctcagcactttcagtgaccaaggagaaaggatcaggatcatgtaaggccaagaatttgatgcaagcctgggcaacatagggagaccccatgtctacaacacacacacacacacacacacacacacaatttgtgaacaatgtcatcacaaagtgattatttatgaacatttgctcagaaaagtagaaaataaaacaatgtcttctgagctaacaatactataataaagacgttagttatttaactatagtaaatacagagaatataagattgtctatcttaaccatacttgagagtgcagagaagtggcattaagtatattcacatgttctgccattattactgacataatcagtaaaaatcttttcatcttataaaaattaatatgtataccccttaaacaatactccacccattttctctatccctacctccagcaacctccattgcagttctgtctttatgtcaatgacatgtttgaagcaacttcgctgtgcactggttaccaacgtacttgagcgtgggggaagagaacaccccccacagcaagttacatgaagtgggtttattattacagataagcagcaagggaacacaaaattcttggactcattatgggtcagtcccccaaggcacaggaaagctatgtggagctgatggagttgactatgtgtaccccacatacaccacagtgcaggaactcaggaaagcagccactctgggttttgtatcctggggtaaaaagacacacagggctgaagtgctaatggacattctattctatgggaaactggtatagaggacaggtaggttgttctgctcagttcctgtctatctcaggatgttacaattccagcacgttctgcaattgtacttgagaactcttaaaataagcaagaaagtggagagaactaagtcagtccagggtcattgcagaacggtcttgcagttatctcatcccccttagcaaagctagcatacttcatatgcccaccaacttcccctgaactggaggcagaggtttatcttttcagattgatgaagcaccttgacttacacaatctcaatgcagattatgaagccatagtgagagtacatttcactgggccatgaaaagctagtaccactggtaggaggataaaactccccaagcagtgactaagatgttaagaggtgaaagggggatcttttgatgtcctattgtctgcagccagtgagcctgctttatgatcacccctacttgtatttctaggatatctgaggtgtttatccaggtacagcagccagtgttgggtgttggtaattgcatggaaagtccatttgtttccatgagagtgtgcccattgttatgttgattgggcagtgaggctgtttcttggtcagagtgaagtctcatggaatatccaaaaacatgacataaattcctctcaagggtggccatggtagccccagcatctaatagagtgacatatatttagctgtccaggaagcaagctattgccatagtccttttctccactcatgagatcctttaatagttcagtcactcagttgctattttcctgaccagacagctgggctgttggcaatggcccatgatttagtggaaatggagcaaaatatagtgttgggggcagcctgcatggctactatcatttcatgtagtttgtcccattgggcagaatgaccatgttcagtgtcagtcaaaagatgccatcccctggctggatggtggctgcacccagtggatccactggcatgtgttttgtacaatcatcagggccccatgccatactgacacaggcatgtctctgaatctttggctctatgtggccaaaggagaagctaaattgtcccctatgggccatttgttcccttctagcaagcttgccatttattcatggggcacatgggtcctgtgggatcctggttagggctgattctgactgtatcatttccacttaatgatttggatctgttgggcctgtccagttttattgattgtgtttgtaggtaccaaagtgagaatggttagttaaggtcgcagcgtcctgcctggtgctctagctctgagatactcagcccctatcagtttcctacagcaagcaaggagctgccattcaaaagaggcacaactgttggctgcttcaggaaattttgtgtccaaaatctgagtctggtgcacccagtgacagtagaatcacctgacatcagatgttagtctgagccctgatgtgtgatacaatgtgaagggttcaggaggggtcattcttcttggcaaattaggtgttcagaagagccagtagcactctaaatctcggttgggggaaactcaaattattgagtccccacagagacctccataacattggttcatgagactcccagggaaagctgggaaagatgactgactgaagtccatgtgttgaatcattctcattattaaaagcccctgctcattaatggcatttcgattagcatccacttggaaagcatttttttttttggattatggctcattttaaaaacatctagtcatagctcttccacaatgactttgtctgtaatcatcctgttgcatttcttttaaggcctgatgatctgtcaaaaccaacagccaatattattaaaatgttattctctttgcaatgtgatcatcagacataggccttgcagtttacccactgttttgatttttacatttccagggcttccttgacaatggcactgatgtgactccatccagcatccattgttgtgagaactctatttggcatatcatcattgtgggcatgaacataatggagactttcataggatgcaatgattaatattcaacattagtcaaaatttcttctagtcctacccttggagctctactgggttggaaaatattttcggacaaggacaatcatttggtagagttttaaaaataaaggctacaaataaattttccatagcaagagtatgaactatgtgtggtccagaatacaattttttatggaatgtaacaaaaattatttaaatgtattcaatttagataataattttacaaataggcatatattgcatatataatagaattaacacacttaagtatgagtactatatatatagccaacattttatcaaataatatattgacttgtatgtatcttacatacatgtatgcacattttcccataaatatggtaaattttaattttttattgaaatattagttttaattttgtcattaattttctaagtttataatttgattactaaatatttacatttatgccactaatttaagaaaaaatacatgtgtgtatatataggtagaggtgtaaatactgtatcaggaagcttttatgcattaatgattggtaactggctaaatacacaactcagtgacagaaaatagtaaacatttgttttcatgttcatagatgctcacgttcacagtaatctggctgatcaaggaagggttcaggtgagtggtttctctgcatggcactgagctcgtcttcagcctacacatatcaactgtctgaggacaaggctgaacagcagtgactacccatgactcaagattcttctggcaggtcacaagagtgaacagcatcccaaaccaaactgcacagttgagtttaagtccaataatttctaacatagcttcacacatttcaaatatattgctttatttcagtgagtacaaatttttaagaaaatgtttactccatttaattatagaggtgtttgatcattccatggacaaataattatgttttcaacctttacaatattgaaaatatttgcaaatgtaaatttgcattaataagaaaataaagctggatgcgttttcaacatgtggctttaaatataatttatttaaatggcctcatgggggaaaatcattttaacttacataaattctcattttgtctctcttgtttcttatagagttgcccaataagaagtcctcccatgagatttggaagtccgaaaaggatgactcaatattctccattggtacctaagacagacacagggacagacatgaggactagagaaacacctgaaaagatgctgtaggaagctgagagcatcagcacccccacccctaagcttccagacaggactgaggaccatatggttagaaagcccatacttcagaggaagatgcattctgttgcctgagggaggatcagagattcctgcttctaatatcagctttcatgactactatatccttggctttgaaaggttgtagtgggaaacttaatcttaggaatttggtcattcttgtcatacccaacagagcaaagaaaccagtggggaaaggcactcagggtgcaaaatattgtttctagaatgcaattgaaataggccctattatcccatggaactaatgtttatgtttttttgtataaacatagaaattgactcccccagtcttaaaactcaagatagttacatctgtcttatctgagtttttttttgtttgtttgttttttcagtaaaccaatgaacaggcctcccagatactatcaaggagctgaaacttacatatcactgaatcgggacagtgagacatcagaaccttcacccattatgattgcctcactgacctcctgcttcctgttgaccaaattatcttccttacccctccctaattcctgttttcccacatttcttccctgctatataaactcctaatttcagttggtcagggagatacatttgagaatggtatcacatctcctaggctgcagcacctgattaaagcctgttccttggcaatgcttgttgtcttagtgattggctttctgtggggtaagctgcagagtcttcactgaatccctggcatttcagtaacaaaattctctgcaaccttcactgctttggcttattgtaacctgaaatcaaatttgtccacaacttctgagataacttgatataattctaggattcattttgtccaccactgcttaccagtctgagcttgccagctcccaacccttcctagtgccaatgaactttctcaaagagccacaggtaacattttccctttttcataaaatgctaattttctcttcgttcttccaatatcttgaagaccactgagttttcctgtatgccccacctggcaaatatttctttgcaaataaaacttaaatttagagattcatctctacattttattttgactttagtagtttactttaattctctgtattaagacaattcctgcttagaatatctatagtggcttcttctgtgttatatgaattcaagctgaagccataaactagactcctcaagtgtcatgatctctgtatttatcaaatcaggagatgcattgctatgtctgtgcagttggggctgagaaagagaaaagaattagggtgcagaggcgatttcacgtacccctctaccaacaccatcagagtgtggctgcatctgagcaacactctcagccaatggaggcatcaggaggagcagctggggcagcccagcttcacacatctgcttccctgggggtttatgttcgggttggtaacactgtgggagggaaactgttagcctgttgacaatagtaagttgcaaaatcttcaggctgcaggctgctgatggtgagagtgaaatctgtcccagatccactgccgctgaaccttgatgggaccccactttgcaaactggatgcagcatagatcaggagcttaggggctttccctggtttctgctgataccaggctaaccagctgctaataccctgactcgcccgacaagtgatggtgactctgtctcctacagatgcagacacggaagatggagactgggtcatctggatgtcgcatctggaacctgagattggaaacataaaaacaaatgtccacacaattaatcatgctgtaagagaagttccctgaatagtaaagcagtactcagcacactgaccgagtataatcctagtgttctcctttcttacctgggaaccagagcagcaggagccccaggagctgagcggggaccctcatgtccatgctgtgtcctgactgggtctgactcctgcacagggtgtgatcagcctgttaataagtcttcaggtcaggagactgtgctctgggaacatgcaaatgagcaggggatggggcaggctgggcgcagctgcagggctggctcatctcagtaactcagcaccagctcagtgtccccaggtgtcccaggtaagaccagggtagcacaaatttgtctgcagagaatgtgtttctactgggaactattttgttgtgagtaacattttttggtttctttttgacgatttgaaatattcctcaggagttgatggactaatgtatttcattggtgtatggggattatttaggagaatattgttgtttgtaggaaacacatagtaaaatgttagacggtacaattctcaagtcttcaaaagactcttatatgattccggctagggaagggggtatttgtcgtatacatgcaacatttctgtgagtttaacattgttcctatgtaaaaaaattaaaaataaaatttattgacatgatggtacatacatttgtaagtatcaggtaatggtgttatgccattgttcttaccagtatgagatcaaactatgtactatagatacacaaagatgataccgtgttttctcgatgcatgcagcagtcacagatccacaattatcaagagcgacaggtctctatagtactcagacactaaatgggttgcaccttattcttgttttgggcaccttcatagtctaccttcttttctgccattcagtattatttcccaaagttcatctctcttactgagggtgaccactgcatggagcatgtccctgccatgcaccatcaatgacactttcctcttttactttttatcagtgattggggaaatcatcctgacccaggcaacagcctccctgttaactgctttaggaaagagacactgaatctcttatcaagcagttgcctatgtacatggagaaatcacttggatccagatgaaactggacagggatttgcactcgttatatctcatatctctaatgtgcccaaaaatgtcccagcctgactcagtagcagggaaagtggatccaactacatcagcatcagtgggctgccacctaggactccacaaaattttactgatgcctgactaggggagccaaatcacagtgctgcaggctgtgcacaaaccttcctgctgttttttaagctgcctgaattttaagggaacttgcttatattgggagaaaggaagaaagctccatttgtcctctaaatatttgctgaaaatgaatggacaaaagaaagattaataagagaaaagacaaacaaaattcatttgaagtgcagcagaatatcatagcagggtgattacccagataactcaatgggatacagttgtttatatttcttttctaaggaagagggaattgagaagtgtaggcaacctggaaagaatagatgagaacagaagtgcatcctcaaaagaacaggtcatagcctgtctggataaagcatcaacttcagtctcttgtattttagattcctcttttgtgttaatattccctgatgtaaaaattctcaggaagaatttttttgacaattggtttccttctggagaatctgctattatgcagataagggacatttaggaaaagtctttttgtgcatttggtgctttctaaatgtctttggttttacataatcatcataccagtgcagcgtagtttgagatgttattttctggattcctttacttgcaacccacctgccaagatcctgttccagagagatgcagctacagattgaatgagcagttgacccttgaacaacatggaggtttgggcactgaccatgggtgcagatgaaaacctgtgtagaacttttgcatttctaactccaggcatcatcttgaaagtggagaaagcagaccttaacctgcccatgtcttgatctttaatttcccattctccagaactgtaagaaaataaatttctgttccttatgaattacatagtgacaatgaatctgttatagcagcttgaaatagaacaagagagacagcgcacaatcagtgaggacacgatgaggtgtatacataccccagcttcctcatctctcaggtggaatagcccagaggaacttagtccatgtttccacatgtggttgatctttggttatcctgagtcaggtaggttgttgatgtgtctttttccattcatcttctgttctcttcctcactttcctcctttcctcccagtgtaaatttgctgcctaaacagggatcctcattgagggtggacccaaactaagatagttaaaaaaaaaaattgttaatcttttgtaagaggggtatttctcatctgaattctgataatttctttttctttgacatgtaggaatattcaggaggcacttaatttttttttttttttttaccaatctgttttacattcaatttgtgaactgattttgtttttctgtgtgttaaaaccaaaaattaagttgtaagccaccaacctgctgaatggactcctcttttgtaaagagcacttcaaagaaatttgaaaaactaggttaggccatgactggcaggtgggtttagatgtgcctcattatactttggagttcagacacaactgaccaacattgtcattacaacagagatctttgggctgacaaaacagacgctttgtagcattaagataccatattccaacatgacagataataggccctgaagaaaatctaaatattttaccttaaaaatatttcttcatcatattctgaagtggttctgcaaagctgccagttgtgggggaaatttgcattctatagagaatctcctccccttactaagtcttttttaaagtctgacattttttaaagctctgataagcaacattcaccttgtactttatctgctactgataggattcatctacatgacaagaaccttggcttccacatccccttttctacactcaagcatttctttatgatgaattcaactctttagacagaccttaactctttcaaccagtagccagtaaggaaagctttgaattcacctatgacctggaagcccctgcttcaagctatcccacctttccaggacaaactaatgtatatcttatatgtattgatttatgtctttccctgtatttctgtgtttccctaaagtgcttaaaaccaatgtgtaatccaaccgccttgggcacatgtttacaggaccttctaaggctgtgtcacaggccataagccttatctttggcagaataaccctgtaaattgattgagacctgtctcagatactgttttgtttatactgggtcacaaaatttaaaaatcctctaaaactatctacacatcaataaatctacattagagacagtggagtgagcataccccaacagataaaactcacaagttagaggaacctgagtctaagattttgtccacctcccttgattcataaaaatacttcgtgattttttaaattttactttagagaaggacaattttggggaatatgtttatggtcggtggaatgaataatgtcccaccccaaaggatgtccatgtcctcatctctggaacccaagtgttataggagtttttaagaaattattttaggcagataggaaaaggggtccttgggaaggttttgtttcctttaaagcagctctagaaacacttcttgtctagccagaaagccctggctcttagagccaggctgggaagctttcctatgcaaatcatagccattagaaactggattcacccaaacatggtgattcccaccgttttcttccttgtcaacacatgtgcctgggaaaaacctgaaagatgctataggaagctgagagcagctgcaaccccacccttaagctttcagacaggactgaggaccacatggttagatagcccatacttcagtggcagatgcattctattttctgagggagtaccagagaatcctgcttctactgtcaacctgcctgactactatatccttggctttgaaaggttgtagtgtaaaagttaatcataggaattcggtcattcttgacatacccaacagagccaagaaaccaggagggaaaaccactcagggtgcaaaatattgtctgaagaatgcaattgaaatagaccctattatcccatggaactaatgtttatgattttttgaataaacatagaaactgactcccccagtcttaaaactcaaggtagttacatttgttaatctgagttcttttttcaggaaaccaaccatcaggcctctagatactatcaaggagctgaaagttatatatcactgaatggggacagtgagacatcagacccttcacccattatgattgcctaactgacctccagcttcctgttgactaaattatcttccttacccctctctaattcctgttttccacatttcttccctgctatataaacgcctaatttattttgtcagggagatacatttgagaatggtgtcccgtctcctcggctgcagcacctgattaaagcctgttctttgacaacacttgttgtcttagtgattggctttctgtgtggtgagccgcaggatctatactgaatccctggcatttcagtaacaaaattctctgcaagcttcactgctttggcttattgtaacctgaaagcaaatttacccacaacttctgagataacttaatataattctaggattcagtttgaccaccactgcttaccagtctgagcttgccagctcccaacccttactacagccaacaaaatttctcaaagaacaataggtaataatttcccttttaataaaactctttgctcttccaacatattgaagaccattgagttttcctgtatgccccatttggcaaaaatttcttagcaaataaaacattaaatttatctgtacattttatttagacttcaatactttagactctaattctatctattaagactattcctgcttagaatatctataatggcttcttctctgttatatgaattctaaccaaagccataaactagactcttcaggtgtcatgatctctatctttattaaatcagcagaggcattgtaatgtctgtgcagctggggctgagaaaagaaaaagaaattgggatgcagaggtgatctcatatcctcctctaccaacaccatcagagtgtggctgcatctgaggaacactctcagccaatggaggcatcaggagaagcagctggggcggcccagtctcacacatctgcttccctgggggtttatgttcgggtttgtaacactatgtgagggtaattattaaactgttgacagtaataagttgcaaaatcttcaggctgcaggctgctgatggtgagagtgaaatctgtcccagatccactgccgctgaaccttgatgggaccccactttccaaactggaggcatcatagatcaggagcttaggagctttccctggtttctgctgatatcaggctaaagcactgctaatgccctgacttgcccggcaagtgatggtgactctgtctcctacagatgcagacagggaggatggagactgggtcaactggatggcacatctggcacctgagattggaagcataaacacaaatggtccacacaattaatcatgtagtaagagaatttccctgaatagccaggctgtactgagccccctgggctgagtaaactgctagtgttctccttccttacctgggagccagagcagcagaagccccaggagctgagcggggaccctcatgtccatgctgtgtcctgagtgggtctgactcctgcaagaagtgtgaccagcctattaagaagtcttcagggcaggaggttgtgttctgggaatatgcaaatgagcagaggatgggcaggctgggcacagctgcagggctggctcatctcagtaactcagcaccagttcagtgtccccaggtgtcccaggtaagaccagggtagcacaaatttgtctccagagaatgtgtttctactgggaactattttattatgagagacattttttaggttttttttgacaatttgaaatattcctcaggagttgatggagtaatgtatttcattggtgtatggggattatttaggagaatattcttgtttgtaggaaatatataataaaatgttagacggtatgattatcaggtctccaaaagactctcatatgatcccggttagggaaggggttactttgccctatacttggaacatttctgtgattttaacattgttcctttctaaaaaaaatcaaaaataaaatttattgacatgatgctatatatacatgtcagtattcggtaatggtgttatgccattgttcttaccactataagatcaagcaatttactacagatccacagagatgatgcctatgtacatggagaaagcagtttgatccagacaaaactggaaatgatttgcaatcattatatcgcacatatctaatgtgcccaaaactgtcccagcctagctcagtagcaggggaagtggatccaactatattagcatcagtgggctgcagcctagggctccacaaaattttactgatgcctgagtaggggagccaaatcacagtgccatagcccgtgcacaaaccttcttgctgctttgtaagccgcctgaattttaagggaacttgcttatattgggagaaaggaagaaaactccatttgtcctctaaatgtttgctgaaaataaactgacaaaaggaagattaataagagaaaaggcaaacaaaattcatttaaagtgcagcaggatatcatagcagggtgattacccaaataactcaataagatccagtagttcatatttcctttccagcgaagacggaattcggaagtgtaggcaatctggagagaatagatgagaacagaagtgcatcttcaaaagaacaggtaatagcctgtctggataaagcatcagttcccagtctcttctatttttgattcctgttttgtgttaatcttccctgatataaaaattctcaggaagaagttttttgacaattggtttccttctggagaatctgctttttggcagataagcgatgtttaggagaaggctttttgtgcatttgctgctttctaaatgcctttggttttatgtaatcctcatacgaatgcagcatagtttgagatgttattttctggattcctttacttacaactcacctaccaagatcctgttccagagagatgcagctacagactgaaagagcagttgacccctgaacaatgtggaggttggggcactgaccacaggtgcagatgaaaacctgtgtagaacttttgcatttctaacttaagtactaatagcttacttttgactgctagccttaatgataaaataaatagttgattaacacttttttaagttatttatatcatatactctattattccaataaactatgctaaagaaaaaaatgtaattaagtaaattataaaaatgagaaaatatatttactacttattaagtacttgcttacaggtgacacacacagaagaaaatacaagtggatctgcaaatttcaaacccaatttattcaagggttaactgtaccaggatgaatataggagtctctatctgtattctagggctttctctttgctgtacctctgctcacttccaatggcaatatacatgtcttatgttctttacagtcttgggcagagaactctgcctgcatgcattgctgaccaaatgacctggaatgtgtatctcttaggaaagtgctatggtttcactgtgtcctccagaatccatctgttgtaaagttaattctcagtgtaatggtattgccaattggggcctattgggatgtgtttagatcatgagtgtggtgccctctagtggaatacattaatgccagtataaacagcaattgtggggctgggatctctctctcttctgcttgtctgtcatgttaagacatggccttccttcctttgaaggaccccaaactccaggcatcatcttgaaagcaaagaaagcagaccttaacctgcccatgccttgaacttaaatttcccattctccagaagtgtaagaaaataaatttgtgttctttatgaattactcagtgaaaaggaatctgttacagcagcttgaaatagaacaagagagacagctcacaatcagtgaggacaggatgaggtgtatacatacttcagcttcctcatctctcaggtggaacagcccggaggaatttagtccatgtttccacaggtggttgatcttcagttctcctgagtcaggtgggttgttgatgcgtcttttacaattcatcttctgttcccttcctcactttcctccttttctcccagcgtaaatttgctgcctaaacaggaatccttattgcaggtggacccaaactaagacagtaaaaaaaaaaaaaaaaaaaaaatcgttaatcttttgtatgaggggtatttctcatctgaattctaataatttctttttctttgacatgtaggaatattcaggaagcacttaatttttctttaccaatctatttcagattgaatttgtgcagtgattttgtttttctgtgtgttaaaaccaaaaattaagttgtaggtcaccaacctgctgaatggactcctcttttgacagaaagcacttcaaagaaatttggaaaactagattaggccatgactggcaggtttagatgtgcctcattatactctcctccctttggagttcagacacaactgaccagcattatcattacaacagagatctctggactgatgaaacagatactttttagcaataagataccatactccaatgtgacagataataggccctggagaaaataaaaatattttatcctaaaaatatttctttgacatattctgaagtggccctgcaaagctacctgttgtgggggaaaattgcattctatagagaatctcctccccttactaagtcttttccaaagagtctgacatttttttctaaggtctgataatcaacattcaccatctactttatttactacccataggattcatctacatgacaagaaccccccattttctagactcaagcatttctttatgatgaattcaactctttaggcagagcttaactctttcaaccagttgccaatcaggaaagctttgaatccacctatgacctggaaacccctgcttcaagctatcccacctttccaggacaaacttatgtgtatcttatatgtactgatttatgtctttgcctgtaatttctgtgtctcctaaagtgtataaaaccaacgtaaaatccaaccaccttaggcatatgtttgcaggacctcctaaggctgtgtcacaggccataagccatatatttggcaaaataacctgtaaattgattgagacctgcctcagatagtgttttgcttacactaggtcacaaaattttaaaatgcctaaaccgcagcagcccggcattcctccaggacctcctcccccgggatcttgcttcaagtgctggaaatctggccactggaccgaggaatgcccacagcctgggattcctcctaagccgtgtcccatctgtgcaggaccccactggaaattggactgtccaactctcctggcagccactcccagagccactggaactctggcccaaggctctctgactgactccttcccagatcttctcagcttagctgctgaagactgatgctgcccaatcgccttggaagcctcctggaccatcacagacactttgggtaactcttacagtggagagtaagtccatccccttcttaatcaatgtggagtctacccactccacattaccttcttttcaacgacctgtttcccttgccgccataactgttgtgggtattgacggccaggcttctaaatctcttaaaactccccaactctgttgcgaacttggacaacattcttttatgcactcctttttagttatccttacctgcccagtttccttattaggtcgagacgttttaacaaaactatccacttccctgactattcctgggctacagccacacctcattgccacccttttcctcacttcaaagcctcctttgcatcctcccctgtgtctccctgccttaatccacaagtatgggatacctctactccttccttggcaactgatcatgcaccccttaccatcccgttaaaacctaatcactgttaccactagagcctgttatcacccacctgttacaacatggcctcttaaagcctacaaattctccttactgagggaagagagagaccctctcatattgttttatattgttttatactcagtacctgttttaagagtaaaaatcaaggaagtgaaatcagagacaggcagcccggcgccaggcctgggcctgcctggcctaaacctagtagttaaaaatcatctcatgacttagcaaccaatgttatccatagattccaagcattgtatgaagaacattgtgaaactccctgttctgttctgtttgactctgactaccagtgcatgaagaccctgttacataacccctagattgctcaatcaatcacgaccctttcatgtaaaatctttagtgttgtgagcccttaaaatggacagaaattgtgcactcaaggagctccgattttaagacagtagcttgccgatgctcccagctgaataaagcccttccttctacaactcggtgtctgagaggttttgtccatggctcatcctgctacattacaactcccctatcctacccatccaggaaccagacaaatcttacaggttggttcaggatctttgccttattaatcaaatcgtctttcccatccaccttatagtgccaaacctctacaccctcctatcttcaatacccccttccacaactcactattttgttattgacctcaaagtcaccttctttactatccccttgtatccctcctctcagcctctttttgcctttacttggactgaccgtgacacccaccaatcccaacaactcacctggactgttctgccccaaggcttcaggaacagcccacactactttggccaggccctttctcatgatctgctttcttttcacctgtctgcctcccaccttattcaatattttgatgatcttcttctttgcagtccctcttaccaatcttcccagcaggacactaccctgcttcttcaacatctctatttaaaggggtaccgagtatccccctccaaggcacaaatttcttcccctagtgttacctatctcggtataatcctccatcagcatacacatgcccttcctgcagactgtgctcagttaatctcccagacccgaatccccaccacaaaacaacaactcctttccttcttaggcattgttggatatttccgactctggataccaggctttgctatcctaacaaaaccactttacaagctcacaaaaggtaacttaactgatcccatagaccctaagttttttgcccattgttctttttgctctctcaaaaaggccctggagacagctcccacactagcactccccaactcgtcccatgctttttccttacacacagctgaaatacaaggctgcgctgctggagtcctcacacaggagccaggcccatgacctgttgcctttctatcaaaacaacttgacctcacaattctggtgcagccctcatatttgcgtgcagcagcagctgctgctgtaatacttctggaagccctcaaaatcacaagctatgctccacttaccctctacagttctcacaaccttcaagcattaatatcctcctcacacctttcacacttactgtctgcccctcgactcctccagctctattcatcttttattgaaaccccaacagtaactattggccatgggcacgatttcaacccagcttctcagttagtaaccaacacaagtcctgaaccacgtgactgcatttccctaatacacataggatcttcctcctttcctcgtatttctattcttcgaattcaaaatccagaccacccaatcaattttcaccaggtaagctggatatgctgtcatgtcccacatctctattattgaaactgctgcacttcctccctccaccacttcccaacaagccaaactgattgctttaactcatgtgctctctctcgctaagggaatgcacattaacatttatactgactccaaatatgctttccacatcttccataaccatgctgccatctgggctaaaagaggcttccttaccacacaaacctcttccattatctatgcctccctaataaaggtcctccttaaggctgctctcctgctggccaagcctggagtcattcattgtaaaggacaccagaaacctactcatcttattgcaaaaggaaatgcctatgccgacaggacagcaaaagaaatagccaatgcctccacacccgctaatattccagctcccactccagaggaccagtatttttcttccttatctatcactaccacctactcttttgaaagcctgctctactagtcttttccaactcagggaaagtgcttcttaaatcatggaaaattcattcttcctgcctcacaagctcagtccatgctttctttccttcatgaccacttccatgtgggatacaagcctctggctcgcctcctgcagcccctcatctccttctcttcatggaaatccatccttaagacagtcacctctcaatgctcgtctaccatgccaccagcccccaaggctttctcagccctcctccttttcctacgcatcaggctcatggatttactccaacacaagattggcagattgacttcactcatatgccccatatctgtaaatttaaatatctcctggtttggattgacaccttcactgggtgggttgaggcatttcccactatctctgaaaaggctactgcagtcatttcttcccttctaacagacataattccctgatttggcctccctacttctattcaatctgacaatggtttggcttttattagtcaaatcctccaagctgtctctcaagctcttgatattcagtggaaacttcataccccctaccatcctcagtcttcaggaaaggtagaaaggagtaatggtcttttaaaaacacacctcaccaagctcagcttccaacttaaaagggactggacagtatttctaccacttgcccttctcagaagtagagcctgacttcaagatgctacagggtacagtccatttcaacttttatatggacttactttcttgcttggccccaaccttgttccagacaccagccctctggacaactatcttccagtcctccagcaggctagacaggaaattcgcccgactgctaatcttctctttcctactccagattcccagccatatgaagacaccctagctgaatgatcagttcttgttaagagtctgagccctcaaactctacagcctcgatggactggaccctacctagtcatctatagcaccccaactgctgtccatctgcaggaccctccccattgggttcaccattccagaataaagctgtgtccattggacagcaagcctgatctctcctcttcctcctggaagttgcaagtactctccactacttcccttaaactcactcacatttctgaaaacagtaataacccttatgaacctaatatgttccttcattctattaggtctattcatccttactctactttttgcaacagggctttacacagtcacccccactacttggactgtgccccaaaacttgtcatccctactatcttctgtctagtcatactcctattcaccattctcaactactcataaatgccctgctcttgtttatactgctggtttacactgtttctccaaaccatcacagctgatatctcctggccctattgccaaaccaccactcttgacttcctcttggagtggatagatgatctttgctggcagggcacactccaatattttcaccatgatgaagtcctattctttatttttatactcactcttattctcattcccattcttatgccaccctctccctctccccaactatctccactacactatcagtctcactcactctctccaagccatttctaatccctccttagcgaacaattgctggctttgcatttccctttcttcctgcgcttacaaagctgtccctgccttacatacctactgggcaacatctcctgtctccgtacatctccgaacttcctttaacagccctcacctttaccctcctgaagaacttctttactttctagacaggtccagcaagacctccccagacatttcacatcagaaagctgctgcccttcttcgcacttacttaaaaaacctttctccttatatcaactctactccccccatatttagacccctcacaacacaagctgctattcctgtggctgctcctttatgtatctctcggcaaagacccactggaattcccctgggtaaccttgcatcttctcgatgttccttcactcttgatctccaaagcccagctacacataccactgaaacaattgtggctttccagctccatattacagataagccctctatcagtactgacaaacttaaaaacattagcagttattattgcttaggaagacattaccctgtatttcactccatcctttgctgccttccccttgctcttcagactctcctcccaggccctcttcttgtttgcttatacccagccccgtaaataacagtgaaaggttgctcatagacactcgacactttctcttacaccatgaaaatcgaaccttcccctctatgcggttaccccatcagtccccattacaacctctgatggctgccgcgctagctggatccctaggagtctgggtacaatacacctcttttagtactccttctcatcttttcactttgcagctccggtattgccttgcacaaggtctcttcttcctctgtggattctctacctacatgtgtctatctgctaattggacaggcacatgcacactagttttcctaagtccctagattcaatttgcaaatgggaccaaacagcttcctgttcccctcatgaaaccgacacgataaaaaagtgttattccactaattcccttacttgtcagtttaggaatttctgcctccactattgctctcggaactggaatagcaggcatttcaacctctgtcacaaccttccttagcctttctaatgacttctctgctagcatcacagacatatcacaaactttatcagtcgtccaggcccaggttgaatctttagctgtggttgtcctccaaaactgccaaggcctcgacttactgctgaaaaaggaggactctgtgtatttttaaatgaagagtattgtttttacctaaatcaatctggcctggtatatgacaacataaaaaaactcaaggatagagcccaaaaactcaccaaccaagcaaataattatgctgaacctccttgggcactctctaattggatgtcctgggtcctcccaattcttagtcctttaatacctgtttttctccttctcttattcagaccttgtgtcttccgtttagtttctcaattcatacaaaaccgcatccagaccatcaccaatcattctatatggcaaatgctccttataacaaccccacaataccaccctttacccgaaaatctttcttcagtttaatatcttctacactatgttcccatgccacccctaatcccactcgaagcagccctgagaaacaatgcccattctctctccataccaccaccaaaaatttttgccaccccaacacttcaccagtattttgttttttcttattaatataagaagataggaatgtcaggtctctgagcccaagttaagccatcatatcccctgtgacctgcatgtatgcatccagatgacctgaagcaactgaagaacaacaaaagaagtgaaaatagccagttcctgccttaaccgatgatattccaccattgtgatttgttcctgccccaccctaactgatcaattaaccttgtgacattccttctcctggaaaatgaatctcaggagctcccccacaaagcaccttgtgacccctgaccctgcccacaagagaacaaccccctttaactgtaattttccactaccctacccaaatcctataaaactgccccaccactatctccctttgctgactccttattcggactcagtcagcctgcacacaggtgattaaaaagctttattgttcacacaaagcctgcttggttgtctcttcacacacacatgtgtgacagattacagccctactgacaccttaacattagctcagtgagacttctgacacggggtactatattttatttgtgtgaagccaataagactgtggtgatttaaacagcagcattggaaactaatgcaaggggaagagatgtctttcacctcactgagagcatggttgtcctctgttcttggaaatatttccaccttgttatctggtgtcaattatgacatattttctagtatttaaagaaaagatctgctgccctaaaatcctatgtccagtaaaattattatttagaaatgaaggacaaattgagaagtcctcagttgtagaaaaactaagagtatttgctgccagcagatccactttaaacataggcaaaatgagccctaggaagataaaactaaagataaagagaggatgttaaataatgttagggacaaaaggctacaaaaatgagaagatagatggatataatgcattgctaaatcatgtgtgatagttgtatcaaagttgtaatactgttttgttcctaatatatgcagataaattacttttaaaaaacaatctatttacaatgggggaggaaacatgacataaaaaaggtaaaattctatatttattttaaatggtaatatattgatgccaacatactgtgagaagctatgcatataaaggaaataccatgacaaccaatttgaaaatcattataaaaagagataccccaaaattaggtaaaattaaaatgaaattgtgaagatgttcaagtaacccaaaagaaggcagcaaaaagaaaacagagaagcaaaaaaagatatagcaaaaaagtagagtgcagacttaaattttaatatatcaatatcaatatattaaatatgcaaattatgaaactttgaaaaagacaacaattgatgaataaaaagaaatgtcccaactgtatgttatctacaagacactcacatcaaatataacagtataagtagattgaatataaaaggaaggaaaatggtatactatgcaaacattaataaaaagaatcagtagcaaatactaatatcagataaagtagactacagagccaaagaatgttaccaggggcagaaaggtacattacataatgaagaaagtcattttggaaagaagacagagcagttctaagtgcgtagacaccaagcaacagagcgatatagtgcatgtggcagaaactaacaaaacaattgcacacagagacttcaaaaacccctttttaatcttcgataggacaactggacagaaaatcagcaaggatttaggactcaacaatatcatcaacccacgagatctaactgacatttatagaacactccaacccataacaatagaagttcacatttttttcttccaagtgcccacaacatataccaagataggacatatcctgcccacataacctctcaacatatttgcaataattaaaatcacagtgaatgtgttctctgaccatggagggatcaaactagaaatcaatattgaaaatgtaacccccaaattttcaaatatatgggaactatacaatattgttctttccaaagaaccagcctttggcttgcctggtgttcagtgtcactttttctgtttgcagttttattgatttctgccctaatatttattatttattttgctcatgttctacttcagatataaattgctcctctttatgtagtttcataaggtggaagctgagattattggttttatcccttttattttctgaaaaatactcatatgcatatgtttatctacgtgcatacacatgcataaatatgtgcagatgcatatgcatacacgtggttttaataccataaattaccctgtaagtgctgctgaatacctatgcgtattttcttttctctgagctcaaactccactcacttgcaaacctgcccacttaatctgcatgttcattggtgtctcaatctagaattgagcaaaaataacaaactcctttcattttatctcaactttcttgaccgctaatacatttaacatcagtaagtcagaatctatctaatagattaaggccaaagctgccaggtcactcctaatctgactcttctcacaccaaggagtgtaaatgacattgatttaaaaatatggtatcatctgcctatgtctccaacaatcttcactgccccaaaactagtttatgccaggatccactttgcccagataagcatctcttctgcttctcacagcccaattcgagtcattactttgctaaaaaataaatatgaccatgggggtactttggttaaaaaaattcccagaatgtcctgctgtacttacaaagcatttgctccccaaacagaaaatgaaggccttattaatttcacatcagtcacatgtggtgatctttaagacactgagagaaaatggctctgacctgccccctcacgaactttctcttttttacctcggttggttaagtcactctcctcatagtgcctttctctgtccttcacacgttcatactgtattccttctaagcgccttgattgtcatgaacctcagtgcccttcagaaacttctcttcaggtcagttgttctcctcatccaggtcagtcacctcctcagaaaaagtagcctctacctccctaactaactgactccttttcctcattaaccacttcctcttcccttgccatttttttcctttatgacccttaactttttctagaatctttttgttgatttatgtttaattagacatggcctttttttcaccagaaaagatataggtaaatgagagtcagacactgactttctcaggggtgcagcctagatacgttcctggtccagcatagttgctcaattaacactttattgaatgaatgaataatgaaaagttagtaagaaactctccaagacataatcaacactcataacctatacacgttgaaaacaacccactgaatgtaaaacatggattattctgagtaatgagaagtttgaatagcagtgtgctgctcttcatagtcagctcttcatagtcagtgtgctgctcttcatagtttgtattttgctggggagataaggaagacatccaaagtccatgataatcaggtaagagtattcttatcttttttaaaaaacaagcaaatagactttgcagtcacaaaaaaattgcaataaatgggactacactatcacttaactctattggctcctgttcacaaaaacaggttgtattattaactcttctttgaaaacaaaccagctccaaacaaaatgccataaaatgagtatgtgcagtcctccctcagtatccatgggaaatagtttccagggcaccctgcagatattccaatttttggagactcaaaacctttatgtaaaatgcacaatatttgcatataacctacacatatcctcccgtacatttcacaccatctctagcctccttatagtacctagtacgatgtctacacatgacttaacttgtgtagattcatccaagtgttactcagcacatggcaaagtcaagctttgctttttggaattttgtggatttttttttcaaaatatttttgatccaggattagttgaatccatggatgcagttcccatggatagagagctgactgtacagctccttataattctgagggtcagctctgtggttcttccattctgggctggctggactgatctctgctgagtccgctcttgtgtctgcagttaccctgtggttcatttgcgactggatggtctgatgtgacttctttaacctatctggaagctggtttgatgtgcaggttggacaacttttggtatcggtttacatgggtcaggaagatgggtcctattccccaatctgtattaggtttgttcccagatcaactctggggttcaagtctattcattgtgggttgtttgggagaaattctacatgaacaaagctgaactgctgtcatttattgctgttagcagttattgttatcctctgaaatgcatcttatataaccaagatctccccagggtggcccaacagtacagctcagctcagcccatcctgtcacttcgctggatgactgcaggtgtgagaaaggcaatatgctcagtcacaggaaaggcaggggcccaccctggggctgaaacctgcagacacagcgttcacacagcttctttgcaaaatacgaagacttcattttctttatacttaagatagttatacatttttttctataatgtccctatgctatttaactatttttaattttcagaactggttgtatttattatttctgtgttaggtgctcttagtcacttatggcaagagtgagttaatagagacaacatacagagtagccatggaacaatagagaagtgtgtgtattcagacaggataaagatcaaaggggtgacaaatacattcttttgagaagcagattctcatagatcaccacaagtcaaggtccacattcaaggtgcagtggcgtgtcagtcacattgtgcaaatggtcagctctgcacattaaacttggctagcacattgcaggaccaaaattacctgtaaaggtatggggaaaataaaccatcatggaaataacaatttgaaggagttctcaattatttatacttggatataaagcagaacgctacaatgaatgaacctacaacctaaaacctttaagccttttaaagaggtttctttttgtcagggtatttctcagcaaataatgataaaaaatttatggataaactacttgcacaattagccacaataaatcccttccctgtactcatcctttggttggcctcattctaaatggatgcaggtgttgcccatgtgtcttgctcaggccaataggataatagcagatgtgacacaagtggagtcttggaaagggcttgcacatcgaagctttcctctctctcacagtgcttggaaaccctaaggtcacaatgagaataagcctgtgcccatctacagtcaatgtcagtggcatggctgctcttcggtctactatttgttcttaaaatgtgtgctaagtttgttatggccatgtaacaaattaccacaaatttatcagcttaagactacacccatttatcatctctcaatttctgagtcagcagttggcacatggctttgtcgggtcctggccattggatttcacaagactgtgccacagtgtagattgggcttcattctcacctgtgagtcccctgagaacatagatactttagagctctttcaggtagttgcagagctcattccttagcatttctatgactcagggcttcaatttctaactggctcttggctcaaggctgctcttaggtccaagaggctgtggacaattccctgccatgtgatgctcacacaggcaatgcccacatggctggttgcttgttcatggtcagcagaaggtttcagagagtgtctctttccagtctgctatgacagaggcttatagaatacaatcattggaaagacatctcataacctatgacatatcatatggattagaagcaagtctaggttccgcttgctctctgtggaggtagattatacaattgtgtgattcactggggagagggttctgctagggtgttctggcatctttagtttcctcaaatatcaggtacttgtactgagtgtgaaatctgtcctgtacttactggcattgactagtcctgtgacccctgggaacatcttgggaagcatactttgtaagagaggttttagggtaacctagctattggaagcataacatttgcaaaatatcctaatctttgtgatttctaacatgtcctcaaggttccttaattgcaattatcataagccaattatctctaaatatccgcaaaatttatatttaatagtaggaaaatgatttattaaggagtctattaaacaagactcagggaaatgatgtcaacacccaattgctgctgcccactgctagactatgtgagacaattttcatgaacaatagaacagatactgcatgctagacacttctgtgagcaccactggcctgctacctctagaaatgtttgcagaacaagggcaattgctatgagtctcaaaatatatatttttttattatactttaagttctagggtacaagtgcacaacgtgcaggcttgatacatagggatatatgtgccatgttggtttgctgcacccatcaactcatcatttacattaggtatttctcctaatgctatccctcccactgcccccgaccccatgacaggccccagtgtgtgatgttcctcaccctgtgtccaaatgttctcgttgttcaattcccacctatgagtgagaacatgaggtgtttggtttcttttccttgtgataggttactgagaatgatggtttccagctttatccatgtccctgcaaaggacatgaaatcatcctttttatggctgcatagtattccttggtgtatatgtgccacattttcttaatccattatatcattgatggacatttgggttggttccaagtcttgctattgtgaatagtggcatgataaacatatgtgtgcatagtaccatgatttataattctttgggtaggtacccagtaatgggattgctgggtcaagtggtatttccagttcttgatccttaaggaattgccacactgtcttccacaatggttgaactaatttacactcccaccaccagtgtaaaagctttcctatttttccacatcctcgccagcatctattgtttcctgacttcttaatgattgctattctaactgacgtgagatgatatctcactgtggttttgatttgcatttctcttatgaccagtgatgatgagcatttttcatgtgtctgttggctgcataaatgtcttcttttgagacgtgtctgttcacatcctttgcccaatttttgagggggttgtttggtttttttcttgtaaatttgtttgagttctttgtagattctggatattagccctttgtcagataggtagattggaaaaattttctcctattctgtagattacctgttcactctgatggtagtttcttttgtcatgcagaagctctttagtttaattagatcccatttgtctatgttggcttttgttgccattgctttggtgttttagtcatgaagtccttgcccatgcctacgtcctgaatggtattgcctaggtgttcttctagggtttttatggttttagatctaacatttaagtctttaatccattttgaattaaattttgtataaggtgtaagtaagggatccagtttcagctttctacatatggctagccagtttttccagcacgatttattaaatagggaatacttccccatttcttgtttttgtcaggtttgtcaaagatcagatggctgtagatgtgtggtgttaattctgaggcctctgttctgttccactggtttgaatctctgttttggtaccagtaccatgctgttttggttactgtagccttgtagtatagtttgaagtcaggtagtgtgatacctccagctttgtttttttttgcttaggattgtcttggcaatgcgggctcttttttgattccatatgaactttaaagtagttttttccaattctgtgaagaaagttattggtagcttgatggggatggcattgaatctataaattaccttgggcagtatggccattttcactatattgattcttcctatccatgagcacggaatgttcttctatgtgttttgtgtcctcttttacttcgttgagcagtggcttgtagttctccttgaagaggtccttcacctcccttgtaagttggattcctaggtattttattcactttgacttaatctgtgaagtgtatttaaattctcattctagagaagaaaaatccaaagtacttggaaaagagaaatcttgccatgagatacacagttcttcagtttcaaagcagagattatctctcagatattctggctcatacaattttcagtacactgcaagacagaagatgtgaagacaacactacccaattggccttacacttgctttgctcactgttaactaagttcactgtaaaaaaaaaaaaaaagattacaataaaacacattgtcaatgaactgtcacaaataaatacatctttagaaccacatccaaaatccagacatagaacatttctatagctccaaaacattttgacccactcttttggaatcaacttgctttctgcctcacagatcagggaattttgatctgcttcctgtcagtacagatttcattttccttgtaagagtttcacataaatgaaacataggatgcgctcttttgtgtctggtgacttttgtgcagcatgactctttctcagattcattcagatgtcctgtgttctaattatgtgctcctctttatttttgagtattatttaactgttcagtaattttatgatggatcccttcatctattgattgccgtgtgggttgtttccattttgggctattatggataaagttgctgtgaatgttcttgaacaagactttgcatgaacatatgtcttcatttcttttgggctaataccaaggcgtgtagttgctgtgtttatcagtaagtgtttaatactctgtccgactttaccgaaagtggctataatattttatatgtccaccaataacttattatagctccacaccctccaaaatatttcaattttttttttaagatttcacctaattgtcactcaacagtaaccagaatagctagtgattattaagctatgtttttcttcccattttcttgtcaatttggggaattgatgtgttacaggacattgagaacagaatcaatactgtcctagttccctatcaaacacttttatcaagccataatatttaggatggtaacatgatatataaagggagtgttggagtagtaataagtattttcaatacttattatattccataaagcaatatatcttcaatgaaatggcatttaactagacttagcatagtaaggttctcatctcaaccctagtattcagtattagcaaaagtttgaggaaaaaaaatatccagcaacataagccagagagtgttttgctagtcaagtagcactgcaatactgatgctcttctaatgccagcccttcacaataatttccactcagaacatttggttgcctccttgccttgttctccttatgggacttcatgctgagggcatgtggcatcacagagggagcagtgcacttgggtgcagaaatatagcttagtagattgtctggccttagaggtggctgcaatggaatacacattttcaaggaagttccctgttaaacctcctggtaaactgatagttaagaccaggtgcggggacttatccccgttatcctagatgtttgcaagatcaagtagggagggtagcagaaatctaggagttcaagaccagcttggaaaacacagggagactccctcatctctagaaaaaaaacactgtttgttaagatgtggtgtgaacaatggcatctctaagtgattatttattaacatttgctgagaaaattagaaaatagaacgatgccttctgatccaataatatcataataaagatgtgaagtttttaaactatggtaagtatagagaacataaaattgcccatcttagccattttcaagtgtacaggacaatggcattaagtatagtcacattgttgggctagcatcaataatatccatctccagaactctttccatcttctagaactgaaactccatagccattaaatgacaaccccctccccgtttcccctgctcccagtccctggcaacctgtaatcaagttctgtctctatgacagtgactgctgtgaagcaggtttgctgtgccctggttaccaacctgtcagagtccagggagacagaacaatcatacacaacaagttacaagaatctagtttagtatttacaggtgaccagcaaggcacggcagaagctgaggatttattgtgggtctttaccctgaggcacaggtaagtggggctgatggaatcttgactgtgtgtacccctcttggaccagagctaaggaaccccagaaagaagatgctctgggttttaaaccctggtgtcacaggacacatggagctaaagtactggaggacttaagtacaggaggacagtactagagggagctggatcagaagccagtctgttctgacctgtccctcgctatttcagaatgttacatttccagcacattctacaattattattgagaagtgtaagaaagagagtggggaaaatcaagtgagtccaggaccatcagaggactggagtgaagtcgtcccccaacacagacatcctccgtagaaagctattccattttatacgcctaccaaccaccgtgaactggaggcacaggtgtgtcttgtcagacggatgaagcaccttgactgacacaatctcaaagcaacatcattgagacagagccagaaaagatttcactgggccaatgaaaactactaccagaggcagaatgatcaggcccacctgaagcagttatgtagcccaggatcccatgatccacagaagaagttgctaaaggggtgaaagaagaatccttcaggtgggattttctgaatctgcagaatccattttctgcaattatgagcttgtttccagatctcctctacttgaatttctaggatacctgaggtgtttatccaggtatagcagggggtattggaaattgtatacattcctcccagttgggattttttaaaggtctagagcaacactgttatcttaaacatccatcccgatggagttaagggatgtctgctgggttaccaaggcagtggctatggaggaggagcaatatctgccatggtcagggacaagttccttatcatttcactttttttcatgagcactgactcctatacatagtaccaaaaatatcataaaagacataaacctatcatctgttgtaccttctggtaggtccctagtaagtctgaggtacagctttgggcttcaggctctatgatttacctaattccaaggagcaatatccagagacaaccccagcatgcccaacatgcaggatctcactattccacagatatccagagatggcatcacatatcctgcattttggtcactcccaaaccgcttacagagaaagatgtagcccttgggtgcatacagccccccttttcccatttttcttcaatcactctgtcatggttatgctggtattggtgcgttcattagccaagtctcactgatagtagagttgcatgagcaaagttttgctcatacaatattgtctgtagacagagggctagcattagtccagtccttgtttttatcattgccattgggatgtttctcatctatgcaatcaaaaaagtatggtgcatcaaaatattagtccaccaatgttttttttaattgtggtcatgacattcgccagaggcaattaagttaaacaggggtcctccagtttcctcccatgtggcaggtgtcagattctcactttgtgggccagtgcttgggtccttttgatgtacaccttagtattaggaatgttggtgtaatttacccttggtagaatgaaagggaacctctagttaatgacagaatgaggtcaagaatgggagattcactattttgaaagatcaccctggtgacctaaaagaagctaacaaagacattgtgcttctaggcctttgctgcctcattcttgtcaaaatgcagcctcacaggttaatgcatcgtctctcacccatcccagggtctcaggtgtcccctacccatctacaagggttgggccgtgttggtgtaggaatgcggtctggctgtccttgctctgtgaacaatccattgcctttgtcacttgatccagatatttcagtcctgattgtccactccaggaagggagattctgccctgtaaaaactggacatatttcataatatcaccaacactaaagggaggataagatgtccctggcaccagaagagggcccctagctccgtgatatttcttagtcttgttatccatcactgtgggatcttgtagaaaggaagcacccagaggaaacataatcctcctattagagttagggggcctgtctggggcattgtaatggcctagattgcaaaccaccccagagcatgtattctaaaggaaaaaaagaaaaggaatggttaggaacactgaaatagctttcacaggtccagactaatataagtgtctgcctggcctacctttacttccacccagctctgtgtttctcaacatgcactatttccctttttgtggcccaggatctttaatgtacatatttctctagtcagatgggataccaccccattaacagactttgtagatgtcctttctgcatattgctgtgtgattccactgatctagcattcactaggatcattggcctgtggatgcagggtgcatggaaagttcatcgtgttccatgagagtgtgcctattgtcacgttgcttgggcagtgaaagatgctcctttgtgagtgagaagtctcatggagtatccaaaaatatgacataaattgcactcaagggttacctaggtagtcccagcatcaaattcagcatcatatttctttttcctgcaggtggaaagctgtggccatagtcctttccttcacactggggattctttaatagtccagtctctcagttgccattttcctgaacagatggcaaggctgttgacaatggccgaggatttagtggatatgtggcatggtgcgttgttgggacagcctgcatggccattaccactgaatgtagttttgcccactgggtagaaagcccatgttaagtttcagttaaaaaagtggccatccactggctgaatggtggccacacctagtggatctgtcagttagcattttgctcagccttcagtgactcctgccatatggaaatctctgaatcttgggctccacatgggcaaataaagagccaaattatcacctacaagttatttggtcccttctagcaagctccccatttgttcatggagccacagatcctgtggggtcctgactaaacctgatcaagaatgtgccatttccatttgataacatggctctgttcagattgttcagttttactaatggtgtttgtaagtatctaagtgagaatggacagctaagggaccagtgtcacagtcacacatggtgctgaagccttaacatgttcagtctccatcagtgcctaatagcaagcaaggagttgccattcaatataaacacattcagtggctgattcaggcaacttatgtgtcctaagattgagaggctggtgcactcattgatagttttctgttgctatacgctccactgagtatgcatagaggttgtggatacctggacttccatctggttagcaggctgtaaaaatcttagagaagtgactgggccaggccttgttgaacagattccaaggctactgttgcaaaacgcctttttcaaagttggcaactttgttcatgattttgactaagggaaccaaaagaacacccaggtgaggtttatgccgtctcccattcgcaaaggggcctacctgccactgagtctccttttattcagtgggtgccacagcgaccaatgtttccagctgttcagttggcataataattaactatgagtacacagctcactttcactatacatatattccttgatggaagttacagcatcatacatgattagcgtgtcagaaccttcaccacatctgatagggtatcaattcaattacctagggtttgtgtgtcagttttgcttgactaagaatatgttttctcctttctatagagacggctgcacctgtgcaggtgataagatcatgaactgcaccctttgccttacttttttgttgtaaataatttgcccgattcaatgccatattatggaagaatttcttaactgtgatgaaagcacttggaaaatcctcaaataatatttcatgcagaaatataactgaaagaaagacaaatgcatatacaggaaaacaactgctgctcttctcatgttggatgaggcctgctaaaaacacctgacaccagctgttagtctgatccttgatgtctggtacaatcttgggttattctccttggaaaagtggatgctcagaagtgccagtatccccatgagtcccagttaactgaaattcatattgttaagcccatgcatggatagtcatgacatcagttcatgagattccctgggaaagctgggaaaggtaactgatgaagtccatgttttgaattattttaattattttgagctcctgcttctaatggcctttagataaatattcacttggaaaggatttattttttctactggtccttttttggaaggtccagtcatatctcctccagagtgactttgtgtccaatccttcagatgtgtttcttctaaggcctgatgatctgtcaaaaccactagtcaagatagtgatattgttggtaatatccagagcggggagaggacaatagtactcccaatattgcgggaggtgtacacccctctttgtgttattgttcttaatatccagggggaaaacaggatgacgttactaccaatatcgtggggggtttacaccctcccttgtgagattcttcataatatccggcaggggggtggataggactatattattcccaatatcgtggggggtgtacacccctcttgtgatattattcataatatcctggggggagacgacaatattactcccaatatcgtggggggtgtacaccccttattttgatattgttcgtaatatccagggttggagaggacgccattacccccagtattgtggggagtgtacaacccccttgtgatattgttcgtaatatccagggagagaggaagatattactcccaatatcgtggggagtgtacacccccaacttgtgatattgttcataatatccaggaggggagaggacgatattactcccaatatcgcccgggctgtacacgcccccttgtgatattgttcgtaatatccgtgggggaagggaagatggtattacttccaaaatcgtaaacacattgtgtgtacacccccctgtgatattgttcgtaatattcggggtgggggggagaggatgacgttactttaaatatcgtaaacacgttgtgtgtacacccccccaccccacgatattgttcataatatccagggagagagaggagatgatattactttcgatatcgtaaacacgttgtgtgtacacccccctgtgatattgttcgtaatatccgggagaggagagtatgatattactcccagtatcacggagggtgtacaccccccgtgatattgttcataatgtccagtgggggagaggagatgtattactttcaatatcgtaagcaacttgtgtgtacaccctcctttggtattgtccataatatccagggtgggagaggatgatattactggcaatatctcggtggctttacacacccctgtaatattgttcgttaaggagttaagaggatgatattactcccagtatcgcgggggagtgcacgcctctgtgatattgttcataacatcttgggagagacaggaggaaattactcccaacatcgcggggcatgcacagccccctgtgatactgttcgcaatatccagcggggaataggatgacattactcccaatattgccggggatgttcaccccactgtaatatttttcttaatattcaggggggaaggatgatattaatcataacactgcggggggtgtacacccttctgtgatattgttcattgtatccagggatggttggagatgatattactttcaatatcgtaaacaccttgtgtgtacacccccctgtgatattgttcctaatatccagtgggggaaaggataatattactcccaacatctcgggaagtgtacacgtccctgtgatatttttcataatatccaggggggcagaggatgatattactcccaattttgcggggggtgtacaacccactgtgatattgtcgtaatatgaagtgggagagaggatgatgttactcccaatatcgccgggagtgtacacccccctgtgatattgtttgtaatatccagggggggattggaggtgatgttagtttcaatatcgttgacaccttgtgtgtacacccgcctgtgatattgttcgtaatattcagagggggagaggatgataatactcccaatattgcggggagtgtacaccaccatgtgatattgttcataatatccagagaggggagaggatgatattatgcccaatatcgtggggggtgtgccccccctgtgatattcttggtaataatcggggggagatgacattacttccaatattgtggggaatgtacacccccttttgatattgtttgtaacatttggaggggagaggatgatattactcccaatatagtggggggtgtaaaatccccctgtgatattgtttttaatatccggggggatttgagatgatattactttaaacatcgtaaacaccttttgtgtacacccccctgtaatatcgttcataatatccaggtggggagaggatgatattacgcccaataccacggggttgtacatacccctgtgacattgttcctaatatccaggggaggaggggttgatattattcccaatatctcagggagtgtacacctccctgtgatattgttcataatatccaggggtgattggagatgatattactttcaatatcataaactttttgtgtatacacgcccctgtcctattgtttgtaatatccaggaggggagagtatgatattactcccaatattgtggggggtgtacaccctcttgtgacattttttgtaatatctgggagggagaggatgatcttactcctagtattgcaggtggcgtactccctgccatgatattgtttgtaatacacagggctgccaggatgatattactcccaatatcttggcattgtaccctggcccagcatgatgttgttgttcgtaatacccaggcagggagaggatgatataactcctaatatcacatgcagtgtaccccctctgtaatattgtttgtaataccctgtggtggagaagataatattattctccatatcaggggtgatttactcctcttttgtgatattgttcctagtaccctgtggtggagaggatgaaattgctcccaatatcaccaccgatgtgacattgttcataatactcagggcaagtctttcctgtgtttgtcccatgatagggaataagtctcttgagatctgatggttttatgaagaggagttctgcacaagctctctctctttgccttttgccatccacgtaagttgtgtcttgctactttttgccttctgccatggccgtgaggcctccccagccatatggaagtgtaacttaattaaacctcttttttttggtaaattgcccagtctcggatatgtctttattagaagcatgaaaatgggcaaatacagtcaattggcaccaggagagtgggccgctattgaaaagatacccaaaaatgtggaaatgactttggagctgggtaacaggcagaggttggaacagtttggagggctcagaagaagacaggaaaatgtgggaaagtttgaaactccctaaagagttgttaaatggctttgaccaaaatgctgataatgatatggacaatgaaatccaggctgaggtggtctcagatgaagatgaggaacttgttgggagctggagcaaaggttattcttgttatgttttagcaaagagattggtgacattttgctcctgccctacagattggtggaactttgaatttgagagagatgatttagggtatctggtgggagaaagttctaagcagcaaagcattcaagaaatgactcaggtgcttttaaaggcattcagttacataagataagcagagcataaatgtccagacaatttgcagcctgccaatgtgatagaaaaggaaatcccatttctgaggagaaattcaggccagcagcagaaatttaaaaaagtaatgaggagcccaatgttgttaatcctcaagacaatggggaaaatgtctccagggcatgtcagaggtcttcatggctgcccctcccatcacaggcccagaggcctgggaggaaaaagtggttttgtgatccaggcccagggccttcatgctgtgtgcagactaaggacttgttggcctgtgtcccagctcttccagccatggccaaaaggggccaatgtagagctcaggctgtggcttcagaggccccaagccttggcagcttccacgtggtattgagcctgcaggtgcacagaagtcaagaattggggttgggaaaccttcgcctagatttcagaggatgtatggaaacacctggatgcccaggcaagaagtttgctgcaggggtggggtgccatggagcactgctagggcagtgccgaagggaaatgtggggttggagccaccacactgagcccctactggggcactgcttagtggagctgtgagaagaggggcactgtcctccagatcccagaatggtagatccactgacaacttacaccgttcacctggaaaagccacagatgctcaacgccagcccttgcaagcagccaggagggaggctgtactctgcaaacctacagggacagagttagtcaagtccacagaaactcacttcttgaatcagtgcgacctggatatgagacatggagtcaaaggagaccattttggaactttaggtttaactgccctcctggatttcagacttgtctggggtctgtagtccctttgttttggccaatttctcccatttggaacagctgtattaacccaatgcctgtacccacaattgggcctaggaagtaactatcattcttttggtcttacaggctcataggttgaagggtcttaccttgtctcagataagactttggactgtgaacttttgagttaatgttgagatgagttgagactatgggggactgctggaaaggcatgattggttttgaaatgtgaggacatgatatttgtgaggggccaggggcagagtgatatggtttggctgtgtccccaaccaaatcccatcttgaattctcacaggttgtgggaggtacccggtggttggtaattgaatcaggagggcaggtcttctctatgctgttcttatgatagtgagtaagtctcatgagatctgatggttttataaagaggagttcccctgcacaagctctctctctttgcctgccaccatccacgttaagatgtgacttgctcctccttctgccatggttgagaggcccccccagcttatggaatcgtaagtccattaaacctctttttttgtaaatttcccagtctcaggtatgtctgtttcagcagggtgaaaacagactaatacaggattcagacagatttagaattttaatggcttcttgatggatttaccaatttataattataaaatgtccattttatctcttgcgttaaagtcatgacctagtttctgttgctcagttttacatgatatgtacttttcatcctttcattttcaaagccattctatattcttactatagtgtgtatttaatgattaacatacatctttgattttaatcctgtctgataattttatgatttacttggaaaaatttgtttatttacgatgcaattattgtaaagttagggttaaacctaccgtcttgtttcctctgattttcttgattcatgctttcatttgaattagtttaattatagattttttcttatattaacttgctaaatatgcaagattattatacagaagatatcctcaacttattaatgcctaatacacatatagtgtattaaaatttctctctcaaattatttctaggtaagtgacacaagcagaatcaaccttcggaagatcatctatttcctgctgggttgacctggaatgtgtgatatgacctaaggtaacctttgagtcaccacacagacctagagctctgtgtgatgcagcacttcctcaggagcttgcagtggcatcagggcccagccttgaatgccaggcaggggtctctcgactctgtgattcttcccaggaaatacataagaacttgcatctgggttcatatctcaaacgcaacccaccagtctctcacgtactgacctctgctccaagtcttcagatggttatttttcatggggtaaaaatatggcttacatattatcttgtaattctgtttaagatggcatacttatgttcctttattctttcaaacttggtccttattgttgaaacccagctttggagttcagaaaactactttttacttcaacatgctgtggttgagactgtggaaagacttttggcactaggtctttatttttgcatacatttgcagcaacatatctagtaacttaaaaatctagaccgtgaagagttatattttggtactccctgaaaaaagtaggaaaaaatacagtgcctgctggtgtcctggtcaggggtctgccttcggaaaagtggtggggggaggtggaggaggggagggaaactgttttaatattaccaaaccttatcaacatacatatactctagtaactgctaaaccaaatcaaaagaatgtattagttttgcgttgccagtaatcagtctcaattaggtgcctgttacgcagaacgaatttacttgatgaatgaatgtagggaaggaagagaggcttagaatgagctttcattgagctttctcttctctcgtgtctcattgctcaaaggggaggtgtacctcctcctttttgcagactctgtcatgcaaaggccgctgcagctgatgggaacttaaaatgtggtgcctgaggtgtagctgagaaatttatggtcatgagccctcagctgtaccaagtcctctgagttctccaacatcttggtctttaggcatctaagagaatccacagtgcctgctctccacagaaacaacacatctgggcagctaggccacagcaagcagggaggtttgtgttcaggactgtaccattgtgggagaataatgtgtactttgctggcagcaataaaccccaacatcctcagcatccatcctccttattttaaacatgaaatctgtccccgacccactgccactgaacctgtctgggactccagggtccctgttggaaaccaaatcaatcaggagccgtggaggctggcctggcttctgtaggtcccaattcaaataggtgtatccattactgtgaaaggggctatgactggatctacaggagatagaggctggctttccaggggtgacgggcagggagagtagaggctgggtcacacagcatctccattggatcctgaaataataagagagaagtgcaaggttatgtacaaacattgtgagccattttaataattttctgtctgttatttatgttttgctcaattattttttgtgtatgattttggttaatactcccaaaacatacaggtttaaaaagaaccaagatttgcaaagcacaaataagcctctagaagtcacctatcccatccccctctttctgtgtcacagctttcactaaagtacatgtccttgctccttctggaatcttcctcactctcacagatctagacatcacatgccccatcctggaggacaagacacatctaacacgaggacagaacacacatgggaggtggcagggcccacagagttcaccctcccaccccatcatcctccctcatttcccttctgctctcagcagggacccagtgcattagcagccctgggagctgagcagggagcctcactgtgggaaggtgaactgaggagtcctgatcagtcaaggcaaggttagagctgagcttttatctcagactcacaagggaaggtcttccctaggggacagtatgcaaatcccctggtgggtgcagtggggtggaaagagccaaggagaaggtggggacctctcttgtgagcaaaatgacataaatatattttatgtttttaaggatatcaagagaggtaaaatctgtttcctgagtggcagaagggacatatttagatgtttcctgctatttcctctacccaatttctagttcgttaggactttctcaggcatgttttacacttctctttaataaggttgagctttcataaatatttggtgattcttatttcttggttcaggcttatttaaaagagcctaggtttgttttattttattttatttaaggaaaaacacacagtgcaaaaggttcaaatcttaagggtgcaaatgaatgtcaaaatccagatcatttcatgtcatgatccacatcaaaatatggaaggtttccaattctcttgctgctttcattatgcaccttcccagtcagcaactgctgctcaaaacacaatcaatgtaactgatactgtgacatctattataattgtttttttttcctgtacttaatcttcatatcaggtaaacattttttgtagcttctttcttatttctttcattttttgagggcttgattccttcttatcaatttgaattgctgtctgctctcattccctgttattctgaaggattttctcttgaattttccacaaggcacatatgctataatgaattagtctttgtgtatgaaggaacatttctaccttgcttttatgtttaaatgattgttttgctggatatagcatttgtggctgacttttctcccccagcatttaaatatatcattccactctcatcccacctctattagtaatgatgaaaatttagccaatacctttattattgcttcctagtatagagtaagtcagtattttagtgatgccttccaaattctctgtgtctttgtctttcaacattggtactataatgtgtattgttatgaactgtattgtgcttatcctagaagggtttcactgagttactttcatgtacagactaatgtgtttcatcattgtgaaaaatgtttttcattatttctccatttttttctttttcagtttttattttagaatcaaaccatacatgtacagatatgttacaaagttattttgcatgatgctgaggtttggggtatgacagaaattattaaccagttagtgaacattgtacccataggtagtttttcagcccctgccctttctccctttgtgttccttctagcacaatgtctattgtgcccatcaaccagggattcaataaagaaactgtggtatatatgcaccatggaatactatgcagccataaataagaacaaaatcttgcccttgcagaaacttggatgcagctggaggccattttcctaagtgaacagatgcagaaacaaaaaaccaaaaaccacatgttctcacttataagtgggagctaaacatggggtattcatgggcataaagatgggaacacatttttagcctctttctgtcttctcctttgtgattcctaatacaaatttgttggtattatacacatggacctataatgtctgaggttttattcattcttctttataattttttccttctttatatgagaccatttctattgacttgtttttcagttcactgattcttgtgtcatcttaaattgctattgagtctatctaatacatttttcaattgagttgttgtacttttcatttctagatttcccagtatgcttgttttcatagttttgtctctgtttgagagcctctattggttgaatcattgtctttacaaattcctttttcagtcttttattataggttaaaataattctttgaacatatatttgataagggtggagcacatagacaccatggagatggaccataaggcagggagctccgaattagattaggtgaattttgagtctctgactatatgatgctcttgtgggttttaattatttcccatgttttatgtttctcatattacaaatagcttttatttttaagatagtaactattatagaaattcagcttataaatccctggaaatttctaacagaaagattgatgaaaagagggtttttttaggcccccacaccagcctctgcctgggacctgactttgtctctgagccagtggaatctgtgatgaggttttgagttgggcagtgaaatcaccacagggcaggctgtgctctgggtgctttggatgacaggaggacactccttcagggtcagtgatgctgggagttcaaagggagactcagcatggagctgcctgtgagttatcccagcaatcctgtttggacagtgatcatctcacaagtgtgctcggaagccactggatggccaaaatgtgggctcaggttggagaaggacaaagctatagggatgaaaatataagactcatttgatactctgaaatatcagtacaaccatcatgaattatatgggaagagaaaggagtcacaagattgtgattttttatttgatattaaaatatgtcacctctgctcatttttccctcaaggatgtacctactgatatacatttaaccaaagtcactgtttttaattttcattttagtaactgacagcctatgtgcagagttcctaaataacgaagccagaccatcattgctatgggtgaagccaggaagtgactgtggatgtgaacaaatgtgagattcatgtacacgtctccaaagacagaggccactgatctggggagaacctgcagtcatttcactttcccatacccagatgagaggacaccttgatctgtgttcatctgatgaactctaaaatctggaccatattctgaaggtgtagttcacacttcttttctgtgctagtgggactctctcactgacgtgtattgtaccctctgcataggacagtctgtgatacatactacttgttttctgctaaacacccatcaatcatgtcatttatgagtcttccataggtgttacctaacctatggctatggggtcttccaaaagaatgggccggaggtggagctgtgaaactgtagctggataaaaagtgtaaatgtcaagaaagggtattgaagtggtgataataataataataatccaaattagtctgggctcttggctgtgattactggtaaatgtgaaagagtctaggtttggtttttattagttttatttcaactgataaagtagccagagtaaagtgcataaatcttgaatgttcaactgaatacagtttttgtgtaattcattgtccaaatggaatgatagaatatttcacattcccttgtgcttccctcatggacaatctttgtcagttatcacccctcccacccagcaaaattaactgtctttctgacatctatacaatcatttaggttttcctgtcttaaactttatataaatagcattaagtgtatttttatctttttagacttggtattgctccttacaacttttgaggccttcatttctttcagaggattcaaggtcctgtcttatgtcatttcctgtgattctgaaggattttctctcaaatgtcttgtaagagacatagctgctatgaatgaatgtattttgtttatcaaataatttttttgctttttctttagatttgaagggtattttcgatggatatagatttcctggttgcctttttttttcctttcagcatttaaatatgacatttcactccttctagcctctattggtcctgatgaaaactcagccaatggctatgttgttgtttttctgtatatagtatctgctttcattcttgatgcaatgaagattttctctttgtctttcaatattttaatataatgtgttcagttattaattcctattgattatctaaaagatttttattgaattttttcatctaagaattttttattacttttgaaaagtttttgtcattatttctccaaagatttcttcagccactttctctttctctcctcctttgtgactcttattatacatttgttggtattcttcactctgagctataaatctctgaagtcttcttttttttctaaactttttctttagactcaataatttctatacctctattttcaagttaactgattgttctgccatctcaatttgctattagacctagctaacaaatatttaaattggtttattgtacttttcatttctagagttccaatttggtcattttttatattttccatgtcttttcttgagcccctacttgccgaatcttctttttttttttaaatattttcttttttatgtcaatgatcatagatttaaacataattatttgaacatctgcatattaactgctttgtagtctttgctaaatccaataattgggacaagttagaattagctttcattgactattttctgttgttattattgtagctgctttatttttattcctttaatattgttcatacttctctgcttttttccagaagttgtgaaactaaaaattgtacatttttgatagcatattatagtagctgtctttagattttgggcttttttattttaattttaacttttttagaaatagggtcttactttttcacccaggctggagtgtggtgctgtgaccatagcttgctgcagcctcaacctcttggggtccagaggttctgcagcttcatcctcctgagtagctgggactataagggcatgccaccactctctgttatttttttttttaattgtaagataagagtgtcactattttgcccacccagcctggtctcgaactcctggcatcaagtaatccttctgcatcagcctcccaaagtactgggattacaagcttgagccaccatgtcaggcctggaatttgttttgtttttctgatcattttttaattttcttcttagtttcttgtctgaacttactgatagtacctgacttatgacagttggagttataatgttttgactttcagatggtgtgaatgtgatatgcattcaagtagaaatagaaattctagtatttacacaactattctattttctctttcaatatagtattcaataaattacatgaggtattcaacactttattgtaagataagctttgtgtaagataatgttgaccaacagtaagctaatgtaagtgttctgagcatatttaggataggataggctgaggcataatgttaagtggattagatgtattaaatgtattttcaatgcaagatatagaaaaatctgtatctcatgtggcgtttgaccacagatatctctgcttctttctgttcttaatattaatatttagtttgattttataggaactacacatgtatctgcatagcgaagtggtcaccaatgatctgagacattttgctcaaatatctggaggttataaatctatcttctgtcaacccatctgtgtgtagtttaaaaagcaaactgcatgcaaaatgcagctagttcttacctccctctggttttactttgcaccggaaactcctagttctcatcactcatatctataacttctaggtcactaggaatatgtgcagagattatttcagcaatgtgggtctatcttatccaggaatctgctatttactatcagcagatgtactacttgcctcaaacaaggcatcatcttggactagcaaggctgtgggctttttctgttcatttcctatggtgttctccctgtttagctggaaacactgaagaattatttcccactccttggcttcactcaagtccacccactttggcagcaagctgccagttttatttgctatccttacatgggtaaaactccagttctgcaattcatattgactgagctgggaatagaagggtgctgtcacaggcaaaaggctacagacattttctgtccttactcaaagcactagtactttttttttctataaagaatatgcatccttaattattttatgctttgccaattttcagagtgctgaaatagttttgatatttcaactttatatttataggtgtgtttgttgtttattcttgcacagatttattaaactctttgtgatgccataaacagagatgccttctgaaatgcgtttaaatgaatgtaatagccacactgaaatggtatgatgtaatggactaacataagtaattttggacttgagaacttgagctccaaaatggccaaatagagcagagatgctaaaactgagtggccaccacactagctgtctgtaaaggaagcagctggtataatctagtaaacactgatggtcttcttgaggtttttgtttcatgttgaatcactgtgggaggccagttattatactgctgacagtaataaactgcaaaatcttcagactgcaggctgctgatggtgagagtgaactctgtcccagacccactgccactgaacctggctgggataccagtggccctggtggatgcaccatagatgaggagcctgggagcctggccaggtttctgctggtaccaggctaagttgctgctaacactctgactggccctgcaggagagggtggctctttcccctggagacacagacagggtggctggagactgcgtcatcactatttctccagtggtatctgaaattggaaataaaacagaaatgcactcatgtaatcaaaatcaaacccactgtctttaagtagagccaaaattgttgatctacattgaattttaattatatttcttgctgagcagaggtggcaggagttttcactgatgtgcaaaaccacctcatattcccctcacctgggagccagagtagcaggaggaagagaagctgcgctggggcttccatggttccgtctgggtcctaactgagcagttcctccccagagctctgacccaggcattgatatgggctctggaaggtagggcagctgggagggacatgcaaagcagctggggtgggagctgagctttcagctgcaaagaccacctgcttcttcctctctgcactgagcatcctgcgccgccctggttgtcaggccagaaaagtctgttggctcagtctgagtgtagaactcctcccttgtgctcagagaatttcgctcctgtgtctttcttctcctcaatcacctaaatccacccagaagatgtttggcacaagcctgttaagaacaatataaaaagctgtgttttcacttctctcttcctatcctcaatatgcccagtcatctccctaagtgcattattggatcgatggaaatgaagagtctgttaaaacttaatcttccagatacacctttcatttgcttgttagtaatgttttctgagggtcctgaagctttccattaacccagccacataccctctttgagttaaaaagtgaaaaacttctgtttacagtcacatgtcctggcagccctgacatagatgctccatggcttgccgattgcttgaaattgatcaagtaacttaacttccctgtgtctcggtttccatatctgtgtaactgtgacaatactggtacctaccttatagtgctgtagacagtttaaagaaaataagataaaacatttacaatagtattcaggacattatgtatgcggcaattaattttgtttttatttattaaatattcagcactacagtcatcatcattatcataaatatacttacttagcacagaaaagagtcttcagtctaatccaagaatgttttatccacagccaaatttaattctaaggcttttccttcactaactctacacaactctttaaatcctaatgatttggtcttaatctgtgctaaagtactcacaccttcaatcattcccacccatccctgtctaactcattaattctcatcatccattatcaaaatgttactctataaaaggttcccatgtcctgttgctgtccttctttcttacacaatctttattctaccctgttatcttttgtcttattcttgccccaggacaataaggaaaagctaccatcattacctgttgacttgctccagtataattttttcaggcttgttaccttggaaatgaggactatgtctggcaaagaaacatattcatcgggtcaatgtgttatgaaataaaatattttatctacttatgatccaataattaatttagacctacttgaacggtttttttttaatgaacgaagaagaagatgatataagaggaaaatacaatacaatagaaaacacaagctattataactcttgcttcacggatttctacatatatattagacatatgctgggtatatgtgtgcaatggtgatccaaaaactgaacgctaactggctgaaggaaagcctgtattacattgggtcttgtctatttttccaattatgaacagaaagctacagtactatttgtatgagtatcaaaccttctagctgctgtgatggaggtagagaagatttactgagactaaagccttggaagtactagaagtttgtcctgtgatgttatgggtgttgctgtggttgttgttgttaggaaatacagtggaagtcaaagcaagtagaaaatttacaagctctgctcttcctcatactcacaaccccttctagagatgacagatagtggcataggaatctctgacacctctaaggaagtcttttttgctctttccgggatctttcctgacaagtattgttttgagtcacagatgatgtggaagtaggtgtagaagaaaggactagagcaagggaagaagttttcaatcccaggtagttgttgtaggcacagggaaatggaatttttcatagatttatgctacacttctatcatgttggggagagaggcatcaaaccaagcttattcttgaaagaaacattacattattttaaagagaaggaactatgcatttcttgtcaaatagatgtttaaaattcaaagctacaatttttttttttgacagtatcttgctctgtcgcccaggctgtagtgcagtggtgcgatcttggctcacggtaacctccatctccctggttcaagtggttctcctgccttagcctcccaagtagatgggattacaggcatgtgccaccacacccagctaataacaggagggagtaaagggccacacaagcatgtacacaagagacaacttttcttcttttttacagaataagtctaaatgtaaaatagcgttataatgtatggactcatgtttaagacaagtctcttggttttctaatttgtgttgaacccaagcagtgttgtgatagaaaatgagtttctttttctttaagctgaatttgaatttgctccaatagcctaatagacaccctagtggtaagtcctctgtgatgctcgccattgtccccatgtctaacaaggatttctactggacatagaagtttttctaagtccaacaagagggaaagagactgggccatcattgttctcatctcagatttccacttcctgcatagaaggtatacatataggtagccagacgttatgaaaatggattgtaagcatttgttagtgaacaaaatatgactcaaacagtatttttattttttatttttaaatttctattgcttattatttgagacagactgtcactctgtcacccaggcaggagtgcagtgggtgcaatcttggctcactgcaacattcacctcctgggttccagtgattctcaagcctcagccacccaagtagctgggattacaggtgtgtgtcactacgtccagctcatttttttttttgtatttttagtagagacagggttgcactgtgttggccaggctggtcttcctgacctgaaatgatccgtccatcttggcctccaaaagtgctgggattacaggcgtgagccaccgcactgggatttaagcaatatttttattaagtaaagtgtagaagaaaaagtgtaagtaaggtgacaataagaaaacaaaatgccgtaatggaaaacgataactttagggcagaaaacaagaaaaggcaaaccaagattcctgtagggcaagcctccaatgcacaatccaaggaggaatgtcaagggtgaaaactctggagcatccagatagtggcccaaaataccaaatgctgaaaacccagaatacccaagtaacagcctatgagtgtccccacaccaaatgccaggaaaccctggagtatccaggggctgaccagtgcagaaaatcctggagcctcagtggggtggccaacaatgagccccaaaggcctggttggggccataaaacaatgtgactctggcttcttagagtcaacagaacaggagaattcttacatccaagtgtcctgccttaaacaattgcacaaacataattagcagggacccaaagaaaaaactgcaaagcaaacacatatatcggggcagaaaataaaataaaatggctgatggataaataaaatggcattagaggagaaatgactaagagaaagaacaatgaggatgtagtcaggtgtgctatgggggaattcaaatggactatctagccaaaggccttatttcctggatcatctatataggcaggtggatagatgggacacttacaggtgtgcaggagccaaaatggggccaagcagtgtctgacatggggcctgcatgaagatctctccaggcttcccagctcggatgggttgggctcctatgggggaactggagcacggagcggctggcctgcatgaagcagtggctctgtggcctcttgcccatccccagagctccaacacctgtcaggaaagatgatggttcttaaaacagcctttggctagtgttaatagctctgcaatgttaacaactcagcataaagtcacacagacacacagacactgtagctttgatcgctgtagcgctgatcaccgtctcatcctctctcactgatcgctgtcttgccacttctccaatagctgtcttgcccattgctgatcactgtgtccatcttctcataaagtgccatctcttgctgtctcttgctgtcttgcttctccgctgtttccactgtcttactgccacatcaaatgctgcttctcaccatctctagtggtgagtggctggctcaatattgatgcaaggcaagtcctcagctttgctcaggaaggaatgtaagagtaagccagtaatagaagaaaacagctttattgatggggcagcagtgttacagctctgtgactactcctgcggagcaggggtaattcataggcagagggccgagagtagcagccaggggcatttttacagtcacatttatacccacttttaatcatgtgataattaaggggtaggttgttcagaaatagctagaaaatgggtggtgttgccccaacttccaggtgttgctatggcaggggcaggaatttccaggtgttgccatggcaagcgctgtgacttctggatgtttctatggcaatggtaaactctcatggcactggtgggtatgtcttatggagaggtcctttcagaaccctgttcctgttttggccagcctcacatctggtcctgagcagagtcctgcctacctcttgcctcaaaagtaacaagaaatctgtaatgaaaatttacccagacagaaaactccaattttatatttggtagttagtgacatggtacttatcaaagttacacaaagattcaagtgaataaaaaatactctcagaattattataggaggtcataatgtcctgtagtccaaaaattaatatgcacataacaaaacaaagaaattaaaggctgatatccattgtgaatataaaaataaatatcttaagaaaaaaagaaaaatgcaatcccactgtatatctgcacatttagtgaacacacattgtaaaaagtgttacagtttttataaaaactcttgataggtaattttaatttctgaaaaatgtatatgaactataaggtatgttggatctcttcccctaacttaaaaaatatttcttcacatttaaattctttaccaatttttaatgactttttattgcttagaattttagttgatataaataagaaatgtgtattaaaagcctaccattttgatttaacctatgaaatatatttaaattcttggaaaaatccaaaaatacctagaaaagtgagctcttgccagaagatacacagttctttagtgtcaggctgagattatctcccagaaataacttttggctcatatagcttccaggacactgcaagaataaaagatgtgaagacaatgttacttaattggatttgcaattattcactattcactgttaaccaattttattgaaaaaaaagattccaatcaaatacactgattttaagtgtactgttgggtttaataaataaatacattcttggaagcaaaatcaatacacacaacatttctgtaactccaaaaagttttgtcctgctcttcagcaatcaacttgcttccacctcacagaacagaccatccttattcagcttattgttagtatagattccactatctttttaagaatttcacataaaggaatatagcacatgttcttttgtggctggtgactttcgtgcagcataattgtttcctaggctcattcatgtcgccttgtgtcctcgtgatgtgttactctttacttttgagtactatttaaatatgtagtaatttcacaatgtatcccatcacctgctgatgaccatgtgggttgtttccactttgggctattatggataaagctaccacgaatggcattatacaaggctttgcatgaatatttctttatttcttttaggcaaatacctaggagtgcagttactgggtcttacagtaagtgtttaatactctgtcatactgttttccaaagtggttataccattttacatctcagcccagaattgatgagagttctcaatgtttcagctacttgtttttaagactttttcttaatcatcactcaacagtgaccagaatggctaatgatcattaagtcatgttttccttacaatttccttgacttttgtgggtgcttgacttgtatcaggatattgaaaacaggatcaatattgtcttaaccccttttaaacactttttctaagtaatgatatttaggatgataacaggagatctaaagggaatgttgggagtagtaacaggcattatccaatatttattatcatactccttaagacaatacattttgagtgaaatagcattcagctagactagggataaaaaggttctaatctcagctttagcattaaatattaggaaacctctgagaaaacaatccaggaagacaaatcagagggtgttttgctagtggagaagtgctgcaacacctaaaacctattaatgccagatttttgcagtgatttccactcataaagttgggttgactcctagccttgttctcctatgtgtctgtgtgactttatgctgaggggatgtgacatcacagagggagaagtgcacttgtgtacagaaacatggcttaggagattggctttggatgtggctgcaatgaaatatatattttgaagaagtcccctatgaaatgtcttatacattgtttcttatggcagggtgctcgggctcacacctgtaatctcagcactttgagagaccaaggaggaaggatcacgtaaggccaagaatttgataccagcctgggcaacatagggaaaccacatgtgtacacacacacacacacacacacacaatttgtgaacagtggcatcacgaagtgattatttatgaacaattggctaagaaaattacaaaataaagcaatgtcttctgagctaacaatactataataaagatgtcaattatttaactgtagaaaatacagagaacataaaattgtctatcttaaccatatttaaaagtgcagtgcagtggcattaagcatattcacatgttctgctattattaccgatactgtctccagaattcttttcgtcttataaaaactaatatctataccccttaaacaatactccccccgtttcctctatccttatccctagcaacctccattccagttctgcctctatgtcagtgacatctttgaagcaggttcactgtacactggttaccaacgtacctgagcgcgaggaacacaacacccccacacagcaagttacatgaagggggtttattattacagataagcagcaagggatcacaaaactcttggactcattatggatctgtcccccaaggcatacgaaagttatgtggagctgatagagtcgactgtgtgtaccccgcttgcatcacagctcaggaatccggaaaagcagacactctgggttttatatcctggggtaatgagacgcacagggctaacgtgcttaaggacattccattctatgagaaactggaatacagcacaggtaggctgttctggccagttcctctctatctcaggatgttacaattccagcacattctacaattattcttgagaactcttaaaataatcaagaaagtggagagaactaagtcagcccagggtcattggagaactgtcttgcagttaccccaccacctagacatcccccttagtaaagctagcatatttcctacacccaccaatgtcccccaaactgaaggcagaggtttatcttttcagattgacgaagcaccttgatttacacaatctcagtgcagattattaagccatagtgagagtacatttcgctggtctaaggaaggctactaccactggcaggagggataagacccccaaaagcagtgacctagtctaggatcccatgatcaagaaattaagatgccaaagaggtgaaagggggatctttcagatgccccattgtctgcagccattgagcctgcatcaggatcacctctacttatatttctaggatacctgaggtgtttatccaggtacagaaggcagtgttgggtgttggtaattacatggaacatccgttatgttccacgagaatgtgcccattgtcacgctgattgggcagtgaggttgtttcttggtcagagtgaagtctcatggagtatccaaaatatgacataaattcctctcaagggtggccatggtagcccgagcatctaatagagtgacatatatttagcagtccaggaagcaagctattgccatagtccttttctccacacaggggatcctttagtagttcagtcactcagttgctgttttcctgaccagatgactgggttgttgaaagtggcccatgatttaatggaaatggagcaaaatatagtgttaggggcagcctgcatggctgctatcattgtatgtagtttggcccattgggcagaatggccatgtttagtgtcaatcaaaagatgccatcccctggctggatggtggccacacccagtggacccactggcatgtgttttgtacaatcatcagggccccatgccatattgacataggcatgtctttgaatctttgactctatgtggccaaaggagaagctgaattgtcccctgtgggtcatttgttcccttcttgcaagcttgtcatttgtttatggggcacatgggtattgtggcatcctggttagggctgattcttactgtaacatttccatttagtaatttggatctgttgggcctgtccagttttattgattgtgtttgtaggcaccaaagtgagaatctgtagttaaggtagcagtgtcactcctggtcctctagctctgagatactcaggccctatcagtttcctacagcaagtaaggagttgccattcaaaagaggcacaaatggtggctgcttcaggaaacatttgcctccaaaatctaagtctggtgcacccagtgacaattttacattgccacagactccagtcagcatgcctagaaatagtggacacctggatttacatcgagcaagcaggctctaaaggtcttaaagaaatgccttggacatgtattgttgaatagattcgaaggctaccgttgcaaagggctccattcaaagttgtcaaatttgttcatgcttttgactaaggtgaccaaaaaaaaaaaaaaaaaaaaaaaaaaagactcagggggacagtgcagctaggtaagaatccagtggctttcccgagcttatttgtcttgcatttttggtgacatggattgttgttcatatcggcttcctctggcaggtccacctggaaagcattatatttagcaagaataaaggaggctgtgaatgatgtcactgcggactgcgtatattccctgttgcaaatgtcaaatccatgaagcaaaaagggatttactagaggttattaaattccttacaaattgttgaaaagccttaaaaaacaggctccagtcaaagcctctagaacaattccaagaatcgtactgctggcacaggtcgggggagcatctcctgcgcctgagactccacattcaagctgtctcttgcagcagaagagagagcagctcttctcactactgcccccagaaggacagcagctctggtatcaactatcaactgctagaaatctgacccctttctctgactgcccatcagatgtgttactacagagtcgttttggattgagatgagggaggggaaatgcctgatctcactcaaatgtgctcattttcctggtctgagtcacagccaggcagcacagtcctgtgggcacaatatcttcacttgccaggttcctataaaatgggagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttaggtccaaatgattcagtgataaaactaaagagaaaaaataaatacacttttcaacgttgaagctgaccaggtgtctgtctctggtgtttacccctccacatcccacgatgtgtttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaagtcaattatgtttgctcttgctttatatgggctagatctatggccccagcacacatctgaacgccctgtgttgacaacttatccagtattgtattgagtctgaatggtcacatgcttatcatatcatttcttccaatttcatgcaataattgtcatgtcaactgtttggattaagaaccatcagccagaaaaccacagccctgagaaaatagaaatagagtatttcaagctgttcagtgggcatagcaatgatgagtctacagctcattttcaatatataaatattctgtttatgagagtaacagtgtttcagagcctccaccacatctgacagcataacaatgcaatagcacaagagtttgtgtgccagcgttgcttgactaataatgggtttttctttgtctatagggtaagctgcacctgtgcacatgacaagatcatgagctacactttgcttcactttttttgaggtcaataaactgcttgatccaaagccatattatggaagaaattcctgactctgatgaaaacacttggaaaatcctcaaataatattttatgcagaaacataaccgaaaaagaaggcaaattcatatattgcaaataaccagtgccttcctcatgttgcatgaggtccactagaatcacctgacaccagctgttagtctgagccctgatgtgtggtacaatgttaagggttcaagaggcatcagttttcttggcaaattaggtgttcagaagagccaatagccctgtacatctcagttagttgaaactcacattactgagtccccacagggaccttattaacattggttcatgaggctacctggggaagctgggaaaggtgattgactgaagtccatgtgttgaatcatcctgattattaaaagcccctgcttgttaatggcatttcacttaatattcacttggaaagcattttttttattatggctcatttttgaaatgtctggtcatagcttttgcagaatgactttgtctgaaatcagcctgttgcatttattttaagacttgatgatctgtcaaaaccaacagccaatatttattaaactgctgttatcttgcaatgggatcatcagatgtaaccattgcagtttacccacggttaggatttttacatttccagtgcttctttgacaatgacactaatgtgactctatccagcgtgcattgttgtgagaactctatttggcctatcatcattgtgggcatgaacataatggagactttcataggatgcaatggttaatattcaacattagtcaaaatttgctctagtcctaccctcggagctctactgggttggaaaaatattttaggtaaggacaaccatttggtaaagttttaaaaataaaggctacaaataaattttctgtagcaagagtattgcatacataatagaataaatgtgcttaaatatgaatactatatatatttgtagccaacattttatcaaacaaatatatattcacttctatgtatcttatatatatgcacatttttccataaataaggtaaattttaattttttattgaaatactagttttaattctgttcttaattttctcttaataacttcataaattgatcactaaatattcacatttataccaccaatttaagaaaaaaatacatatgtttatatacacgtagaggtgtaaataccgtatcaggaagcctttatgcataatgattggttactggttaaatacacaactcagtgacagaaaacagtaaacatttgttttcgtgttcatggatgctcacgttcacaatcctctggctgaccaaggaagggctctgatgagtcgttcctctgcagggcactgagctcaccttcagcctacagatatgaattgtctgaggacaaggctgaacagcagtgactacacatgacacaagattcttgtggcaggtcacaggagtgaacaacatcccaaatcaaactgcacagttgaatttaagtccaataatttctaacatagcttcacacattttaaatatattcctttatttcagtgagtacacattttcaagaaaatgtttactccatttaattatagaagggtttgatcattccatgaacaaataattatgttttcaaactttacaatcctgaaaatatttgcaaatgtaaatttgcattaataagaaaataaagctggatgtgtttccaacatgtggcttcaaatataatttatttaaatggactcattggggtaaaaatcattttaacttatgtaaatatccctttttgctgtgcttgtgtcctatagagttgcccaataagagttcctcccgtgagatttggaaatcagaaaaggaagactcaatattatccattggtaactaagacaggtacaaggacagaggtgaggactggagaaacacctggaaggatgttgcaggaagctaagagcatcagcacgcctacccctaagcttccagacaggactgaggaccacatggttagaaagcccttactttaggggcggatgcattctgttttctgagggagaaccagagaatcctgcctctaatatcaactttcctgactactgtatccttgtctttgaaaggctgtagtctgaacgttaatcataggcattggttcattcttgttatacccaacagagccaagaaacctagtggggaaaggcactcagggtgcaaaatattgctgctggaatgcaattgaaataggccctgttatcccatggaactaaggtttatggttttttgaataaacttagaaattgtctccccctccctgtcttaaaactcaagatagttacatctgtcttacctgagtcctttttttcagtaaaccaaccatcaggcctcccagatactattaagaagctgaaacttacatatcactgaattgggacagtgagacatcagaaccttcacccactgtgattgcataactgacctcctgcttcttcttgaccaaattatcttccttacccctccctaattcctgttttcaacatttcttccctcctatataaacccctaattaattttgtcagagagatacaattgagaatggcgtcccatctcctcggctgcagcacctgattaaagcctgttccttggcaatacttgttgtcttcgagattggctttctgtgtggtgagctgcaggatctacaccaagtccctggtatttcagtaagaaaattctctgcaaccttcagtgctttggcttattgtaacctgaaatcaaatttatccacaatttctgagataacttgatataactctaggattcactttgtccaccactgtttaccagtctgagcttgccagctcccaacccttcctagtgccaatgaactttctcaaagtgcaataggtaatatttccctttttcatggaacactgactttttctttgttcttccaacgtactgaagaccactgagttttcctgtatgcctcatttggcaaatatttctcttcaaataaaacattaaatttagagattcatctctacattttatttagacttcagcagtttattctaattctctgtattaagactattcctgcttagaatatctatagtggcttcttctgcattatgatttccaactgaagccataaactagactcctcaggtgtcatgatctctgtttttattaaataaggagaagcattgctatgtctgtgcagttggtgctgagaaagagaaaagaattagggtgcagaggtgacttcatgtccccatctaccaacaccatcagagtgtggctgcatctgaggaacactctcagctgatggaggcatcaggagaagctgctggggcagcccagcctcacacatctgcttccctgggggtttatgtttgggtgtgtaacactgtgggagggtaactattatactgttggcagtaataagttgcaaaatcttcaggctgcaggctgctgatggtgagagtgaaatctgtcccagatccactgccgctgaactttgatgggaccccactttgcaaactggatgcagcatagatcagggacttaggggctttccctggtttctgctgaaaccaggctaaataattgctaatgccctgactcgcccgacaagtgatggtgactctgtctcctacagatgcagacagtgaggatggagactgggtcatctggatgtcacatctggcacctgagattggaaacataaaaacaaatgtccacacaattaatcatgttgtaagagaatttccctgaatagtaaagcagtactgagcaccctgggctgagtaaactgctagtgttctccatccttacctgggaaacagagcagcaggagccccaggagctgagcgaggactctcatgtccatgctgtgtcctgactgggtctgattcctgcacaaagtctgaccagcctattaataaggcttcagggcaggaggttgtgctctgggaacatgcaaatgagcaggggatggggcaggctgggcacagctgcagagctggcgcatctcagtaactcagcaccagctcagtgtccccacgtgtcccaggtaagatcaaggtagctcaaatttgtctgcagagaatgtgtttctactggggactattttgttatgggaaacattttatggtttctttttgacaatttgaaatattccttgggagtcgatggagcaatgtatttcattggtgtatggggattatttaggagaatattcttttttgtaggaaacacatagtaaaattttagaccctacaattttcaggtcttcaaaagactctcatgtgatttctgttagggaaggtggtacttatcatatacttgcaacatttctgtgagtttaacattgctcctttctaaaaaaaaattaaaaataaaatttattcacatgatgctacatatatttgtaaatgttaggtaatggtgttatgccattgttcttaccactgtaagatcaagcaatttacttcagatacactaagttgataccgtgtttcctcaatgcatgcagcaattacagatccaccattatcaagagctctaggtctctttaatatccagagactaaatgggctgcaccttattcctgttttgcaccttattcctgttttgggcaccttcatagtctaccttcttttctgccattaagtattatttcccaacattcatctctcttagtgagggtgatcactgcatggagcatgtccctgccatgcaccataggtgacactttcttcttttactttttatcagggacatcatcctgacccagacaccaagatccctgttaacatcttttggaaagaggcactcaatcttttatcaagcaactgcccaggtacatggagaaatcagttggttccagatgaaactggacagggatttgcactcgttatatctcatatctctaatgtgcccaaaaatgtcccggcctggttccgtgggaggggaagtggatccaactacatcagcatcagtgggctgcagcctaggactccataaaattttactgatgcctgactaggagagccaaatcacagtgctgtagcctctgcacaaaccttcctgctgctttataagctgcctgaattttaagggaaattgcttatattggaagaaaggaagaaagctccatttgtcctctaaatgtttgctgaaaataaactgacaaaaggaagattaataagagaaaaggcaaacaaaattcacttaaagtgcagcaggatatcatagcaaggtgattacccagataactcaatgagatccaggtgtttatgtttcctttctagggaagaggtaattgggaaatgtaggcaacctggagagaatagatgagaatagaaatgcatcctcaaaagaacaggtaatcacctccctaggtaaagtatcaactttgagtctcttccatttttgattcctcttttgtgttaatcttccttgatataaaaattctcaggaagagttttcttaaaaattggtttccttctgaagaatttgcttttaggcaggtaggggatatttaggaaaagccccctgtgcatttcctgctttctaaatgcctttggttttatataatcatcatacaaatgcagcacagtttgagatgttattttctggattcctttacttgcaacccacctgccaagatcctgttccagagagatgtggctacagactgaaagagcagttgtcccctcaacaacgtggaggttggggcactgaccactggtgcagatgaaaacctgtgtagaacttttgcatctccaagttatgtagtaatagattacttttgactggaagccttaatgataaaataaatagttgattaacccttttttatgttatacatattatatactctattcttccaataaagtatgctaaagaaaaaatgttattgagaaaaccttaaaaatgagaaaatatatttagtacttattaagcgcttgctcacaggtgacacacagaagaaaatataagtggatctgcaaatttcaaacccaagttattcaagggttaactgtaccatgatgaatgtagcagtccccatctatagtctagggcttttccctttgctgtatctctgctcatttccaatggctatatatatgtcttatgtgcttcatgatcttgggcagagaggtctgcttgcatgccttgctggccagatggcctgcaatgtgtatctcttaggaaagtgctatggtttgactgtgtcctccagaatccatcgttgtaaagttaaatctcagtgaaatggtattgccaggtggggcctattgagatgtgttagatcatgagggtggagccctctagtggaataccttaatgccactataaacagggtttatggggctggaatctctctgtctcttctgctggtctgtcatgttaagacatggccttcgttcctttgaaggactgaaagctccaggcgtcatcttgaaagcagagaaagacgaccttaacctgcccatgccttgatcttaaatttcccattctccagaaatgtgagaaaataaatttctgttctttatgaattacacagtggcaaggaacctaacctgttatagcagcttgaaagagaacaagagagacagctcacaatcagtgaggacagaatgaggtgtatacataccttagcttcctcgtctctcaggtggaatagcccagaggaatttagtccatgtttccacatgtggttgatcttcagttatcctgagtcaggtgggttgttgatgtgtcttttaccattcatcttctgttccctccctcactttcttcctttcctcccagtgtaaatttgctgcctaaacaggaatcctcattgctggtggacccaaactaagatagtaaataaaatcattaatcttttgtatgaggggtatttctcatctgaattcttttatcatttccctttctttgacatgtaggaatattcaggaaacacacaattttttttttaaccaatctattttagattgaatttatgcggtgattttttgtgtgtgtgtgttaaaacaaaaaattacgttgtaagccactaaccagctgaacggactcctcttttggtagagagaacttcaaagaaatctgaaaaactaggttaggccatgactggcaggtgggtttagatgtacctcattatatggtccttcctttggagttcagacacaactgaccagcattatcattacaacagagatctttggattgacaaaacagatgctttgtagcaataagataccatactccaacacgacagataataggccctgaagaaaatcaaaatattttaccctaaaagtatttctttgacatattctgaagtggccctgcaagctgcctgttgtgggggaaatttgcattctgcagagaatctcctccccttactaagtcttttccaaagagtctgacattttttttaaggtctgataaacaacattagccacctactttgtttgctacccataggattcatctaggtgacaagaacctttgcttccacacccccttttctaaactcaagcatttctttatgatgaattcaagtgtttaggcagagcttaactctttcaaccagttggcagtcaggaaatctttgaatccacctatgacctggaagcccctacttcaagctatcccacctttccaggacaaactaatgtaaatcttatatgtattgatttatgtctttccctgtaatttctgtctctccaaagtatttaaatgtgtattcttgtcaccctgggcacatgtttgcaggacatcctaaggctgtgtcacaggccataagctttgggaaaataaacctataaattgattgagacccgtctcagatactgttttgtttatactggtcacaaacttaaaaatcctctaaaacaatctacacatcaataaatctacattagagacagtggaatgatcataccttaacagttaaagctcacaatttaaaggaacctgagtctaagattttggccagctctcttgcttcataaaaaatacttcgtgatttttaaaattttactttagagaaaggcaatttgggggaatatatttattgtcaatgggatgaataatgtctctaccctaaaagatgtccatgtcctcatctctggaacccaagtgttacaggagttattaagaaattattttaggcagataggaaaagagtgtccttggtaaggttttctttcctttaaagcagctccagaaacgtttcttgtctagcaggaaagccctggctcttagagccaggctgggaagctttgatttgcaaattccggccattagaaactgagtccagccaaacctgtcaattcccaccatcttcttccttgcccccacatgtgcctgacaacaaggctgcccccacatatccccatgtgtagagaatattttggcaccctgcatttgcatattaaaagtcttgttgggaaggccagttattttgcaggcttcatgaatggcatgcctggtcaaaccagtccctagagccctatataaatcagacaccacctcctccagcctcctcatataagagccacttttctgctgcaatggagttttgtctttgttggaatccctcctccctctgtctctgtgtgggggagctgttttcttcttccttccttcttgcatattaaacctttctctccctaaaaccactccacgtgtgtctgtgttgttttatccaaagtggtgtgagaccaagaaccctggtgttcctccagtcaacggagccgtatcataaaaattctaccttacatagcaaaaagagaacttgacagatataagtgaagaataagcgacccagttatctagatgaaaccaatatgatcacaaaggtccttaaaataaaagaggaggcttgcagtcagagaggagctgggacaatggagagggatgtggtttgaagagggaacgggttactctgctacaaaaaaaaatatgaccacgggggtactttgcttaaaaaatatcccagaatgtcctgctatacttagagagcatttgcttcccaaatagaaaatgaaggcctccttcatttcacaccagtttctgctacatgcactgtatcgctctgttgcttggtgtctacgcacttagaactgctctgtcttctttccgaaatgactttcttcattatgtaatgtacatttctgtcactggtaacattcttggctttgtagtctactttatctgatattagtatttgctactgattcattttattaattttgcatactatgccattttcttttcttttatattgagtctacttctagtgtcatatttgatgtgagtgtcttatagacagtatactgttcggacattcctttttgattcatcaattgctgtctgttataatttactaatttgcatatttaatatatcgataattattgatatactaagatttaagtctttgctctacttttttgctgtatctttttttgcttctccgttttctttttgctgccttcctttgggttacttgaacatttttagaatttcattttaattttacctaatttgagggtatctctttttatagtgatttttaaattggttgtcatggtatttcctttatatccatagcttctcacagtatgttggtgtcataatattaccatttaaaataaatataaaattttaccttgttttatgtcatttttcttcccccattagtaatagattgtgcacatatactcatgtacccttcacaccatctctagcctacttataatacctgacgcgatatgtatacatgacttaacctgtgtggattcaaccaagtggtactaagcacatggtgaagtcaagtttttctttttggaactttgtggattttttttctatatatttttgatccaggtttagttgaatccatggatgcagatcccatggatagagagatgactatactgctccttataactctgaggatcaactctgtggttcctccattctgggctggctgaactgatctctgctgagcctgctcatgtgtctgcagttaccctgtggttcagttgtgactagatggtctgatatgacttgtttaacctatctggaagctgatttgatgtgcaggttggacaacatttggtttcggtttacataggtcagggagatggggcctgttccccaacctctattcagttcgtttctagatcaactcaggagttcgtctattcattgtaggttgtttgggggaaattccacacagaacattggtaatgaagaagctgaactgctgtcatcagttattgttatcatctgaaatgcatcatatattaccaaagtctccccagggtggcccaacagtgcagctcagctcaccccatccagtcacttccctggttgcctgcaggtgtgagaaaggcaatgtgctcagtcacaggaaagacaggggccctccctggtgctgaaacctgcagatagttttcacacagtttcattccaaaatacaaagacttcattttctttgtctttaaaatagttatacattttctttctataatgtccccatgcttttcaactaatttgaattttcagaactggaagtatttattatttctgtgttagatgctcttagtcacttatggcaagagtgagttaatagagacaggatatggattagccatagaacaatacagaagtgtgtggattcagataggataaagatcaaagcggtgacaaatacattcttttgaagcggattctcataggtcaccagtcaatgtccgcattcaaggtgcgatgatgtgtcagctacattgtgcaaatggtcagctctgcagagtaaacttggacagcacactacaggaccaaaattacctgtaaaggtatggggaaaataaaccatcatagaaaaaatagtgtgaaggagttctcggttatttatacttggatatcaagcagaacactataatcaatgaagctataacctaaaaactttaagacttttaaagaggtttcccttttctcagggtatttctcaggaaaaaatttataaattatggataaactacttgcacaattagctacaataaatcccttccctgcactcatcctttggttggcctcattctaaatggactcaggtgttacccatgtgtcttgctcaggccaataggataatagcagatgtgacagaattggaatattggaaagggcttgcacatcgaagctttcctctctttcacagtgcttggaaaccctaaggtcacaatgagaataagcctgtgcccatctccattcaatgtcagtggcatggctgctcttaggtctattatttgttcttaaaatgtgtgttcagtttgttataaacatgtaagaaattacctgcaaatttatcaacttaagactacacccatttataatctctcaatttctgagtcagcagtcagcacatggctttgctggatcctgcccattggatttcacaagactgtgccacagtgtagactgttcttcattctcacctgagactccctgagaagagagatattttagagctctttcaggtagttgcagagcccatgccttagcacctctgtgactcagggcttcagcttcttactggctcttggctcaaggctgctctcaggtcccagaggctgtggacaattccctgccatgtgatgctcacacaggcaatgcccacatggctggttgtttgttcaaggccagcagaaggtttcagagagtgtctctttccagtctgctatgacagaggcttacagaatacaatacaatcattggaaagacatctcataacctctgccataccatatgggttagaagcaagcctaagttctacctgttctctgtggaggtagatcacacaatgccatgactcactggagacaggtttctgctagggtgttctggcatctttagtttcctcaaatatcagggtactcgtactgagtgtgaaatctctcctacatctacttcatcgtgctgtgtctgactgatcagacatttgacacatgacttttttttttttttgtgacggagtctcactctgtcgctgaggctggagtgcaatggcatcatgtcggcccactgcaacctctgtctcctgggttcaagcaattctcctgcctcagcctcccgagcagctgggattacaggcacccaccaccatgccaggctagtttttatatttttagtagagacggggtttcaccatgttggccaggctggtctcaaactcctgacctccggtgatccacccatctcggcgccccaagatgggattatagggatgagctaccatgcctagcctactttagtttttaagtagatttaatgaaatctatttagtagccaaaagccaagaatgccaatagttttacctggctactctctgaaacaatggtattaaaaagggtctttccagcccctttccagcagaaagacaggtgctaagaaacagtggaagtgtgaaggtgggggaagggagagaaacagtttttatatacctaaactaacccagctgcatgtaaaccagtaactactcatcaaaataaaatacagaaagcatattagttttggtttggtgtgaaccagccttaaatacaaagttgttacactgaatgggtttaattgaccaaaatgcgtagggaaggcagaaaggattaggatgcccttctactcagctttatctgctgtcaagtctggttcctcaggggacacatggatcccctccattgtcctgcagattctgccaggccaaggctgttaaatctggcggggtctcatgtgtggacttctgggtgtatacagggagaaactagagaaaggccgagcagatttttactgcatgtaggtaatctacgtgggcttttagagaaaaaaggctttagataaaaagtgtttgacaaagtcacacatggtttgtaaaaaaacaaaaaataaaatacaacttgaaaactcttggagaagtgacactttagtttcccaaatcactcttcttcatacacttccacttagctttttttcaccttctagctctgtggtcttagaaggacatgcacttaaaataatttgtttccataggaatccaacaagtaaaagcataaacaacatcaaataaactacatcattagcatagaagcatgtcaaagaaactgagattagattttgagttttggcacaagtattagagaaatagagaaaagatttaaaagatagaataagacttacacaagaaagcaggacagcaatacgacaattgaacctatcatagaataataggttgtgataatggatggtgagaagaaatgcattggacagacatgcatgggcatgattgatttgagcaatttagcatggatcaagacaaaatctttaggatttaaagggctgtgagctgggtagtaaaaagccccattttagcacctcttggggctgtagatggaaagaacttggatttaaaactattttcaataagtgtctgctaagtgctaagtattatagctataaggatacctaaattaatagaagcacatattatctgttggatatattctaaatcttttaccttgtttaaattgtaaaccgacctatgaggtagaacctattattgtcacagcattgcgggtatagaaaaggaggcaaaggggggttaagttactttactaatgtcacacaacatgtaagcggtaaagctccatccccaaccccaagggtttgacttcagggcctgccaagacaacatctggactgttgcatggatcttgcctggctgtacatgaagctctaattccaggatggatgaagattccattagaacttggagtagcattaataaaattgcttccttgagaccaggcgaagtgtccagaaagcaaaggagtttaactgcttaaaggaaaggtgcagatttgtaggaaatgaagctctggactgtgaacagagtttttcaaaacaattaaggagaagagaaattgagtctagtttgatagatgtgttgtgcagagtgagtgtagtggagattagagaatcagccaaggaattatcccctgccttcatggatggcatcaacatctgtcttcatggcaattgtattggcagcctgagtgtcagagcctgggtcctgcccatccatgcagctgtggtcacctttgcacctgcagtgctggagttacttgagtgttactctttgaggtagcttcaggacacttggtaaaaatcactaagtggcaagtgaaaggcttggaagaaaagttctaatcagctcttcattcccacctgatgcaatttttgctgctgctgggaccccaagttctttgtctcctccccgccgcttttttttttttttttttttttttgagacagagttttgcttttgtttcccaggctggagtacagtggtgtgatctcggctcactgcaacctctgcctcctgggttcaagtgattctcctgcctcagcctcccaagtagctgggattacaagtgtgtacccccacgcctggctaattttgtatttttagtagagatggggtttcaccatgttggtcaggctgatttcaaactcctgacttcaggtgatccacccaccttggcctcccaaagtactgagattataggtgtgagccatcgcgcctgaccccttgcctcttttgtaaatagaaatcaacaccaggccaaacagaaattgtctcaggcaaggtttaataggtttgtggcaagagcaaagcaagggagcagcctatgggtaagagatcctggtggctattccttgaagtgcccagctcttaccattttaaggaagctgaggcggaaaaaggaatgacatacaagcatggttaggcaaagttttctttgcatttgtgcagtggagcgtcatgctctaacatatataacatggtgaggaaatggaggataagccctgccttgggtggatattttagtattacaatgagattataatgaggaaaaatcagtgaaaggtcagttctggggaccatcccaccttcagctggctagatctcatttggtgctttggggaaatgccagctctatcagcaaccttggaagatggtcaggttcttatcaggaatgttagagttccactttagaaaccttgggaggctgggcacagtggctcacgcctataatcccagcactttgggaggctgaggagggcagatcactggaggtcagcagtttgagaccagcctggccaacatggtgaaacgctgtctctactaaaagtacaaaacatagccgggcatggtggtgtgcacctgtagtcctagctactctggaggttgaggcaggagaatcgcttgaacctggaaggcataggttgcagtgagtgtagatcgtgccactgcactgcatcctgagtgacagagtgagactctatctgaagaaaaaaaaaaaatgaaatcttgagatactcaggccctatcattttcctacagcaagcgaggagttgccattcaaaagaggcacaactggtggccacttcaggaaacttttgcatccaaaagctgagtctggtgcacctagtgacattgccacagactccagtcagcatgcatagaaatagtggatacctggatttccatcgagcaagcaggctctaaaggtcttaaataaatgccttggacatgtatagttgtatagattccaaggctaccgttgcaaagggctccattcaaagttggcaactttgttcatgattttgactaaggtgaccaaaaaaaaaaaaaaaaaaaaaagactcagggggacagtgcaactaggtgagaacccagtggctttcctgagcttatttgtcttgcatttttgttgacatggattgttgttcacattgtcttcctctggcaggtccacctggaaagcattatatatttagcaagaaaaaaggaggctgtgaatgatgtcactgcggactgcgtatattccctgttgcaaatgtcagatccatgaagcataaagtgattaactagaagatattaaattccttacaaattgttgaaaagccttaaagaacaggctccagtcaaagcctctagaacaattccaagaatcatactgctggcacaggctggggaggagctcctactgcttgagacattcaagctgtcttttgcagcagaaaagagaccagctcttctcactactgcccccaggaggacagcagctctgctatcaactctcaactgctggaaatctgacccctttctctgactgcccatcagatgtgtcactacagagtcgttttggattgagatgagggaggggaaatgtctgatttcactcaaatgtgctcattttcctggtctgggtctcagccaggcagcacagtcctgtgggcacaatatcttcacttgccaggttcctataaaatgagagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttagatccaaatgattcagtgataaaagtaaagagaaaaaataaatacacttttcaacgttgaagctgaccaggtgtctgcctctggtgtttacccctccacatcccactatgcatttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaaatcagttatttttgctcttgctttatatgggctagatctatggccccagcacacatctgaatgccctgtgttgacaacttatccagtattgtattaagtctaaatggtgacatgcttatcatatcatttcttccaatttcttggaataattgtcatgtcaattctttgcattaagaaccatcagccagaaaaccacagccctgagaaaatagaaatagagtatttcaagctgttcagttggcacaagaatgatgaatctgcagctcattttcaagatataaatattctgtttatggaagtaacagcaccattcatgattagtgtttcagagcctccaccacttctgacagcatagcaattcaatagcacaagggtttgtgtgacagctttgcttgactaataatgggtttttccctgtctatagggaaagctgcacctgtgcacatgacaagagcatgagctacattttgcttcactttttttgaggcaaataagttgcttgatccaaagccatattatggaagaacttcctgactctgatgaaaactccttgaaaatccacaaataatattttatgcagaaacataaccgaaaaggaaggcaaatccatatatagtaaaataaccactgccatcctcatgttccatgaggtccactagaatcacctgataccagtaattagtctgagccctgatgtgtggtacaatgttaagggttctggaggggtcagttttcttggcaaattgggtgttcagaagagccagtagccctgtacatctcagttagttgaaagtcatattattgagtctccacagggacctccataacactggttcgtgaggctagctgggaaagctggaagaggtaactgaagtccatatgttgaatcatcctcattattaaaagccccctggtcgttaatggcatttcaattaatattcacttggaaagcttcttattcttgattatggctcatttttgaaacttctagtcatagctcttacagaatgactttgtctgaaatcatcctgttgcatttcttttaaggcctgatgatctgtcaaaaccaacagccaatattattaaactgctgttctctttgcaacgtgatcatcagatgtaggccttgcagtttacccactgttatgagttttacatttccagggcttccttgacaatggcactgatgtgactccatccagcatccattgttgtgagaactctatttggaatatcatcattgtgggcatgaacataatggagacttttataggatgcaatggttaatattcaacattattcaaaatttgctctagccttacccttggagctctactggattggaaaaatattttaggtaaggacaaccatttggtaaagttttaaaaataaaggctacaaataaattttctgtagcaagagtatgaattaggtgtcatcacaaataccattttttttgtgtggaatgtaacaattatttaaatgtatataatttagataatattttataaataaaatatgtatatattgcatatataatagaataaatgtacttaaatatgaatactgtacgtagttgtagccaacattttatcaaataaatatatattcacttctatgtatcttaaatatatatgcacttttttccataaagaaggtaaattttaattttttattgaaatactaattagttttaattttgtgtttttctcttaataacttcataatttgattactaaatattcatatttataccaccaattcaagaaaaaatatgtatgtttatataggtagaggtgtaaatactgtatcaggaagtgtttatgcattaattacggtaactggttaaatgtacaactcagtggctgataacagtaaacatttgttttcatgttcatagatgctcatgttcacaatcatctggctgatcaaggaaggtctctgctgagtggctcctctcagcagagaggagcctgtagattgtattcagcctgtagatatcagttgtttaacgacaaggctgaacagcagtgactacacatgacacaagattcttgtggcaggtcacagtagtgatcaacatcccaaaccaaaccgcacagttgaatttaagtccaataatttctaacatagcttcaaacatttaaaatatattcctttatttcaatgagtataagtttttaagaaaatgtttactccacttaattgtagaggtgtttgatcattccatagacaaataatcatgttttcaaccttcacaatcctgaaaatatttgcaaatgtaagtttgcattaataagaaaacaaagctggatgtgttttcaacatgtggcttcaaatataatttttttaaatgacctttttgggggaaaatcattttaacttatggaaatatccctctttacctctcatgtcctatagggttgcccaataagagggtcccccatgagatttggaagtgagaaaaggaagactcagtattatccattggtacctaagaggcagagagacaaaggtgaggactggagaaacacctggaaagatgctctaggaagcgagaacttcagcaattccagacttaaacttccagacaggactgaggaccacatgggtagaaaacccttacttcaggggtggatacattctgttttcagtgggagcaccaaagaatgctgcttctaatatcaactttcctgaatactatatccttggttttgaaaggttgtagtgtgaatgttaatcataggaattgggtcattcttgtcataccaaacagagccatgaaaccagaggggaaaggcactcagggtgaaaaatattgtttctagaatgcaattgaaataggccctattatgccatggaactaatgtttatggttttttgaataaacatagaaattgacttccccgatcttaaaactcaagatagttacatctgtcttacctgagttcttttttcagtaaaccaaccatcaggcctcccagatactatcaaggagctgaaacttacatatcactgaatcaggacagtgggacatcagacccttcactcattatgactgcataactgacctcctgcttcttgttgaccaaattatctcccttaaccctccataattcctgttttcccacatttcttccgtgctatataaacccctaatttttgttggtcagggagatacatttgagaatggtgtcccatctcctcagctacagcacctgattaaagccttttccttggcaatacttgccttagtgattggctttctgtgtggtgagctgcaggatctacgctgaatccctggtatttcagtaacaaaacactctgcaaccttcactgctttggcttcttgtaacctgaaatcaaatttgtccacaacttctgagataacttgatataattctaggattcactttgtccaccactgcttcccagtctgagcttgccagctcccaacccttcctagtgccaatgaactttctcaaagagccataggtaatattttccctttttcatgaaacactaactttttctttgttcttgccacatattgaagaccactgagttttcctgtatgccccatttgggaaatatttctgtgtaaataaaacattacatttagagattcatctctacattttatttagacgtcagtagtttactttaattctctgtattaagacaattcctgcctagaatatctatagtggcttcttctctgttatataaagtccaactgaagccataaactagactcctcaggtgtcatgatctctgtctgtattaaattaggagaggcattgctatgtctgtgtagttggggctgagaaagagaaaagaattagggtgcagaggtgacttcatgtccccttctaccaacaccatcagagtgtggctgcatctgaggaacaatctcagctgatggaggcatcaggaggagcagctggggcagcccagcctcacacatctgcttccctgggggtttatgttcgggtgtgtaacactgtgggagggtaactattatgctgtagacagtaataagttgcaaaatcttcaggctgcaggctgctgattgtgagagtgaattctgtcccagatccactgccgctgaaccttgatgggaccccactttgcaaactggatgcagcatagatcaggcgcttaggggctttccctggtttctgctgataccagcctaaatcatttctaatgccctgacttgcccggcaagtgatggtgactctgtctcctacagatgcagacagggaggatggagactgggtcatctggatgtcacacctggcacctgagattggaaacataaaaacaaatgtccacacaattaatcatgttgtaagagaatttccctgaacagtaaagcagtactgagcactctgggctgagtaaactgctagtgttctccatccttacctgggaaccagagcagcaggagccccaggagctgagcggggaccctcatgtccatgctgtgtcctgagtgggactgattcctgcatgaagtgtgtccagcctattaataaggcttcagggcaggaggctgtgctctgggaacatgcaaatgagcaggggatggggcaggctgggcgcagctgcagggctggctcatctcagtaactcagcagcagctcagtgtccccaggtgtcccaggtaagatcagggtagcacagatttgtctgcagagaatgggtttctactggagactattttgttacgagagacattttttagattttttttgacaatttgaaatattcctcaggagtcggtggagtatcatatttcattggcgtatggggagtatataggaggatattctttttttgtaggaaacacatagtaaagttttagacgatagaattctaaggtctttaaaagactattgtataattccggttagggaagggggtatttattgtatacttgcaacttttctgtaagtttatcattgttcctttctaaaaaaaattaaaaataaaatatattgacatgatgatgcatatatttgtaagtatatgcagctagagagaaaaaacagatcacctacaaagggaagccatcagactaacagaagacctctcagcagaagagattgggggcctatatttaacattcttaaagaaaataaattccaactaagaatttcatatttggacaaactaagcttcggaagcaaaggagaaataagatccttttcagacaagcaaatgctcaggaaatttgttaccaccagacctgcctaacacaagcttctggaagaagcactaaatatggaaatgaaacaccgttatcagccactataaaaacacactgaagtacacagaccagtgacattataaagcaaccacacaaacaagttggcaaaataacaggctaacagcatgatggtggtatcaaatctaacatatcaatattaaccttgaatgtcaacaggctaaacgccccacttaaaagacacagggtggcaagctggataaagaagcaagaccaaatgttatgctgccttaaggagacccatctcacatgcaatgaagcccatggactcatataaagggatggagaaaaatctaccaagcaaatggaaaacagaaaaaaaccaggattttaattctaattcagatgaaacagactttaagtcaacaaaaatcaaaaagacaaagaagggcattacataacagtaaagggttcaattcaccaagaagatctagttactctaaatctatatgctgccagctcaagatcacctagattcataaagaaagttcttagacactttgaaggagacttagattcccacacaataatagtgggagatttcaacaccccactgacagtattatacagattataatctgtataattaattttctgaggcagaaaattaacaaaggtattcaggacttggactcaaccctggatcaaatggaccttatataaatctgcagaactcttcaccccaaaacaacagaatatacatattctcatcaccacatggcacatatgctaaaattgaccacacaatcggacatacatcaatattcagcaagtgcaaaagaaccaaaatcatgccaacctctctcggaccacagcaaaatgaatgtagaattcaagactaagaaaatcactcaaaaccatggaaattaaacaacatgctcctgaatgacttgggtaaataatgaagttaaggcagaaatcaaaacgttctttgaaatgaatgagaacaaagatacaatataccagaatctctgggacacaggttaggcagtgttaagagggaaatttatagcactaaatgcccacatcagaaagttatacctcagattaacagcctaatatcacaactaaaagaactagagaagcaagggaaaaccaattccaaatctagcagaaaacaagaaataaccaaaatcagagttgaactgaagtagataagacacacaaaaaaattcaaaagatcaatgaagccagtgcctgtttttattttgaaaaagctaatgagataaatagaccactagctagactaataaagaagaaaagggtgagtatccaaatacataaaattagaagtgacaaaaggacattatcactgaccccacagaaatacaactaaccatcagagactactatgaacacctctatgcacaataactagaaaatctagaagaaatagataaattcctggatgcatacaccctcccaagactgaaccagaaagaaattgagtccctgaagtgagcaaaaatgagcttgtaattgaatcagtaataaatagcctaccaaccaaaaaaatcccaggtccaaatggattcacaactgaattaattccgcggatccttctatagtgtcacctaaatgtcgacggccag

SEQ ID NO: 7 - DNA, 312376 bp, Artificial Sequence
  Description of Artificial Sequence: Synthetic polynucleotide
  human Igl region from yeast artificial chromosome
taatgtggtgactagactagcctagtgggattcccattaggctcatcatactgtgattgaacagtgctggtctgcacctcttcaggttaacaggggctgtggagtgacctggtgcaggaaatatcatctccatccataggatatcagtgtgaacccagggagaggcactggtgcaagagagatgagaacaggggtgtggagtaggggactgagccttcactttgagccgaagaagtttcctttcctatcctcaatcctgaacaagagggatttctggacttctttttgttttcaagtttgtgccccttcagatttggggctgtctggaatcctgccaggggacaccgagaaaaaataggagtctcacactgactgttgtatttcatctgctggggccatcccaaaccactgcgtacaatttcctttcctggtgctcaaatagctgctccacgcacttgttgtggtttcagagatgaatctgggtgggaagacaggacagtgtatgttataatatttaaatggaacccaaatccattaatatttattttaatatggaacattaaaagagttttgtaataggcaatgggaaaaggtaaaaaagataaaagctttttgagaaaaaaaacaaaaacaaacttatagaatgtctatgtgtcttcagtgttgcagggttgagagagatcagctttatggtgccccatggatgtgctgagatggggaaaatcaagaaagaaggaagtatgtaccactgtgactcaacaaataaatcaaagtaaaatggacttaaatctttcaataagtcattcacaataaatatcactctggtgcacacagaaatgcctgttagcaaactttcccttccccctggccatgtctccatggatcacctgtgtgcagagtggctccggtcagtgctctgtgttccctccacagggctccccacaacatgtgccctgtgtggatgtgggtgcatcgcctggggtggctgatgtgctccagggattcgatgctgcagatgcctcagcaccaagggtgggggtgggaatgggacaaggctgcagctggggagaccaaggatcaaccacacacagcaggggtttccacggggtgagcagcctcatttcctgacagtagagcgagcctaaaggtaggtgccaggcagtggtatctgtggggtggcccaggcctggagggtcacagagacacaggcaccacacagcagagacactgagggccaggagctcactcaggtgagggacttcagcagatctttctctcctggtacaaagagatcaagttcctaccatcagaatagacaaacaaggactttaatctcctcagctgagccccactgtccagggaagaagtctctgagcccaggcccaggtgagagtgggatgaggagaggagccaggacacagattttcatggatgccccgccctcctctgaggcagagcggataagacagggctgggggcatacccagtgcttgagtctcaggaggcagcgctctcgggacgtctccaccatggcctgggctctgctcctcctcaccctcctcactcagggcacaggtgatgcctccaggaaaggggcctcagggacctctgggctgattcttagtctcctgctcctcaggctcacctgggcccagcactgactcactagagtgtgttttttcctttttccgggctctcgggctcagtctgccctgactcagcctcactcagtacccgggtctcctggacagtcggtcaccatctcctgcactggaaccagcagtgacgttgggcattataactatgtctcctggtgccagcagcacccaggcacatgatttatgaagtcagttataggctctctggagtctctgatcacttctctggctcccagctctggcaacatggcctccatgaccatctctgggctccaggctgaggacgaggctgattattactgcagttcatatacaagcagcaacattttccacagtggacataagattgattctcaggctccaagtctggccagtgagcttctttgagactccctgggatcccagcagtgacactgatcactattgctgtcccacacatcccaagtgatgaggaagtaagaccaaaaccctcctgagattcctgacttgtgtcctgacaccagggctgttgggattcctgtctttccttcaagattgttcaaataagcagtgacagtcacttccatgtgagatatgagaagaagaataattccatatgaaccaaatccacgaagcctacactgaagcctgccaagttctctgcagtccagcgcgatgaagggagcattttcgtgggaacttttgggaatatgaggggagccaggctcagctatgggttccagagacaaagctcctggatgtttctccccggccttggtccatcacctgctacctctcctcactctttccacagacactgccccaggctaagcccccacaggaccctaagcctattcctgaccctgagctcagcccaggtgatgcttcaggagatgggatcctgagaatgagccccaacatctctttaacctaaggtgtggggtcatgagacacctgttagccataagacacctgtcccccacctgctcaggagacagtggagcaggcaacagtgcagagagaaccagcaggagccaggccaggccctgcatccaaagcaggccccagtccccacagattctccagctctagcctgtggtacagcccccactttctgcaggctgaaatgggcttctcaggatgggcaggccatgatgggggatggcagtgtgtccacaggacacagccctgctgcctgcctgaccctcatgccccctccttccccaccctggttaatctccaccagaaagggcccaggttcagaactcaggacacctggatcagctcctggacttgcccccactgctctctgttctcctgagccacttagtctcttttggcctcagtgttacctgctgtgaagtgaggaggcttatactgaactgaggaagctcttttcttcattcaaaattaaaagacagaaaaacaatgaaagtcatgtaaattaaagcctgctgaggggatgtcatttaatgggcttcagtgggtttcagacgtggaacttcttgtcttttctctgcagggattccaagacaggggctcaaaagagcttgctttctgtatggtgggaacagcggtccctagctgagaataagcaggagattcccagcttcatcaggaaggcagactaggctagtgtagaaatcctctccgtacaaactctgagaggtgttgaataaaataaagataaacataatttcatgttttcatggtgccgatgatggtgatgttagctcacaactaagctgcagtgcctggaacatcaggaaatcacagtgaatcacagctgctcttattgggtgggaggtgcaccagtttgatgcctaagtacatagaaagcctgggtccctgtaggatggcacatgcatctctctggactttgaaagctttgcagaagagcttcagttgactcactctaattagtccggactgaacaaaaccactagaggagggcatttcaaccctgagacacttctatagccccaacttcctaccctgcgtgtgcgaactctctgtgctgggctgggcagggcagattgggtcaccctgcacagaatggggctggactgtctggtcctcaacttctgaggtgacaggtgctgtggaggcacgtggaagaaaaaagctcctgggctgagtctcctccaccagctgggggcagcagagctgcagccaggagcagtcaggattaaggctggggctgcccagctggggcaaagagaaggccagcctggcgttcaacaggtgtccaagaatcagtcttcagactgaaagtgagtgcagttcatcctatcccctcaggctgcagtgaccattctctgagggtcagactcatacagtgtcaccccaggacactgacagaagcccggcacagtgaaggcctcacctgggaaatgcagctggaggaggctgggaccaggtgtcaactggggcagcttactcaggaaggggatttctttggagacatcccaaggttgaggtgctctaggagggggcacagcgtgaggtgacggggctcccagggcccgggttcttcacccaggatggctgtctgagcctcctgccactctcagggccttgtccctctcagtccagcagcaacctggggagctgagccctctgtcctgggcacttccagatacaccatacctcacttccttctgcctcaccttccagctccaggcggactctgactcagggggaaactcctgtgctcaggggagtctcgggtgggtggggtgaagcatttgggatcctgatcccttcatggggcatccccagcatccttaaggagacactcttcagagggacagggcttctcacctgcctcagctctgaccatggggctgtccacactcagtgacaggacactgaccagggatctgactggagtgaccaggaacctggctggggcaaccagggaccacccaccctctggagctcacatgctgtgcagagaccatgaccctgggaccccttcagagaccatggggcctgaagttagattttcagtccagtgtggttttctcctgctttttgcaagtttacataaaacattgatgagaaaaacatacataaataacagacgagctgagggtgccaattgctaatctcttgtggcaatgaggggtgatgtagcaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctgggccacctgctgctgagtcaggtgtcagcaagatctctccgcagagcccagctcagcccatggccaacctcctggaaggtccacagctctgctgagcctggcccaggacagaccccaggtcagcgaggtttgggacagtggtcatgagattaattcccagaaaggtgactgtgatcacagggcttgaaggctgcagctgattttctaatctgagaccctgcttcttcctcctgttgcctgtgctgccctcacagctggtttgagtgacatctctccaggaggaatcgcagaggatgtaaatttgcataaacgccaaacactgactgcccccaaaagctggagagggaataagagaggcctggggagcccagctgtgctgtaggctcaggaggcagagctctgaatgtctcaccatggcctggatccctctcctgctccccctcctcattctctgcacaggtgctgcccctaggctcagtctccacagaccccaagttgagcctgacctgaatcctgagcaaagccctgccactgcctctgggggggattcctggcaatgcgtcctttgtcctcaagccccctctcctgtcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctcacagtgacacaggcagatggagaaatgagacacaaaccccttgccatctgtgtcaccttcttcctccagccccaggaggactgtggacaaagccacgaacaggtctggcccagtacacccagatcagagactctgaggcctccttccttccagatctctacggaggccctacagaaggtggatcaataataaattcggggttggcaggtccagtaggtcctggtgttttctgggctggagtgtgacttggggaaaaatgacttgaatggaagtacagtcagtgggagacatctattgagtggtgatggtcccagtatttccttgtgtggtgactgaacctagggcagtgccactactctgtggcccaaatgccctgggttattcctctgagttccccgtgtattattgagatgctccagcccccactctcatggtatcctgatctgaagaatcatggccagtgcccattgcagtgtctccatctaggtgccattttcaggactcatgcatccagcatccaaacaaggctgtgtgggagaccgtgacttgtcacagctgttccccactggaaaatgccactgagctgcagagaactgctctcccagtgatgttcccccttcacagtgtggttcaggtgcaatgcctgcctggtccctagattttaatgccatgttttcatttaaaataaccacgaagtgtctcttgctgagcgctccggtgtaacacattcccagtcatgcctctcacaattttctttctgacaaaatttcctgaaaccctattgcaatgaattctccctctcagagtaggattgcagggagttcacaaattaacaaacaaaccaaatactgtctagaagaaagaggatcaaagaggagagagctgcacagggagcgcactctggagtctgcagatattcatgagcaccgatgagcatgtgcatgggaggaaaccttctgtgatagagaaaataaccattcaaagacatttgaggaaacactccatagagctcacacacacatccatgtgcacacacatgcacaatcagaatagtgcctgttcctccgctccatgaagaaaggcccgagttaaagtgggtgagatttaccagtgagaagagctttgcctcagtactggggaaaacattgccctagacaaaaggcatctctggtgttaactaagaaagtgtacggcccctgtgctgatgcccatgtcaaagaccatcacacgtattttaaccaactagcccagagttgtcaccaagagtttgatcttacaataattctgcaatgaacatccctattcagactccttggagttcacctatgaagattaccatagaataaatctctagaagttgaattgttaggtcaaaaagaagtacgtttgtaattttcactgattattctcagattcctattcacgggggggttgtaccaatttacagtgccagccataaatctttgacgtgagtatgctgttgaaagtttgggtttttgccaacatggtagattaaaattttgttgtcttgtaacagtgttattttggatttctcctattctgcttgaggttgaacattttctcaaacatttcagggctcttatattttaggatttagtgagcttttttctaaaatggccaggtaaggagggttttagcccctgtgggccaagagtcaactttgaccatattatgagggaacttataactccagttacaatgtaaccatttaaagctataaaaaccactctcagctctgggaccacacaaaacaggtggcaggccaggggtggccacaggatgtggtttaatggtccctgttttgtagggtcatttgaagtttaaaaatttcaccagcatatattttaggtggagatctttttgtgggtaatactgtatttcaccgcctatagtggcctgagatttctctctagataagaacacacttttcttattttttggatggattttgggtctatctgtgatagccctgtgtcataaactcataacttttgtgtccgtccttttactgtgatttttgggagtgtgacagtatatcaggaatacactatccagggtggaaaatcagagagagggggaggagcaagtgggcaaggaagcttgtaccaaagctggaatatccactgcagcaggctcagagaaaagggtcctaatatcagcatttgactgaagccaaaaccacaagagaccatagaggttctgaggatgacaaataaaaacatagtttaagttttaatgcattcattatttttataatccacaaaaattctaaaactcagaatttaacaatgggataaggaaaagagtttgagatgttaaacgataaagaccccaaggaaagttgccaggaaaagaacaggacctttttggtggaactatgtttatgctgtaaattaccctcttctatatgtctatatatatatttaggtataagagaacatctcatggaacacccttcttcaccacagtcaaagatcaccctcacccaaggagggaaccgaaagggaacgtcaatatgagacagaaaacataatgcacttttgtataaacattaggagagtctctatttgcatatcaaatgtggatgcttaatgttaacattggaaatagtaggttaatatgcatgtgaggtgagttttcttttgactatttctgtctgtgatttatctttcttaatagggacatttctgcccttagaacaacttaacttgtgatattttttgttctattatctgtatcagctctgttttttttttttcaaacagtggcaaagatatcccatgactaatgattaataaattcaattaatgggtatttaaattatttcaagagtggacagttgtgacttccccacatctaactcacagatgtcgctgatgctgactcactcttctcttccaatcatagcaaataaagtgggagctttgacttttctgaagacccagatgacaacaggagagaggaggtgaaaccccctaaagctgttatcctttaaaccctcaggaggaatcatcctggagaaacacccacacttgagttggattatacctaaatgagagtttggtcttagagttggtgctgagttagttcaggatttgggttgttgggatggagtgaatgcgctttacaagtgaaaaatacatgagtttttgggtccataggttggagagttcttggctgaattgtgtcccccagagttcatacaatgaagctctaatgcacggtgtgtgactgaatttggagagaatctttaaagaggtgattcagtgaaaatgaagtcatgagggtgggttcttatcgaatctgactggtgttctcgtgagaagagaaaatttgcacacacaaaaatgagacactcgagatgagcgtgcagaggaaagaccgtgtgaggactcagcaaggaggtagcgacccgcaagccaaggagagaggcctcagtgaaaaccaaacctataaacactttcatcttgactccccagcttcagaactgtgagaaaataagtgtctgctctttaggccagcaggtctttggtatctcattaaggtagcactagcaaatgaaaacaaaagggaccccaaagaccttggatgcgggaggaggaggagatggagcagggtgcaggaggtggggcagggaggggctggaagttcaggctctgaggtcatctcctgggtggaatcctgactccactcactgctgtctggggacttggggaaaaacaattaaccgcccaatattaattccatagtaaagatcgggccttgagcacaggattcctcatcttccttttttatatgatgaaagtcttcttgaggtcatgcttgtaaaacactcagcaatgtatctggcatacactatggtctcagaagtggttattatgaattttctagtgatatgtagaggatgacattggtcctgtgggcagagggggcactgtggaccttggtttgaggactctgaaagacaccaagtccgctggtagtgctcaagagcgaagagcatcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgaggagtagatttgcattcactgctcatcagagagcccacccaacaaggatacaagaataaaagaagtagatttgcatgaagagcctctccttcccatgataagagaggcctgaaggtccctccccagccatgggctcagagacagagctatgtggcatctccaccgtggcctggacccctcccttgctcaccctcctccgtctctgtgctgcctcccagggctcagcccccaaaggaccagagatcagactggccctgagcttcagctcagcacagggagtgatgcagagtgtggggctctgggaatgaccctcatcctcataattaactctcctgtcctctcttgtaggctctgtggcctcctccatgctgactcaggagccagtagggtctgtggccctgggacagtcagccagggtaacctgccagggagaaaacctaagaagccatggtacaaactggcaccagcagaagccaggctaggctcctgtgcaggtcatacatcgacaaaataaccagccctcagggctcccagaccaattctctggctccaagtcaggaacacagccaccctgaccatcactggggctcaggttgaacatgaagctgactattaccatcactcatgggacagcagtgctactcacctcacaatgacacagacagattgggaagtgagatctaaagaccttcactgtctgtgtcaccctcttcctccagccatagcaggactgtggagacagccatgagcagggctggcctgggtcacctgcatcgaagtcctccaagctgcccttccccccagctctccaggtagtctctgcagagaatgagtcaggataggatttggggctggcagaaccaggctgtcctgctgttatttggaatggatgtaccttggctcaagatgacctgagccatcttactggaaggacttactggaaggacggtaagagggagacagctcctgagtgctcatggtcactgaatttcctcctgtgtgttgactgaacccaatgcagtgcctctactctgtggcccaaataccctggattatttttctgaactgcccgtgtttaactgagaccctcaagccccagctttgtgcatcctgatgttctgaacatggaagcctttcacagtgtgcactgtgacatccctcagattcccgtttcaggacttatgcacccaccatcctcccagggctgcagggaggccctggcttctcacagctctccccaccagaaactgccatgcagtacagagaatagctttgctcaaagaattgcccatttcagagtatgtttcgggggcaatgactccctgatgccttaatctgaaagtcatgctttaatttaagaccctgaatatcaaattgaagtgccttctagctgaacactcaattgtaaaacattcccagtcacacactccacacttctttcctgagaatatatcctgaaaccctattgcatggaatcctccctctcagagtaggattccagggaacttaaaaattaaaaaaaaaaacaacacaccagtctagagggaaaaatattgaagaggagagagttagggagttgcacaaggaaagaactctgaagtctgcaaatatgcatgcactgaagagcacttgtgtgtaaagaaactccctctgaaagagaaagacccttgagggaacactccaaagagtgtgcatgcgtgcgcacacacacacacacacacacacactccagtcacagaggaaaggcctgagttacagagcatgaggtggactcatcagaagagcttcggctcagtattggggaaaatgtcggacagacatagggctactccactgtcaactaagaaagtgtagaagcaaactgggaaaagttaagacagtttccaagtaactttactgaatccaaaaataaaagaccaaaatagagaagaaaatgcaaaaggattataaactcaacaaagaaaaattcacaatgattggcattctgtcaatatttcttgcaagcaaaaaagaaaatatatgctttaacacagagaaaaatgaatcaatccaaagtggccaaaaattgcacacatgatagaccttgtaggcacgaattttggagcaattctttttttttttttttttttttttgatggagtctcactctgttgccaggctggagtacagtggcgcgatctcagctcactgcaacctccgccacccgagttcaagcgattctcctgcctcagcctcctgagtggctggaactacaggcatgtgccaccacacccagctattttttttttttaatttttagtagagacggggtttcaccgtattggccaggatggtctcgatctcttgacctcatgatccacccgccttggcctctcaaagtggtgagattacgggcgtgagccaccgcgccagccttggagcaattcttataactcttttctccttcctcatgagaatggaggatctattgaatgtgttaagtggagaaatggaaagcataaagcaagatgcaagttaaacttttagaaatggcccctaaatatctgcattgaaaaaatacactggatgagactcattgcagattagaagctgtgaaggaatagatgagtgaacttgaagatatggcaatggaagttatgcaagatgaagcacaaaaaaagtgaagagagcatcagtgagtttcaggacatcttcaagctgacttactggttataattaaagacatgaagggagataacattggtggggggagaggaaaggtagaaaagccatttaaaggaatcatggccacaatttcccaaatttggtgaaagctagaaacccactactccaaaaagcttaacaagtcacatacacacacacacacacaaacacacacacacaaataacacaccaccaacactcaccataatgaaattgctaaaaacctattataaagacatacttttaaaagtagccataaagacatggtatgtacagatgaacaacatcataaaaagaacagatttctttttctttttaaaattttcttaaacatctgtgggtacagagtaggtgtatatgtttgtgggatacatgagatattttgatacaggcattgccatgtgaaatagtcacatcatggagagttgggtttccatcccctcaagcatttatcctttgtgttacaaactactcaattacactatttcaggtattttaaattgtacaattaagttgctgacatgttatcaaatagtattgatgtaactctgacatgctatcaaatagtaggtcttattcattctttctattttatttacccattaagcatcccctaataagagcagatttcttcttagaagtcatgcaagcaggaggcagtggagctatatttataaaatattaaaagaaaaaacttactaccaaaacccatccacagactcaatgcaatccctatcaaaatacaaacgacattcacagtagtagaaaaaaactctatagttggtatggaaccacaaaatcccctgaatagccaaagcaataccaagcaaaaagcccaggctgaatatgtcacattatctgaatcaaaatatactacaaactacagtaaccaaaacaagatcgatggtattggcttaaaatcagacactgagactaatataatggaatagaataccccaaaataaattcatatatttacagccaactgatttgcagcaaaaatgccaaaaacatacgttgagaaaatgacatacttttcaataaatggcgctgagaaaaactggatattcataggcagaaccttgaaactagacttttatctctctccctatacaataatcaactcaaaatttattaaaactccgaaatataagacccaaaactataaaactactagaagggaacgtagagaacacaggggaagttcttcaggacgttggtctagacaaaaattccatagctaagacttcaaaagcacagggaacaacacgaactagacatatgggacttcattaaactgaaaatcttctgaaaagcaaaggaaacgatcaacagagtgaagacaacttctagaatgagagaaaatatttgcaaactattcaactcaaaagggcctaagatccagcataagaaaataagacaaggagctgaaataactcatcagcataaaaaacaaataatacaattaaaaagtggataaatgatatgaatagacttttcacagtcaaagacatacaaatggccaacaggtatatgacaaaatgctcaatatcactaatcatcaggggtacgcaaatccaaacctccatgagatatcatctcatcccagttggatggctatcatcaagaagacaaaaaaataacaaacactggtgaggatgtagagaaaatagaagacaaaaccacatggtcatctcaacagtcacatcaaatgttttcatgcgaggaaacattaccatttgttgtttttctagtcttgctagagcatcataaaaagataagatttgtggtgccactattggagaaaatgttattacatgcaaagactctggctatcccacaccaaactacatgaacacttactgttaaatgctaaaagaggccaggcacggtagctcacactcgtaatcccagcactttgggagaccgaggcaggcggatcacaaggtcaagagatccagaccatcctggtgaaaccccatctctacaaaaatacaaaaattacttgtatttttgcacggtggcacacacctgtagtcccagctactcgggaggctgaggcaggagaattgcttgaacccgggaggtggaggttgcagtgagccaagatcacgccactgtactccagcctggcgacagagtgagactcaggcaaaaaaaaaaaaaaaaacctaaaagattacaattctgcatttccaaatgttctggtggtcagagaccacttccttgacaagtggtgagtacggggatctgatgggataggtggcatttaggcaggtattgggtgaagaatagtgatatacacaagaaactttcaaagagaaaaacacacggaagttggaacacagaagagaacataatatgtctgagaaataaggaaagtccagactcactggagctgagtgagaacaagaaaaatggcataagccatgtatttctctctggatatctcatcaaaatattgtctcctccccaacacaccacccatgtgaattataaaaatgcccgtttttaatttttgtttgcatgtcgtgacagagtcaagcacgtgaatcaagctgagtttgatgagtccagggctgttaagctccagacccaggtggcctcagaaggacttggtggaacaagggcttgttgtcaaaagcagaggaagtgagattttccattgtggcttagaccagagattcttaaattccagtggacacacaaggccccttaaggatctggttaagatgcagatgcagcctcagcagttctggatgtggccccaaattctctgtgtccggcaactcccaggtgaggctgctgctgctggtcctcccaggaccacactttgagtggctgaactcttattcacccacctcactcaagccacgggtgagactcacacaaggagggcaccttctagaagcacaggtcacttctcactcctccccttgtgtcttagatcctttcctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggcgagccagtgtgtgctgaggtcaatgaggggaaggaagcaagagagaaagggaagataccagtctcatttaaataagcagctcttctggaaacagaggaaattcactcaccccaagtgagggcattaatctattcatgagagatccactcctatcaccctaaaagctcccattaattcccacccccaacactggggattcaatttcagcataagatttgcaagggatgaagatcaaagccatagcaccctgaggcttggccacacacttgctcatctccacatttgtcccttccttcaggaccgggatcctgactgctctgactcagtctccgtctacctcatggacacctggcagtcggtcatcatcggttttgctgaatcagcagcaacattgggggtaacaattgtgtctcctggttccaccagagacagagtagagacccacacagctgaagtgtggggtcaaatattaaaactaagagacataagattgattctcaggctccaagtctgacaagtgagcttctttgagactccctgggatcccagcagtgacactgatcactgttgctgttccacacatcccaagtgatgaggaagtaagaccaaaaccctcctgagattcctgacttgtgtcctgacaccaggtctgttcttccctcccctagaataaaacatctcttaagcacaaggctgaagaaatgtggcctcctcctttctcccacagctggtcaaagtggatacctgagagaattggctcactgaggcctcttgggaacaaaggctgggttcctgcctgtgatctgtgtactgagacacattccggacctgcccaggaaaggcaagtatagatgatgtttagttgtcacagagtccaagtagggacaattcagcggtgtcttcttgggacccctgcctctggctattttcatctactttataatgggccagggccattatttccaacttgtcatatcctttttctcctttcctcaccaggtaaggaggtggaggacagttgatgagggctggcttatgagttaccccaggatgcaaatgactttgaagtcaagcccatgtggggtcaagctcagtctataaccagggtcttttgagctctggaggagccaggcatcccagccatcaaagaggtcttgcatttgctaataaatcctcttcttccaacccacagcttatcttggctgcctaccctcatctctgtcaggaagcaatccttcgttgtttaacaccaaattattcttacttggtcagtttaaaagtcccttcctcagaaaggtcatctgtggcctgaagacaaagtgagaaggctttgctgcattttcatttggaaccttacattgccccttctgcaatgttctaaccacacatggcacatatttacaggacagcgtgataattcacttttgaaaatacagaatgtgctcatggaacaggacaatgtcatacttttggggcctgatgagcatgtccttttcacaggaccccccagagctgcccatgcatccagaaggtaccattctactctatgcaaaacgatggggcatttctatattgcagtttcttagggttccttagaaagaggccacccccaacacagagctgcacaccttgtgaccacttactgtcaattcctcaatgctgtctccaagtctcaccatgcacaagggaggaacacagagaccctggattcctagagacttgcatttcttggatgaacaaatctggggtttggttggtggcagagagctcagggctcatgtgtgagcatcacctgatgcttcctccagggtcagagtccagcccctaccctggaaggatgaaagatattgtccacagaagtggtataaaggtaacagcatcgaggacggagctgcctcttgaaatgggctattgctttgcacaacgctggagacctaaattatgttgactataatggaagagtagtccctgcggatggcctctaattgggtggaagaaagcagagggtctgcgtctgagagagcagcaatgggcagattcagcacaggcatgggcagagcagcaatcaagggtacctgagcagcaatggccccgggagaggcctggcacctgccggaagtgacgttggagacagagaaacatctaagacttaaggcttctctttctgtgcaatcccccaccccacagtttatgtgtcacagatattggcacctccttactgtaaggggtcatatgaataatacagtcctcaggggcatgggttcgaggggcagccaggtttatcctcgaagcccacttctgttacctgcagctgtgtggctgtaagcaaggcatttaatctctcagaaaaccatcctaatgagaggttaagaacctctgagaaaaaaacttagacaagaattgacagtaattcttcactattgaggctgcagggatgtaacttaatcatgtttgtaaagtgcataacacagaccctgacatgccccagctgctcctgagttggcagcaattattcctgacatcactcatgagaattggacctggaatggggatggagggaaggcagtgcagagggtttcagagggttaggaaaagagagactttaatgatttaaaatgaaggcctaggagtggagacaagcgtcctgggacattctcctgccaactctcacaatgtctcagagactgttccaaggtgaagtctactagagagctaagggaggagtttgcagaatcaaggtttgcaatgtcatgcatgagggggcagagagtcagcgggagggaagacagctgagctcatctgaagggtatttatggttttctggccctagagtccttggccatccctctatgaccagggcctcagataagcagagagcttatctgcttctctcctccaacgatagttcctggttatcctgagcccaggtcagtgcagctgtggcccattctctcctctttgtgctcagtggactgacctggaggaaacagtaggaggttcccctgctctctgtccccagggtcctttcctttcagtggcaccagcccagccctagtgtccatccatctgtgcctgcccagtcaggcctccatgctgccccctgtaatggccacaggtcaaaaactgattgtcagtcttgagcagattgtcctgactctttctgcaaaactgagcctctcacccagcaccaggacgtcacaagcaaggccagctgtaggaaggcaagtaggggagtaacgtgcatcacagagtctggacaagacaaagtagttctgctgggacacatcctggtgatgtttctcaggatggttcaggtccctgcaattgcaggcccagagaacaggactgaaggctggaagatgtgctccctttctcctgtacacaaaacagtgccatgtgtgcatgtgagtaaatgcatatgcctgtgtgcttgtgtgtgtgcacctgtgtaaatgcatatgcctgtatgtgagagagtgtgtgtgtaaatgcatatgatgtgtgtgagtgtgtgcatgtgtgtaaatgcatatgcctgtgtgtgtgcatgtgtgtaaatgcatatgctgtgtatgagtgtgtgtgcatgtgtgtaaacgcatatgcctgtgtgtgtgcatgtgcatgtgtgtaaatgcatacactgtgtgtgagtgtgtgtgcatgtgtgtaaatgcatatgcctgtgtgctggtgtgtgtgcatgtgtgtaaatccatatgcctgtgtgtgagtgtgtgtgcctgtgtgtaaatgcatatactgtgtgttggtgtgtgcatgtgtgtaaatgcatatgcctgtgtgtgtgtgtatgcatgcgtgtaaatgcatatgactgcgtgtgagtgtgtgtgcatgtgtgcaaatacatatgcctgtgtgctggtgagtatgcatgtgtgtaaatgcatatgcctgtgtgtgcatgtgtgtaaatgcatataccttgtgtgtgtgcacatgtgtaaatgcatatgcctgtgtgtgagagagtgtgtgtaaatgtgtgtgctgtgtgagtgtgtgcatgtgtgtaaatgcatatgcctgtgtgctggtgtgtgcacatgtgtgtaaatgcatatgctgtgtgctggtgtgtgtccatgtgtgtaaatgcatatgcctgtgtgtgagtgtgtgcatgtatgtaaatgcatatgctgtgtgtgtgtgtgcatgtgtgtaatgtatatgcctgtgtgtgtgcatgtgtttaaatgcatatgctatgtgtgtgtgcatgtgtgtgtgagtgtgtgtgcacgtgcatgtgtgtgtgcatgtgtgtaaatgcatatgctgtgtgactgtgtgtgcatgtgtgtaatgcatatacctgtgtgtgagtgcatgtgcatgtgtgcacatgtgcatgttagtgttgccagggagtgcttcaagtatcgaatgtcccaaattcacaacttttctattttcctcacttacctcctccctgacacatgcttctcagttaagtgagttcatatgcgcaaggcctacaaacaggcaaggcatgggccatagtcagtgctgagtcagtgtcatcaaatattgttatgcttatatagaaccttgtccagggtgggccaaatgtatgcccctgtcttgtcctgacagagcagcagaaagggagactgagacaaaacaatggccagggccctggcaacacggagacaccttcccactcctgtgagcttcacagacaaccctgggtatgggattcctgtcattcctttaagattgttcaaataaacagtgacaatcactctcatatgatatatgagaagaagaagaattccatataaaccaaacccatgacgcccacactgaagcctgccaagttctctccagtcgagcccaatggagggagcattttcatggggacttttgagagtatggagaagacctgaggaaaccaggctcagctgtgggctccagaggcaaagctctgggatgtctccccatggcctagacccttcgcctgccacctcttctcactctttgcacagatgcttcccccaggctaagcccccacaggaccctaatcctagtcctgaccctgagctcagcccaggtgatgcttcaggagatgggaccctgagaataagccctaaagtctcctcaacctgcaggctctgtagtctcttaaagactcaggtacctccagtagagttggccatgagacatctgtccctccaactgctcaggagcaggcaacagtgcagagagaaacagcagcccaggccaggccctacactcaaagcagcccccaatccccacagatcctccagcgctaacctggggtacaggccccacctctgcaggctgaggtgggctcctcagcatggctaggccatgacgggggatggcagtgtgtccatgggacacagccctgctgcctgcctggccctcatgccccgtccctccccaccctggttaagctctgccccaaagggcccaggttcataactcaggacacctggatcggctcttggacttgcccccactgttctctgttctcctgagccacttagtttcttttggccacagtgttacctgctgcgaagtgaggaggcttatactgaactgaagaagcacttttcttcattcaaaattaaaagatagaaaaacaatggaagtcatgcgaatggggggatgtcatttaatgggcttcagtgggcttcagacatggaatttcttgtctttcctctgcagagattccaagaaaaggactcgaaaagagcttgctttctatatggtgggaacagcagctgccagctaagaataagcaggagagtcccagtttcatcaggaaaacagactaggctagtatggaaatcctccctgcagaaactctgagaagtgtggaatgaaataaacataaacatgaaattaatctgccaacgatggtgatgttagctcacaactaagctgcagtgccagaaacatgcggtgattgcagtgaatcatagctgctcttactgggtgggaggtgcaccagtttgcttcctaagtgcatagaaagcctggcacgcacgtctctctggactttgaaagcttggcagaagagcttcagttgacttactctaattagtcctgacggaacaaaaccactagagtagggcatttcaaccctgagacacttctgtagcaattgctcctgccccacatccctgcactgcatgtgtgacctctctgtggtgggctgggcagggcagattgggccacactggcacagaatggggctggactctctggtcctcaacttctgaggtgacaggtgctgtggggtcacctggaaggaaaaagctcctgggctgagtctcctccaccagttgggggcagcagagctgcagccagcagcagtgaggagagaggctggggctgcccagccggggaaaagaggaaggcctgcctaaggttcaacaggtgtccaagaatcagtcttcagactgaaagtgaagacagttcatcctatcccctcaggctgcagtgaccacgctctgagggtcagactcatatagtgttactccaggacactgacagaagcctggcacagtgaaggcctcacctgggaaatgctgctggaggaggctgggcccaggtgtcagcttgggcagcttcctcaggaaggggattccctggaagaagtcccgaggtcaaggtgctctaggaggggcacagtgtgaggtgacggggttcccagggcctgggttcttcacccaggatggcggcctgagcctcctgccactctcagggccttgtcctgccctgtccagcagtgtcctggggagctgagccctctgtcgtgggcacttccagatacaccctgcctaccctccctctgcctttccttccagctccaggcagactctgactcaagggcagctcctgtgcttaggggagtctcaggtgggtggcgtgaagtatttggggccctggtccctgcatggggcatcaccagcctcattgaggagacactctccagagggatggggattctcacctgcctcaggccacagccctgaccccggacctgtccatgctcagtgacaggacaataaccaggaacctggctggagtaaccagggaccacccatcctctggagctcacatgctgtgcagagaccatgaccctgggaccctgggaccctgggaccctgggaccctggaaccgtgacagaatccatggggcctaaagttagattctcagtccactatggttttctgctgctttttgcaagtttacataaaacattgatgagaaaaacataaataaataacagacgagctgagggtgccaattgcttatctcttgtggcaatgagggaatggtatagaaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctggtccacctgctgctgagtcaggtgtcagcatgatctctcggcagggcccagctcagccccatggccaaactcctggaaggtccacagctctgctgagcctggcccaggacagaccccaggtcaacgaggtttgggacagtggtcatgaagtcaattcccaagaaggtgactgcgatcacagggcttcaaggctgcagctgattttctaaccagagatcctgcttcttcttcttcctcttgtcgcctgtgctgcccccacagctggtttgggtgacatctctccaagaggagtcccagaggaagtaaatttgcataaacaccaaacactgactaccctaaaaagcctgagagagaataagagaggcctggggagcctagctgtgctgtgggtccaggaggcagaactctgggtgtctcaccatggcctggatccctctacttctccccctcttcactctctgcacaggtgctgtccccaggccctgctccaggccctgctccagtcttattccccacagatcccaagttgagcctgccctgaatcccgagcaaagcccagacgcagcctctgggtgcgactcctgggaatgggtcctttgtcttcaagccccctctcttgttcttccttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcccacagtgacacaagcagacagggaagtgagacataaacccctccccctctatttcatcctcttcctcctgccccaggaggactgtggacaaagccatgagtaggcttggccaaattcacccaaatctgaacccccaggctgcccttccctccagccctccaggcaggcactgcagagtagtcagtctggagtggatttgtgcctggcaggccaggctgtcctgtgtttctttgcctggggtttgagttgtcgatggagggtctgactggaaagacagacacagggagacatccatgcaggcatgtccaaagggacatggggaactctcaggtctcagttgaatgcagtcattgttgtatcctctgggaaagcattcctctagtgcatctaagacctccagacccacagagcctgagatcaggaggagagaatgttaaatttttgctaatggaccactgaagacatttttgagtggagccactacaatttactccttgattctggactcatggatcctgactgtgggagaaacagcaccatctattgggcactgatgcacagaacatgccctatcctggaagacattgtccagccctacacatacttgccacttgcctggtgcagtaatggtgtctccaagcagtcattaaaccattcatataagccatatgtctcagaatgtttgggacaagagtaagaatcttgattgccagaagaaaaggcccatagccctttatttgcagtgaaatgaattccttggtcagaacctcctgtggaataccatcatgatgggtgcgtcattctgtaatccagagacaacagttttggcagaagcattgctgtcaatgaaagcaaatcctctgtagaataaatgtcaattctagtaagaaaaaagagctattcctgccatgatggaagagtgcaaacgaaattaatattaagcaggcccctggctgttttccacagagaaagtcatcctatagggatctctgtgttagtctctgctgttggcagatggtcactcagcagtggctacagccaggccagctccagttagtggaaatcgacattgatgagcccatggacagcctccatccctgccaccatgggcgcttttttttatggagcccactgggcattgacaagagtggttgagggaggctgcctgatgtccacagaacaagtcaccctactcacctgattagcaaaatcacttcattttcacagaagacttggtgagtattgacatatggaaaaaattctcttactttctgcccaccggaggaggtctattcacacatctctccccctgacgtatttgtgatcaatattctcattgtgtctctctcaagtccctgaacatccttgagcatctttcaagaccctgagtcacaacctgtgaattaggaacctctgcccatctcttggcaggtgacatgagccaattgcactgcttaaaattctactttaatgagaatgttcctccaacactgctgttcagggattctcagaggccaggtggagtactagcactgtccacaccagtagtggctgcatgtcctgcagaaaactctgtaaccccagcctaagtgcctcctcctaggcagctgatctcagggagcccctcaggacgtcaaggctgtagggtgagaggaagacatggtgcagggctccggtcatgtctatttggccaactcttcatgaaacttacttgggcctcgtgacctagtccctcaagtcacaaatacatccctgccatgtgattgaggagctgctggaaatggccaaccgggactgtggttcagaccaaacctagcatactggcaacttgggtcgcatggtgagctgtgtggccacaatcacacagagcctctgctgaggcccaggagcgttcgcagtctttctcaaatggagctttctgctcattcaaaaaaataagtagagggaggctgggaccccaggaccacttagaccacgcacatgatcttgtctgattattctgaatccttgcatgctcagctatgcattatggtaaccaagccacagtgtctttggcaataaaatgccactacttggcccccacctaacctgggatcccctcaaccacatcttgctacccaaaacaggtttcacctccactgagagaaatttatttttatattgagaagatgaaagattaattatttcaattgtgaaaattttataggacagtaatgtgaaaatattttaaaagacactttacgaagagtgaaagaccttccattaaaccactcaatatatgacactgtaattggcctacccaaaccctaagttcagctccgggttgggaccttctgggaatggacccttcatcctcacgccctcctctcctctcctctcctctcctctcctctcctctcctctcctctcctctcctctcctctcctctcctctcctctcctctcctcttctgtcagccctgtgcctcctatgtgcagagacagctggtctcagtgttggtggccctgggactgacaatcatgagcacatactctggagataaccttgagataaacatgcattaaggaaccagcagaatccaggccagtccatggtgctggtcatctagtataacagcaactgaccctcagggacatctgcccaattcttaggcttcaactcagggaacatggccaccatgaccattaatggagcccaagcccgggaagagactgactattgctgaactgcagataataacagtgggagcagctggcagggactcatagtaacacagagagacagggactagccacagaactgtcccatctcggcctggctctcattctcagctgccctgtgagcagctgaaggtcaggcctcagggtcaggcgtcctctctggtcttaacctggcccctgcagggctggtgattctgagcagcttctccatcctctcagggcctgcatgtgtccagtgagaagtgagtggacagggggaagctggttggagctgcaggaacctctgtcaggtttgtggtgtacatgaaaggtttaggaatccacacaacatcacatggccccagatgtaatcacacatcacacaggggaggaaagagctgtcgcagagggtacagtcctgtggaatttctcttttccttgggtataagcagcttagtggaagctccagaggctgtgtctcctctggtttccagatgagttcagttgacctccgcattctaaaggggtgcctgaggcctgaggaggactggagacccagccccttttggccccagggccctttctgtgctgacatttcacagaaactgaagaggaagaacagacactacctttcatcccacctggggactgtctttggggcacgctgaactcccatggcccccaaagtcccatcaccttccccaggtaggtcagacctgactggatgtccctctagtgccctgatagtgtggattttatctttgggctctgggctgctttctgaggagctcactaagaacccttgatgccaagtccaggacctgcccctctgctccatgtcccaggggctgcaagcatgacgggaaggtcctgctgggtgaggatggtgcccttttccagaagagatgtctgattccagtctctagggccaggtttgttgggctttttttctcacttggaaggtctcagtctctttattaccttctttaaaagtacaattggtttaatcgtgaaatcatgtgcatgcactaaagtttacagactatggtcatcagcacatatgtacactctttctggatgggacaactgtggacacggccatactggggtctctgtctctctcattatcacaagggaggataccaacagctctctcctatgcagaccgtagtcatgtttcccaattgcacaagaatgtctcttacagttgtttaatttccttcccagccaggacgcttaagtttcccatgctgatacttggttgctatttctctctgatccaacatttttcaaacagtattgcttgcaacccaaggcttatgaaacactttaccaaaagttccacaagaaaagctcaagtttctcatgcaccgttggaccaggttcattgcgtgcagtaggaccttgctcaagtgatgagtccatttgatgttttcaccatcaaggtgaagggtattatgacttttgggcactgagttgatagaaggaagacagcagctgatgatggccctgcccaccgatgtgtgtgtgtgggcaggacctatcgatggatttagaagttgagggaactgtttattctgcagatggaatttccagcactgaatctccaccaaccagacactagcactcagcaggtgctctgtaagaagaagcccttcactgccaatcacggccattacacaggtgaaggagaggatgatttttaacagccattgaccctcacagtaaactgaggtcaaaactctggtacacaaagtgactttgagagaacaggctgaggaagcaggttaattagtagcagaaggctttgccgagagcaggaacaaaacagggttggtgaggaactagtgatgccatggtgtggaaggaacaaggcctgtaccaggagcaggaaggggcatgggaaagaccacactgccacatgtgatgagtcagcacatggaaggcacagcaaatgttgcacaaaggtttttgtgtaataacctggcaaacagctgcttctctatcaagattgatgagtcaaaaaatgttactgatgcattgctgtcacatgtgaaggtgtgtgaagaatggtgacattcaaggaaacctgttctctgcagacacctacccaccagtacagcagacaccccagctatgccaagggctttgtcttcctctggggtaagagcctgggaacaacaagttggcccctgaaaggggtgccccatcatgcgctcttcatggctgagttaagtggggagctcccagagaactttccagtaaatggtcaatctgtttgttctgggtgcattgagcatgacccaggatcaatggaagtgacagaagcttaatttccccaaggctgcaaggcgggcactgggaggacggctgaagcagtttagccaccaccccctagtggctccagccccaggtaagcagggacagttgaagggcctgcctgagcccacctgtgtctaattagttccagcatcagcagctgcatcctgtagaccaccaaggagtgtgtgtgcccagcccctcacagatcacctgagcataaacaggaaattctccttcttacacctgactgcaccacacatctgccccttgctcttcatttacaagacgctatcacatcagacacggactgatctgagtcccgggttccctcaggtttctgctgtcctctcagatccccacacacaaaagactcttcaccacagggcgttgagccagctcttcccctaacactgcctcttacaggttactcttctccaatatgatgcgggtttgatttcagtgtttctacatatatacttttgtattttattgggtaagctgagccccttgtacctgatcttgagtcaggcaggggccacacagagaagaggtgttcctcccctgggaccagcagtcctcggatcagggcatcagggacctgaacagcaggttctgaatccacacctagacccaggaagtccctgagcccccagcccacagtgtggagcggccaccagggggaagcagagagttacctggcaaagccacctggcgatggggcgggcctgggtgacagggagacgctgacatgcagcaggagccagtgaccatgatctcacacctggaatgaaagggtctttattttcatagagtattgtccttgtgtacttgacactcatgtagaaattctagaataggattttaccttcagctcttgcagatgctgcctctttctctgccacagctccaggcacttgacttctcacagtgccctctcctcacacacccagttgtgctaaaatggtgtccctgccatgtgcagtgtcctccctgaggtcacaggtgtcccctttatctcccctttgctctgggagcccctgtcctgcagacacagtggcttctcctttcctggctgctcctccactttcattgtccctggtctttccggactctctcctggggaagctgccaaatcatggctcttgatttcctggtgagtcacaaaatagttgctcattaacctttagttgacttaagttcttaatcattgatacattttccccaacaactgacgacaacttagttataataaacattcacttctgggggtcttggagtttgcagccccctctcattctctcatggagcaaacatttccttcgcctcctcatctgtctctgatcctgacagcatcctggagatactgaggcacagcagctatgacctacccaggagcttgcagccaaggcagaaacttccatcacctcatggatcttccagcactctgtgtgcacttgacaaataagaaattccattgtcctctaccactcaggagctgtgccctgcggtgggacctgcacctttccaaggtgtgtgttatcatctgcacagtggagatgaagagggaacctgcattgggttctggaaagtaccatctaaaaatatatttagacctgcaacagaaatctcctctctaacataaaatatttatgatcaggacacactgagaggcctagaccaaaattaagcactgccctcctgagccaggatagaatggaggaggggactggggaccccagataattccacagttaccagcatgactctatgatcacctcctggaccagatcaaagatcatcccatatgaaggacttcatattccttaggaaatacaaagtcacctctgagctctgctgtgaccaagtgagcccaggaatgaggctgagcacagtgtgatgtggagatgtctgcagagaatatggaatcaattgataaaggagatcctgtgggcaaagggtgggagggcaaggccacccctaacctctttgggtcccttggggctgagtccttctggaaaccacaaagctcctccagcagcagcccctgactctgctgattggcatcacgggctgttctctccaacaaggggttaagagagacctgggaggagcctgcccagcctcagacttgagaagcagcattggaggcacttcagccatggcctggcccctcttttccttggtctcctgactcactgcccaggtgctgcccccagggtctcacccacctgcccagccccaggcctccaggttcagcctggccatcagtctgagctcagcagggccctgtgtgtggtgggcaggatgctcgtgaccctgctgcagggggaggggctggttgggctgaaatgcccccactctgtgctcctgtgctcatgggtgccctgagagctcttttattcctggggctcactccagccctggcaagtagcaagatatcctggggttgagcctctcagtttcaaattttttatctcccctttccttcttgcaggctctgtcacctcctgtgagctgacacagccaccctcagtgtcagtagctccaggacagatgactaggatcacctgtggggaaaacagtattggaagtaaaagtgcttaatggtaccagcagaagccaggacaggcccctgtgtgggtcatctatggggatagcaggcggccttcagggatctctgagattctctggctcaaactcagggaacaggaccaccctggccatcaacagggcccaggctggggaccaggctattactgtaagatgtgggacattaggactcctcatcccacagtgacagaggtagatggggaagtgagacacaaaccccttccccatacgtgtcactcttgtcctccagcccaggaagactgtggacaaagccatgagcatgggtttcccaattcacctggatctgagaccccccaggctgccctttccacaggccctccaggcaggctctgcagaggggacatcaagactgaatttagggcagaggtgaccaggatatattgaggtttgggggactcagttgtgatttggggaaatggggccagaatggaaggtcaggccaaggtcaacatccttagttggtctctggatttccatagggggtgaaggccagtccttgggctgaatatcctgagtcagtttccagaactgcccagctcaggctcccatggcatcctgccattctctgaaaagggccctggcatgccaggtgctctgggttctgagggagagttggaatcagatcctcctgcaggaatccagggtcaggagaagcagcctcacctgacacagggaccacagatgcacccccacagggtgagctgcaggatggatgctgctcatctccaatcctcacatcctatgcaaaaaatcattcttttcacccctccttcagtgtatcaaagttgacacttaaaaagccttaagagcccactcttgtcaacagaaaacccattcacatctccatcagccacacaatctccacagaatgattcttcaaaaaacgataacagtagacatgaaaaggtatctaaaatgttacataaataattgaacttagattacatatgaaaatgatactatttttggtatgctaggtaaataaaatatattatttggactcctttactttcttctctttgtatttctaatgtggtgactagacattgggattccaatgaggctcacatcatattgtgattgaacagtgctggtctgcacctcttcaggtaacaggggctgtggagtgacctggtgcaggaagccccatctccaatcataggacatcagtgtgaacccagggagaggcactggtgcaagagaaatgagaacaggagtgtggaccatctgcttgtacaggggactgagccctcactttgagccaaataaactttttttctattttcaattctgaagaagaagactttcctggacttctttccgttttcagatttgtgccccttcaggtttggcctgtctggatcccagccaggggacaccgaggaaatccaggagtctcacactgactctgttgtatttcatctgctggggtcatcccaaactgctgcgtatcgtttcctttcctggtgctcaaatagctgctccatgcacttgtcacggtttcatagctcagtctaggtgggaagacaggatagtgtatgttataatatttaaatggaacctgaatccattcattgtttttgtttttttgtgtttttgtttgtttttgttttgtttcgtttttgagagagagagagagtcttgctctgtcgcccaggctggagtgcaatggtatgatctcggctcactgcaacctctacctcccaggttcaagcgattctcctgcctcagcctcctgggcagctgggattacaggcccccgccaccacatccagctagtttttgtattttagtagagatgaagtttcaccattttggtcaggctggtctcaaactcttgacctcaggtgacccacctgtcttagcctcctaaagtgctgggattataaaggtgagccaccacgcccgacccaatagtttttttaaaatatgaaatgttaaaagagttttgtcataggcattgggaaaggtgaaaatagattaaaaacattttaagaaaaaaaccaaaaatgtacttgtagactgtctgtgtgtcttcagtgttgcagggttcagagaggtcagttttatggttcactaaggaggggctaagatggaggaaaccaagaaagccaaaaacacacatctctgccactcaaaacataaatcaaagtaaaatggaaaaaatctttcaataaatcattcccaataaatatcactctggtgcacatagaaaggcctgttagcaaactttccctttcccctgctggctcatatccccatggatcacctgtgtgcagagtggactctgtggtccccatttctcaggctgagaaccagagactgggaaggacaagtcacctgctcatgagtgggaagggcaggattgggagcagctggcttgggttcaggactgtggccctggtcggtgctctgtgtccctccagagggtccctcccacatgtgccccgtgtggatgtgggtgcactgcctggggtggctgatgtgctccagggattcgatggtgcagatgcttcagcacaaaacgtggaggtggggatgggatgaggctgcagctggggagaccagagaccagcgccacccagcagaggtttccacggggtgggcagccccatttcctgacagtagagacaggctggaggtgggtgccaagcagagggcgctgtggggtatgcccaggcctagagagtcacagagacacaggcactacacagcagaggcactgagggccaggagctcactcaggtgagagacttcagcagatccttctctcctgagcaaatcaggtacaaaaaaaattaagttcctgccatcagcatgcacaaacaagaacattcatctcttcagctgagccctgctgtccagggaagcaaaagtctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacaggtgacgcctccagggaaggggtcttggggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttccacagtggtccaagttcatggggaactgagaccaaaacctgcccagggccttcagacttcctccttgctctgaagatgcttcctcacccggtgcaagaggcttgctgcagcgcggccttgagaattcttctctctcagctccttccctttccaccatgaattccaacaggaaacctgccctgtggtttcccatccaggacagggacagcttcctgatgcttgtgtgctgtggtccctgaatgtgcaactcttcccagctcttcaaatgcagggacagtgacaaggagctgcctgattggtgcagtcactgcttttttcagggatgtcttcaccctacatgtatcatcatcccctacactgtgggtagaattttagcaactacattctaatggttatcgccacaactttgatcttagaaataacagtgcagtgaacatccctatgcaggctcctttgagttcctgtgtgaatacgaccataggattcatttctaaaagtgaaattgcgggtcagaaagatgtgtgtttgtgattttcacccaatgttgtcagattcccctccagagggattgtaccaattttcaatgccagctggaagtacttgttcagagtacattgttgaatgtggaaatttttgccaacgtatcagagtgaaaaatggtaccttgttacagttttatttttcagtctcccgttctgcttaaggttgggccttttcacaaatagttcagtactcttcatttttcatgatttggtaaactttataaaaaatatccagataagaagaattttagtctttgtggccagacacggtggctcatgcctgtaatcccagcattttggaagactaagacgggtgaatcgcttgatcccaggagtttgggattagcctgggccacacagtgaaccctcatctcaattaaattaaagaaaataaaaataatttttaaaaaaatcctttgtggtccaaggatcaactttggggatattacctatggacttatatcaccatttacaatgcaaacatttaaaatgataacaactactgtcagctgcagaactaatttgactccatcaaaaaaaaaaaagctaaaagattataattctgcatttccacatgttctggtggtcagagaccacttccttgacaagcagtgagtacggggatctgaagggtagttagcatttaggcaggtattgggtgaagaatagggatatacacaagaaactttcaaagagaaaaacacatggaagttggaacacagaagagaacataatatgtctgagaaataaggaaagtccagactcactggagctgagtgagaacaagaaaaatggcataagccatgtatttctctctggatatctcattaaaatattgtctcctccccaacacaccacccatgtgaattataaaaatgcccgttttaaatttttgtttgcatgtcgtgacagagtcaagcacgtgaatcaagctgagtttgatgagtccagggctgttaagccccagacccaggtggcctcagaaggacttggtggaacgagggcttgttgtcaaaagcagaggaagtgagattttccattgtggctgagaccagtttcttaaattccagtggacacacaaggccccttaaggatcggttaagatgcagatgcagcctcagcagttctggatgtggccccaaattctctgtgtctggcaactcccaggtgaggctgctgctgctggtcctcccaggaccacactttgagtggctgaactcttattcacccacctcactcaagccacgggtgagactcacacaaggagagcatattctagaagcacaggtcacttctcactcctccccttgtgtcttagatccttttctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggggagccagtgtgtgcagatgtcaatgggggagaggaagcaagagagaagacaaagatgccaggctctttttaataaccagctctttcggaaacaggggaattcactcaccccaagtgagggcattaatctattcatgagagatccactcccatcaccctaaaagctcccattagttcccacctccaatactggggatccaatttcaacataagatttggaggtgacaaagatcaaagccatagcaccctgaggtttggccacacacttgctcatctccacatttgtccctcccctcaggactagggtcctgactgctctgacttagtctccctccaccttatgggcacctggcagtcggtcatcatcagctttgctgaatcagcagcaacattgagggtaaaaattgtgtctcctggttccaccagaaataaagtagagccccacacagctgaggtgtggggtcaaaaattaaaactaagagacataagactcattctcaggctccaagtctggccagtgagcttctttgagactccctgggatcccagcagtgacactgatcactattgctgtcccacacatcccaagtgatgaggaagtaagaccaaaaccctcctgagattcctggcttgtgtcctgacactggggctgttgggattcctgtctttccttcaagattgttcaaataagcaccgacaatcacttccatgtgagatatgaggagagaataattccacatgaaccaaatccacgaagcctacactgaagcctgccaagttctctgcagtccagcacgatgaagggagcattttcatgggaacttttgggaatatgaggggagccaggctcagctatgggttccagagacaaagctcctggatgtttccccctggccttggtccatcacctgctacctctcctcactctttccacagatgctgccccaggttaagcccccacaggactctaagcctattcctgaccctgagctcagcccaagtgatgcttcaggagatgggatcctgagaatgagcgccaacgtctctttaacctgaggtgtgaggtcatgagacacctgttggccataagacacctgtcccccacctgctcaggagacagtggagcaggcaacagtgcagagagaaccagcaggagccaggccaggccctgcatccaaagcaggccccaatcccacagattctccagctccagcctggggtacagccccaactttctgtaggctgaaatgggcttctcaggatgggcaggccatgatgggggatggcagtgtgtccacaggacacagccctgctgcctgcctggccctcatgcccactccttccccaccctggttaatctccacccaaaagggcccaggctcagaactcaggacacctggatcagctcctggacttgcccccactgctttctgttcccctgagccacttagtctcttttggcctcagtgttacctgctgtgaagtgaggaggcttatactgaactgaggaagctcttttcttcattcaaaattaaaagacagaaacaataaagtcatgtgaattaaagccttctaaggggatgtcatttaatgggctccaatgggcttcagacatggaacttcttgtctttcctctgcagagattccaagaaagggactcaaaagggcttgctttctgtatgatgggaacagtgatctccagctgagtataagcaggagagtcctagtttcatcagcaagacagacaaggctagggtagaaatcctcctggcacaagctctgagaggtgtggaatgaaataaagataaacatgaaattaatgtgcctatgatggtgatgttagctcacaactaagctgcagaaccagaaacctggtgattgcagtgaatcatagctgctcttactgggtgggaggtgcaccagtttgcttcctaagtgcatagaaagcctgggtccctgtaggatggcatgcacatctctctggactttgaaagtgttgcagaagagcttcagttgactcactctaattagacctgactgaacaaaaccattagaggagggcatttcaaccctgagacacttctatagcaattgcacctgccccaccccactgaactgcgtgtgttacctctctgtgctgggctgggcagggcagattgggtcacactggcacagaatggggctggactctctggtcctcaacttctgaggtgacaggtgctgtggggtcacctggaagaagaaagctcctgggctgagtctcctccaccagttgggggcagcagagctgcagccaggagcagtgaggagagaggctggggctgcccagctggggcgaagaggaaggccagcctggggttcaacaggtgtccaagagtcagtcttcagactgaaaatgaagacagttcatcctatcccctcgggctgcagtgaccacgttctgagggtcagattcatacagtgtcacccaaggacaccgacagaagcccggcacagtgaaggcctcacctgggaaatgcaactagaagaggctgggcccaggtgtcagcttgggcagcttccttaggaaggggattccctgggagaagtcctgaggccgaggtgctctaggaggggcacaatgtgaggtgacagggctcccagggcccaggttcttcacccaggatggcggcctgagcctcctgccactctcagggccttgtccctccctgtccagcagtgtcctggggagctgagccctctatcgtgggcacttccagatacacccgacccctcctgcctctgcctttccttccagctccaggtggactctgactcaggacgcagctcctgtgctcaggggagattcaggtgggtggcgtgaagcattttggggccctggtccctgcatgaggcatcaccagcctccttcaggagatgctgtccagaggaacagggcttctcacctgcctcaggccacagctctcaccacggggctgtcctttgatcagtggcaggatctgcatggctggagggactactgaccacatgctctctggagctcatgtcttgtgtggagaccatgacctggggaccctcagaaagaccaagcagcctaaagttagattttcagtccagtgtgattctctggttcttttcgcaagtttacgtaaaacgttgatgagaaaaagtgaataaataaaggaagagttgaggatggcaattgctggtctactgtggggctgggggataccatggaaagagcagcaccacatgtcaaatgagactagagattgggatgcatccgaaatatgtgtggttgctcaaatgacaaaactcttccaactgcaatgattcataagtgtcctacagacacagtacatcatgtacataacattaccaggatggggccaagtgactcgggggtatcaggagcagggatgaaagaggagaaagatgatgcatctttggtgtacttgctgctgagtcaggcgtcatcagtgatttctcaacagggcccagctcagccccaggccaggctcctggaaggtccatagtcctgctcaatgcagcccaggacaggccacatgacacagaggtttgagacagggaccatgttgtcaatccccaggacggtgactgtgatcacaggccttggaggccaaggctgattttctgactggagaagcagacgaaggaagctggggattcaccccttcattttaagtttctcatgctgcccccagagctggcttgagggatatcccgccatgaggagtcccagagaagtaaatttgcataaacaccaaggatgcactgccccagtgggcctgagaggaaataagagaggcctgggaagcccagctgtgctgtgggctcaggaggcagagctgtgggtgtctcaccatggcatgggccacactcctgctcccactcctcaacctctacacaggtgctgcccccagaccctgccccaggctcagccctcctaagcccctggtcttaccctgaaccctgagctcagcccaggcatagcctcagggcgatactactggaatgggtttgttatcttcaagccccctctcttgtcctctcttgcaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctcagtgacacaggcagatggggaagtgagacacaaactcctttttcatctgtgttgtgttcttcctccagcaccaggaagactgtggaccaagcaatgagcaggtctggccaagttctactggatctgagacctccaggccatccttttttccagctgtccaggttggctctgcagagggtggagcaggagtggatttaaggctgctataatcagaatttatggtgttttggggcctcatgagtgacttggggaaataagaactggatggaagatgaaagagatgtagagaaccatcacttgaccttagatttccatacgatggtgattgggtcactccttcttcaaaatatcctacatcagtcccgaaaaatacccacctcagctcaacacctgagcttccaggcttccatggcagcctgggattttgaacaggaaaagccaaggaggggacactgtggcatctgcctcaatacccttttctgagctcacccaacctcaactgctgggagcttctaggagctcagagctgtgccctcactgggaagtgctattagctccaaagaaaacttccttcctcatatttaggcccagttttgagagttttggtttgatgactgcctgagccaagaacccaaggccctgtcctaatagaggatgacactgaaaggccttccagatccagacatcccagtatggatgcctgaggcctcagttgcaaccctattgtgggtcagggtctccttctggtgggcgatgcctccctcactccttccagatcctctgtgcatgcacatctttttctcagagtctacttccaggaaacccaaactaagatggctggctatcaccaaaataaactaccatagacctgaggtggaaacaccagcgaatttcccaaatttccattgtgaacatccaaatgcccatttatatctgagtgttccttgtattcttataaaatgaaaatggagcctgacataccaggtttttggagtcctgaaggagatgtggagacagatccttctgcaaggaatccaccgaaaggggagcagcctcaccccatgcaggggctggagatgctcccacaggggcagctgtagcatggacgctaccaacctccaccctgcacatcctgcacaaacaatcactctttcacccctccttcagcttatcaaagttgacacttacgaagccagcacagctcacccttgtcaatcagactccttcaaacctccatcaaccacacaatctcaacataaagaatctccccaacataataataggaacagtagctatgaaaatggctataaaatatctcataaataattttagattgtgttcatgtgtaaatattatttttcacactttgggttaaataaaatatattactgaaactagtttacctttttattttttatgtctagtatggtgactagacagtaggattcacatgagactcacatcatgtgattgtacaatgctggtcttgtcttaccccttgaggtggcaggtgctttggagtaacctgcttcagcaagccccatctccacccgtaggacatatgtgtgaagccatggagaggcactggtggaagagaaatgagaacacagatgtggaccagctgtttatgcaggtgactgagtcctggagccctgatcctgttctaacctagatgtgtcacatccatctcaccagagaccgctgctggcctgccttagctcataactggggggatctggcagttcatgaaacatggtcgcttgatgtccagtgttatcctgtctctctcagggcccaataagacaaaaggagctgcttttagaaagggaagtaacactctactgcacatgacatggccttattccaaaaccccatgagtctacgttgggattctccagtggggtttgccatgtacaggaggtttcagttcccacagtagagtcagctggattctctggacccaacagcaggacactcacaaccctgcctgcacctgctgcagagcctcaatgctctgggcctggaaaacaatgggtgatatttgtggctcctgatatatgggttggagccacatccccaagtgtaaaatatgctactcctagacctttatagaccttgtgtctgtttcttcctggagggaattgaagggtataataacatgttctttaatttgtaggagactctcagctgctccagacaactgaagtcccaatttctgctaatacagaagagggaacagtttatttcccactcttaaaagtgcatggatctcacaaaagcttccagtaggccatgcccatcatgtatatgtgattcaactatgatatcaagatggtctgaaccctcatgatgatatcatgatagagataagagagctaatgatgctgggcagagaaagtgtgaatgtatactgtcgtccattccacctgaatgcacactgattctgatcctattctctgagggaaatagacaagacctcagtatctgcttcagtgaggtaactgtgcacctgcagccatagcattctgttcccagagatccccatctggcacagatattgctaatgccactattgcccatctgggtctgtacaaatccaaattcatcttccaggatcattcaactattgtagagatcagtccagtaaactgaaaacaaaaccccagaagtaatcacacgtactgcgggagaggagagagctgtctcagagggcacagtcttgttgaaattcctctgctccttgggaagaaacagcccagaaaaggccccaggggctgcgtctcatctgggttcctggatgaggcacaccccctactgcactgagattccacagaagctgggggtgaagtgcaaataccgtctttggttcatccttgggattttctttttatcacacactcgtcattttgtccacaatgtccaaagtttctaaagtgctgtctaatagatagaggttctttgtgcgctgaactaaaagctcttgggttggacaatggtgatgtttgcacaacatttttactgtacttactgccgcttaattacacacttaaaaatgattaaaaggatgaaacattttgttatgtttattttaccataataaaaatattgcatgctcaggaagcaaagtaattttgcaattatacaactgttaaaaatggaagaattatgtactgagcaccattttctctgttgtttatgctacaattcaactttctctctctctcactctttctctaattagcaatgatcttctgtctggtccaaggtcacacatttccagtcttccagaaatgtctgttgaatctgttaatttgttgccaggaagaatactcaaacttctcatgctcatatttgagtgttagctgtctccagccagcatttctaagccagaccctttgtcaaggcttttgaataattttgtgaaaagtacccccaaagatgacagtgttcactgttggcagcaggactgtttccatgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctattggacactgagtcacatagagggacagaaggtggctgaggacaccttatctctgatgagcataaggggattagatctgctggtggaacaggaagctgaagaaacctgtggctctaaacatggaatttccagccctgagtctctgctgtccgtgcccctctcatctgtatgttcctgggagatgtggaccacgggggttagaggtgaaggggattgggaagctttcatgttctctctcaccatctcccttgcttatctaacacactcttacacacctactttattggagcttctgctctacaaacatggctgagctctaaattagagacttttgaaagtgcagacggatgcaggaactcgtccatctggagactttccaccacttgaagcagtgaacacgtctgtgcaaggctcagaatttcaagtgacaggatgttgggatttcaaagaaaactaaatctttggatgaaccacgacagaagagggaaggttcacacatttccctgctgcttgggcctcagtgaggactgactcagccagtctcaggctcctggagaccgcctgggagatctgcactaggaaaccattttcagcacagcctggggctggtaaggggcccttactctgttattctgctgcctgataattttgcatccagagaagaattaggacctgtgagtccaggaatttcaaagcccatagacaaggtcccctcattctgccgtgacagcctcagctctgctttcccaaaaaaagagcatcttcccagcatgaagaaccaggagcaaagagggagcttctcccaggggtgagcagggcagaagccaccttggtcagtgggaaggaaacatgctcagctcacatctgacccagaatgactcagtcacacctgtgcagggtcacctgtgtgtgagcatcatctatttgctccatgagaaaataccttgtgtggctcttgggtaaaatcataccataggtgacatttctctgcctattgcttcagccgatgcttttcgtgattccctttaggacactggcataaggtaagcatgtcaggtgtgggacgtattgaacaggaaaagcagaggcttctcatatcaatgctcgtggcttgtatttgggcccatacctcatggaaatgggaaaaacagaaaagaaaatgatactctgctcaaaaaagcactgagaaatgctatagtattaatatatcgacaactcatttattgagctaatgaaatattaacatagatagatcatttttatagggggatccctaatccttaaacattatattaaaaatttgtcagcttaaaggatcattaaaaggcctatgtttgattgaaacctggagtactgtactttgagtcttctaatcagccaatgagtgcagggagctggctgccctcccaggtcctgactggctccatgtccaggtagagcagcgctccccacaggcagctggaggaactgacgaggggaagctgttggcatcagggcctcaaaaatttgactcaggattttcccacgtcccctccccaagtccaggcgggttccaggacactcagaagagctcatcattatgggtctaggacttccctggtcctgctcttctttcttccttccccagtggccttaagattgtcactccctgtcacaggcccttcctttccttgtcaagtgcactccctgaattctctgctcctgggtcaggaaagctctggaacttcagggaaagcagtgctgggtgacccaatggggacccagaaagctggcccagggccagatacacaggcagcagggtgggtccctacagtgctgcctggtgggcatcaggtagaggggagtgaccaggaccaactcccctgagtgtcttcagggccaggtgaactagggagggtctgggacctggtgtggacccatgcactgacccaggaataggacaggaaactcctcagagcaaggactgtgttttcctcatgctgagctcctgaaaagcagtcttgccaggatagagtgggccagggtggatatatgttgggtgaatgagcttctgtctctgttttattgcaggagtcactacgaaggtacgctggccctgtatttgtatccagaaccagtcaaagccacctgtgagtcctgcatccctcagtaccaagccccagtcccccttcaggaccacccaccacacagagagacagacgtgcagggagcctgaggaagaacctgaaacctcctctactacatggagtgtttgtatttccatcaggaatcttgagcaccttgtgccgggtcttgaggcaggaaggggccacacagagaagaggagtttcttccctgaggtcagcagtccatgaacgaagggatcagggacttgagcagcagattctgaagcaacacctggacccaggaggcccctgagcctccagcagcccgcgtagagtggccaccagggggcagcagagagtaacctggcagaagcacctggagatggggtgggcctgggcatcagggagatgcccacatgcagggagggtcggtgaccatgacctgagatctggagggaaagaggttcttcttttcttagagtatttgtccttgacaccgatgtttacattcttctggcttcctggttctcagatctgactcttggagatgatccttatttttctgacacacattcaggcactttgcctcttcccatcgacctggcccccatctcactgtcacacatgccatcccatcctgtagtcagacgtgtcccacctccctgcctttgctctgggagcccctgtcctgcagacacagccacttctccttccctggccacccctcaacgtccactgtccccggtctttcctgactctgttctggggaacctgccaattcgtagttcttgatttccttatgagacacacaatacttactcattaatcttttgttgacttaagtttttatccattgttacattttcccagcaacagaagacaacttagttataataaacacttacttcctgggtcttggagtttgcagccccctctcattttctcatgaagcaaacatttccttcacctcctgatctgtccctggtcctgacagcaccctggtgatactgaggcacagcacccatgacctgacactagaactcgcagccaaggtagaaacttaccgcatcccatggatcttccaaaattctatgtgcccttggcaaccaagaattgcattctcctctagcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacggtgacacaggcagatgaggaagtgagacaaaaacaccctcccagcctcggtcaccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacccacctggcactgctgagaagcccagcagctcagagctgtgccctcactgggaagtgctgttggttgcagaaagcttcctcaagtttgtgtcccttttcagaggggttcggtttaatcaaccaagatctcaaatccttgcctcaatttaagatgccactgaatgaagggcctcccagctccagagctccctgtgtggatacctgaggcctcaatgtcaactccatcacgagtcagggtctccttctgccccgtgttgcctcccccactcccttctgaatcttctgtgcatggacatctctattgcagagttagcttccagagaaccccatctaagatggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcgatgtaatttatctcatacataatttcatgttgataacgtgaaaatgatagtattttgctctactgaaataaataaaatatatatatatatctgaatttatttgtcttatcttttcatatttaatgtggtgactagacactagggggtcacaggaggatcgtgtcataccactatgggacagagctcctcacaactctttcaggtgacaggtactgttgagtaacctgctgcaagcatccccatctccaccagaccatataagtgtgaacccaggaagaggcactggaacaatagagagaaaaacctgcttgtgcagaagacggtgcccttgagccctgctcctgctccatcctacgggtgccacattcatctcatggtgtaatatttcgtgccctgcctgagcttatgaccgaggggatatggcaggtctgactgtgtggttactggtgtctcatgaggttctggatgtaacaaagccctcgaatatagaagaggttgttttcaaaaggaaataattatctactgcacatgacatagacttgttgctaaatcccatgcgtctacactaggattctcctctgaagccttgccttaagcacaaggtttcagttcctatgtccagttcctctattatggtagagtctgctagtttctctggcccaatagcaggacactcactcccccacctgcacctgctgcagagcctttctactcttggccccaaaacactgggtgacacagttctcagacccatgatttatagtgtcagtattcaggcctcaggggtccctgatggcttctctggctccaagtctggaaacacagcctccatgaccatctctgggttccaggctgaggatgaggctgattattactgcaactcacataggagaggtggcactttccaccgtggtccaagttcatggggaattgagacccaaacctgccctgggctctcagcctctctcttgttctgaagatgcttcctcaccctgtgcaaggggcttcttgcagcactgccttgagaatttcccctctcccagctcctctcctttctcaccaggaagtccaaaaggaaacctgctctgtgatttctcatccaggacagtgacagcttcctgatgcttgtgtgctgtggtccctgaatgtgcaactcttcctagctcttcaaatgcaggcacatagtgagaaaagctgcctgactggtgcattcactgctgtttttaaggatgtcctcacccaaaatgcatcctcctcccaaattgtgaagaacaatctggacagaggtcattacagggagtttcaagaaactgcatcttattcaattgtgtccaccatggtctggtaaagatggccctcctggatggactattcctctgcatgtctgtcctgaagcagtgaccactgtgagaagatctgaacatgtttgtgaggtattaaggacgagaggaaactgttgtttttattattcttttgtttttgtttttgaaacaaacttttgctttgtcgccaggctggagtgcagtggcagaatcttggcttactgaaatctcagcctcccaggctctaccaatgctccctgcctcagcctcccgaagagctgggataacaggtgaccaccaccatgcctggctgatttttgtatatttagtagagacgggatttcaccatgttggccaggctggtcttgaactcctgatctcaggtgatgcacccacctcggcctctcaaagggatgggaatacacacaggagccactgcatctggcagtgttttttttatttttgctcctcctctttgcctcaatacctcaggttgctgagctggggagattttgcgtgacaggctcagtgctccctcaaaatcctcccgtctcaattcgctggggccctgtcctggaaactccccaaaagtggatggtgtccctataggttgggagtttccaaaatggccccacagggaagagttaacgtgagtccattccttcttcctcattgacatccagcatttgtaatttccatgggtgtcaatacttttgtagctgaaatctttcttaatctactaaaggtgagaatgaatttaataaatattcagacattagttgcatccaatatttaaattttatgagtcaattggtagacatagccattattatatataatttaggcttcataaactttgattaaataggttttattaaaaacaaagtaaccattttattatgtgtttagactatatcaacatgttgtgtacctgaaatatccacaagaaaatatatttcaaaaaccaaattgtatttattgtctattgttgcataaaaattgctccctaatatttagcatggtaagagaacacgtgtttgtgatcttgtcacttcggtgcatctggaattgagagcagcttagttttgtggttctggttctgggttggtcatgaagttgcagccaagctgtcaggccaggctgcattcagaggccagagcaggtggccaggcccagcctgaggggcttccactgtccctaacctgtttgtctgatgtggaaaatctcagaggaaaaggagagagtgaagtgtaaggcacctgtcccagtcccccttgtcaaaggccatcccatacctgcaccatttcttattctttcctggggcgtcataggcatagagcactgcccattcattctaacgctgtagagtattctgtagtaggattttagccatgcagcctctaatggttatcaccatgattttgatcttacaaatcacactgcagcaagcatccctgtgcagactcctttgagttcatgtgtgcatatcaccataggataaatttccagaagtggaattgctgggtcaaaaggatgtgcatttttaacttttatccattgttttcatattcccctccagttctaccagtttacaataccagccctaaatattgattggaattcattggtgaaagtgcaagtttgtgccaacctatcagatatacaaagttatcttgttacacatttatttttgatttctcctattttgcttgaggttgagcatttactcaaatatttcagtgctcattatgttttaggatttggtaaaccgtttcttcaatgcctcggtaagaggtattttagtctttgccatgcacaagacaacgttgggataatatgtatgttctgatacaccatctacaacgtaatcattaaaacatataaaaaccactatcagttctggggccattaaaaaaattggtggcaggccagggatgtcccacaggatgtggtttaacggtctctggtttctagggttatttgaagtttgaacattgcacccgcatatgttctatgtggagatctctttgtgagggacactgtaattcacctcctctaggggcctgaggtctttctttggataagaacctacctgtaccatgtgtttgattggatcttgtgtctgctcaagacagccctgtgtcacaagctcatgactttcatcttcatccatttgctctgttttgtgagagcttcagtatatcaggaatagagattcctccgaggtgaaaaattagaggcagagggaggggcaaatgggcaaggaagcttgcaccaagtcgggagtgatccagtgtaggctgagagaaaaaaggtcttaaaatcagccttgtagctgaaaccaaaaacacacaagatggttggtgttctgagcatcattaacaaatgataaatgaagttgaacttttaaatgtattgcaaatttttataaagcaagtagatcgttaaactcagaatgcaacaatggaataaagaagagagtttgagatgtttttaaaatttatttatttatttatttatttttgagatggagtctcactctgttgccaggctggagtgcagtggcacaatcgcggctcactgcaacatccacctcccgggttcaagaaattctcctgcctcagcctcccaagtagctgggattacaagctctcgccatcatgccaggctaatttttgtattttttgtagagacatggtttcacaatgttgaccaggatggtgtcaatctcctgacctcatgatccacccgtctcggcctcccaaagtgctgggattacaggcatgaactaccgtgcctggctgagtttgagattttaactgtaagtcctccaactaagttgccatgacaagaacagggatgatgagagtggaaatatgttatcctgcaaattatcgttttatgtaaaagaatattttccctcttttaggtaaaggaagcatcttctggagcaccttctctctgactatcaaagcaccattaagccacaaataaactgtaacatgaagtaggaaacaactgcccttttatataaccattgagaggtggctttatatgcataccaaaatgttgatgctcaatgctaaaattggatttagtaatttaatatgcctacaagaaattaattttctttggattatattatttctgtgtacgatttatcttagttaacttggaaatattctgctctaaaaacaactcttgttttttgggttatattttctgtatcaactatagctcttttccaaatgctgtcagagatagcccatggctactgatcacaaaattcaattttatggcatttaaattattctatactctaaattattttaaaagtgcacagatgtgaatttttcacatctgactcaaaaatgttgctgatgttgactcacttttttatttcaatcttattgaagtaggagtttacttttctggaacctggatgataacaggagactggagaggaaaccccccaaattgttttcctttaaaccctcaggatgaatcatcctggataatcacccacacttgatttgggtgatatctaaatgagagttgggtcttagagtaggtgctgagttagtttaggacttgcgctgttggaatgagttgaatgtttttacaagtgagaaagacatgagttttttggagtccagagggtggggggttattggctgaattaagtcccccaaaatgtatgcattgaagctgtaacacacaatatgtgactgaaattgtgcatagggtctttaaagaggtgactaagtgaaaatgaaaaaattagggtggattcttctcaaattggactgatgtcctcctaggaagaagaaatttgcacacacagaaatgaggcaccagaggtgagcgtgcagagaaaagaccaggtgaggattcagcaaggaggtagcaacctgcaagccaaggagagagtcctcaggggaaaccaaacccactaccacctttatcttgggttttccagcttcagaactgtgagaaaatatgtttctgccatttcggtcactaattctttcctatcttcttgtgggagctctagcaaaaacaagagggaccccaaagaccttggatgagggagaaggaggagatggagcagggtgcaggaggcggtgcaggaaggggctggaaggtcgggctctgaggtgcatctcctgggtggaatcttgactccactccctattgtctggaggacttgggaaaaacatttaacctcctaatattcactcactaataaagatgggcttgaagcacaaggctccccatcatcctattctatattacaaaagtcttcttgaggtaacacttgtaaaactctcgctaatgcatctggcatgtattatggactcataagtagcccttctgagtgatctagtgatgtgcagaaaatggcattcatgctgtgtgcaccagggggcactgtgaggtttagtctgaggcccctaatgagtccaagcccctagtaatgctcaagggcgaagagcctgactgttgcttcctatgaggccccttctagtgggtaaatctgaaaatgcacttggcccttcttctgatcttgagaaattactcagagaaggccatcaggctcagggctcagacaagaaccaggacaaatgttttagggaatggagaacagatttgcatccactgctcaccagagccacctaacgacgacacaagaataaaggaagtagatttgcatgaagagacttcccttcctatgataagagaggcctggaggttcctccttagctgtgggctcagaagcagagttctggggtgtctccaccatggcctggacccctctctggctcactctcctcactctttgcataggtgctgcctcccagggctcaaccccatattatcatgctagctgtgccaacctggccctgagcttcggctcaacacagggagtagtgtagggtgtgggactctaggcgtgaaacccttatcctcacctcttctgtcctcttttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatctcacattgacacagacagatggggaagtgagacagaaaccccttcactatctgtgtcatcctctctctccagccccagcaggactgtgaacaaagccataaacagggctggcccagttcacctgcatctgagacctccaggctgcctttccctccattcctccaggtaggctctgcagaaggtgggtcaggatgatgtgaggcttgaaggaccaggctgttctgctgttgtttagactgagtgtgccttgcctcaagatgacctgaatggaaggaccacaagaaggagatgggcagctgttgagtggtcatgatccctggagttcctcttgtgtggtgactggatctaacacaatgcctgtactttgtggcccaaatgccctggattattggtctgaactccccatgtttaactgagaccctcaagccccagctccatgcatcctgatgttctgaacaggaaagtcttttctagtgagcactgtggcatcccttggcatcccagcttcacacagcaattccccaccaaaaaatgcctttgagtgcaaagaacggcttcatgcaaagatgtgcctccttcagaatgtagttcaggagcaataactacctgatgccttaatcccaaagccatattttaatttagaatgaccttgaaatgccttctagctgagcagtcagttgtaacacattcccagtcacgcctcccacacttctttcctgacagtatgtcatgaaaccctactgcatggaatcctgcctcttagagtaggattccagggatctcaaaaattgtttagaaatgaacaaaaacagtctagttggaagagtatcaaagaggaggcagttgcacatgcagagaactctgaggtctgcaaatatacatgaactgatgagcacttgtgtgtaaagaaacacctccgaaagagaaaagaaccacgcaaagactcttgagggaacacctcacagagctcactcccacacacacccacccacgcactcacagacactcacacactacagtcacagaggaaaggcctgacttacagggcatgaggttgactcatcagaagagctttgcctcagtactggggaaaaagtcaccctagacaaaatgctgctcaggtctcaactatgaaagtgtaaaagcaaacagaaaactcaaactgtttttctgaacagtaaagtaactttactgaattcaacaataaaagacagaaatagagaatgaactgcaaaagaattctcaacccagcaggaaaaatgcacaatgccttcatcctgtcaatatttcctgcaaggtaaccagaaaatatatgctatatcaaacagagaagtgaatcaatcccaaatggcaataaaattgcacacatgatagaccttgtaggcaaggatatgaaagaaattcttataactctattctattctacttgttcttgaggatataagattgaaaaatcatattaagtggatacataaaacatataaagacagacgcaagttatactcttataaatgatccataatatgtctgcaataaaaaatacactgaatgagactgattgcagattggattctgtgaaagaatagatgagtgaacttgaagatatggcaatggcagctattcaagacgaagcacaaaagcgtaaacagagtatcagtgagttttaggacatcttcaactgcctaaattggtataatgaaagtcattaaaggaggtaagattggacagggaagagaaaaggcagaaaaacaatttaaaggaacaatgaccaaaatttcccaaattttgtgaaaactagaaacctcctattccaaaaagtttaacatgtcccaaagacacacacacacacacacacacacacagagagagagagagagagatagagagagagagagaaagagagaaagggagagagagagatacaggtgaacaacaaaatgacaagaacaaatttggtttttaaaaatttttttaattttagtggcttcatagtaggcatatatttttattgggtacacgagatgtttcaaaacaggcatgcaatgtgaaatagccacattatggaaaattcggtattcattcactcaagcacttatcctttgtagtataaactattcaattacactcttttagctttataaaatgtacagttaagttgttattgactatagtcatcctgttgtgctgtcaaatagtaggccttattgattatttctaactagttttttcttacccagtaaccatccccaggtaatagttgatttcttattagaagtaatgcaagcctaaatcagtggagttacatttagaaaatattaaatgaagaaacttactacccaaagcaatctacaaactcaatgcaattcctatcaaaataccaatgatattattcacagaaataaaaaatcctctaaaattggtataaaaccctaaaagacgctgaatagccaaagcaatactgagcaaaaagaacacagctgaagatatcacactactagaattaaaatatgctacaaactatagtaaccaaaacaggaagttattggcatgcaatcagacactgagaccaatataacaaaatagaaaacccgtaaataaatccatatatctatatatagctgactttcaacaaagatgtcaagaatgtacactgagaaaatggcacaattttcaataagtggtgctgagaaaactggatacccatctacagaacaatgaaactagacacttatcctctccacaaaaaaatatcaactaaaaatggattaaaggcccaaatataacaccccaaactataaaactactagaagggaacttaacataggggaagaacaaattctttaggacattgttctagataaaaaattatatggccaagacttcaaaagcacaggcaacaacaaataatagagatatgggacatcattaaactacaaagttcctgaaaagcaaaggaaacaatcaacagagtaaagacaacatgtagaatgagagaaaatatttgcaaactgttcacttgacaagggcctaacattcagtgtatgaaaattttaaaaaaactgaaataactcattagcataaaaaaactaataatatcattaaaaatgggccaagaatttgaagagacttttctcaatagaagatatacaaatggccaacaggcatacgagaaaaatgttgaacatcactaattagtgagggaatgagaatcaaaaccccagtgagatacaatctcaccctagctggaatggctatgatcaaaaagacaaaaaatgcaaagctggtgaaggtaggtgacttcacatttctctagtccgattctctgggaacaatgagagtgctctgtctttgctctccctctagtaactatttttcacacgcaaaaatatggaccctagtgggaaataatgcctaagaccaccaacaccttaatcatttgttcatcacactagaaatgaaactgttttccaaataatattaacatctatctgtgtctatcgccattgtgtcaatgtctgtgtgatcctataacatttagaaggcctagaagaatgcccttgctttttgcaatatgaaaatggccgatatcatagatgatatagatatagatagatagggggttgtattttgaaatgtatttctctaaaggacttctttcacttcaaatttgaaattattcttgttttaaatgtcacaaatgataaaccttatagaatgataacacaattgtatgtgttataaagtcacagggtctatcaaatgatgaaccaatcattcggtgttgaggttagtagtattttttttatttcgattctcactaaatgagaacacgttttgtattgaggggccatgccctaaccataccacatcgtggggttgctcagagactgtgaggttctgcccacactaagccagaaggagaattttattcctaagccaggatgagaattttattcctcacactgctctctgcacttgtttgtatcccataatatcccccaaaagtgagcatgagaagttcattttttaagctgcttgttcattctcttacatttaatacatgtaccaaaaattgtcttcatttttaaaataaaatgttatgctatcttgtaatctataaccctatagaataatcttgatccatacacttttgctatcacaagcagaacaagatccacttcctctctctgggataaatcccatgaccgctgctctttgagcattatttttcttaagttattttttaaacagaaatttatctgacttaccttaaccaaatgtcttttcaaagtaaccgcatttcttttaagtgaaaaattaaatagttaccttctgttatcaagaattatctgaatacaaaatatttattgtttcaactttagaaggaatgaaaaacatctacaggttactaatctaaaaatgcaggctctgggtttctatggtgttaacatgtcttccaaattttaagtaacaggtatttaaataacatgaactttgttttcaaacttagaaaatgtttcaaccttttggctgggcatggtggctcaagtctataatcccagcaatttggaaggacgagctgcgagttttgtctgatcccaggagctcaagaccagcctgggcaacatgatgaaactccatctctaccaaaagttataaaactttgccaggcatggtggcactgcctgtagtcccatctactcaagagactgagatgggaggattgctggagccagagaagttgaggctgcagaaggtaaactgtagaggctaaaacatgataaatatttaattcatcacttaaaagaaatgttggttacattgaaaagaaatttgattaatgtaattagatatatttctgtttaaaaaataattgaagtaagccctgttagcaccactgcattccagcctgggcaacagagcaaaacctgttaaagaaagaaagaaagaaagagaaggaaggatgaggaaggaaggaaggaaggaaggaaggaaggaaggaaggaaggaaggaacgaaggggaaagaaaaaaaggaagaagatatttcaagctttacagtaccagagccactctgtaatcaataagcaacaggaccaaaacagaaagagattctgtagaacagtctaaccagcgatacaattatacatttctgttcagatatcaaaaccattttcaatagtaaatatatggaatgaactccccacagagatcaagtaggatgtatgatgtgtgaatgaaattatgagttgagagtaggaaatttataaatttaatcaaacaaattaaagcattatgaggaagttgtactgctaatgtattacttggcaagctgttcagtggaacaccaagatattcttaaggaagttgcaaatatcttttaaaatgttatcattgaagtggatttttaaaaaatgaggacatgaatacctttacaaagtattcagggataaagagagaaaaataaatttagattgtgcatacatatataaaatttattttaaaagataagcttgtcttttttatcccttaaataaaaggagcagatatttaaattccttgtcttttattttaaaatttagaaaatgcttacagcttcccacactgaaatttatactaagacagataatctaatcaagggataacaaaatcaaaacagaattctcttgatgaatctattttcttgatttttaagtctcagtgtgtactctatagtaaaactatttataattgattctgctgtttgaaaatatttactgatcgtttatcttgcaccaagtgatctccagctctgaagataggtcagtgggaaaacatacaaagttgcccagcttcgttaaacttaaattctaatgaggaaaaaagaagtaattaatcagggactttaaaacaggagtgttgtgatatggcttggaattctaactgcttcctgtgcttgctgtgtggagactggattgaaaaatagggcgatagaagcttaaattcatatagaatatggctagcctgtattttgagggcccctgaaataagaatgtatagtagttctcattatttcctcaagaaatctgtgcagtagagctttggccttgggagggaagtactatagtcaccaagtggtgagggtgggaaggtgaatttgcaaataccacttggaatgagttcactttaaaggtaaagctggcaggattttcatacatgtcagatctgaaaaaatgtgtgtgcgtgtgtgtgtgtgtgttatagagagagagagagagagagagtgaaaaccagacagataccgagagagaacgacagatctgcagtgacagagagaattaaaagcggacaccacgaatattgagctcagaaactataaaatgggaggtgccattaaacagaatggggaagagcaagtttgaggagtatcagtggctccatgtggacttattgattttgacattcctaacagatgtccaaatggagaagtcagacagtgttgtgcgtagtctagtgttaaggtatcaaagaaaatatcaggaaatgagtgacacaaaaattagtaagaaagcaaagataagaaacattagtcaaagtcctgagtccagtggttatctaacacccaaaaagtagtaggccgggtgccgtggctcatgcctggaatcccagcactttggaaggccaaggcgggcagatctcctgaggtcgggagttcaaggccagcctgaccaatatggagaaaccctatctctactaaaaatacaaaattagccgggtgtggtggctcatgcctgtaataccagctactcaggaggctgaggcaggagaatcgcttgaagcagggaggtggagggtgtggtgagccgagattgcatcattgaactccagcctgggaaacaagagcaaaacttcatctcagaaagaaaaaaaagtgataaagacaagaagaaaccagcaaaaaagtactaggggtaattatcaaaaatgtcaaagggaaagtaggttaagtgttctggaattctctcaaagaaagttttgaaaaaaggagggaggaagagatcaactgctttcaatgctgctgatacataaattaagacaaaggctgaggaattatgcttcaattcatcatttaacgatatggatattgtttgtgctttgataagagcaattttcttggagtgagtaggtgagaaaccatattggagtggtttctcaaaggaatgcctgatctctggattcttaaggaaactttttattgaacagtggaggcacaaattggatttgttttaattccggggtcgggacacactctaaacatgtgcctctgcatgcctcgcttattacagctaggtatcctagtatctttcagtaacagaataatcacctgcaaaacccacacccatttaatagacacgctttacaaagactgatactagaagttgttggagaggatgtggttccacgtaatatcttatgagtcactgatgggcaagtaagctggtaaaatgtctttggaaaactcactatacctgctatactaaaacattcagataccaaacaccagaaattccatattgtaatatatttctatgagaaaaaaacaagagccctgtattaaaatatagattattattaaaaataatcacactgggtttcctgatttttttattagcaagtcagtctctgcctgattcaatagtacaacctctatctaatatatatatatagtgtttttaatcaaccactaagaaaaagtattatattttatatcaattctacattcagtgccgaaaccagcattttgtagattccagagatttgttgaataaataatgaataacttaaataagttaatatttatagtatccatatacaaataatacatcatctcagaatacaataataacgtttgttatgcagaaaatgatttcaatctcagttaaaaatattttgggcttaggagttactgtcatatatggatgctcacattgttttgtttatacgaaaatgtttgtagttaacgtacgtttttggtacttaagccttttgttcttgctgccatagcaaatagtgtgcctattaggaacaagaaccagaggtttacttcatcttaacagatttcttaataaaatacatgccatactgtttggtttaatgcataagcaaagagtcattcactccgccattgctacgtgtccctcctctaatacggctcctgaagatgttaccgatagcagaggactttgtgttcaacctaagcactttatagccctttcactttcaactaagtatgagataaaataattcagcaccaataaaacaaacacttcttaaatactgaccctttttttgagcctgtttcacgttacgcagcaagacagagtacacttctctttcccagcaaatcagtgttggcactacaccctctacactctgaaaacttgtattattggcttccttagaaacacaatttgagcttataatttagatgtcatcaaataatgtacaaaaatatgctacttccttccccttcacttctcttctcttctcttcttatcagataattgtcagttgttttttctctccaactcctttcctccgactacctgatttttaaaagactttctgcacatttccaatcttagtattgtagagacaaaatgtgtggtcaaactgcatatataggaagagctgaattatatgcaagcatttttaaatacacaattcctcctcagttttctgtgattatttcatataatcaaatgtcttccagatacacatcccaaacgagtggttgtcaagctctgctttgtggtctaatttcatcagaattatccaaaattcttatgataaatacagataaattgacataactccagatttatgaaatcaacatttccagaacccaggaatatgcattgaaaaagtgtattcctcagatgatgctgacatgatacgggatccgagtttacaatgcaaggaaaattaccttccttgcccttcagctgacccttgtatccagaggtcctcttcccctttcatattctgccctctctccttctgcacctttctcctttcctccctccagttctgctcatccagatcccaagccctcccccatggattccctaaacctcccaaatggtcagttgccactaaagttccctctgtctcatgaacaagttatgtgggcaaatgtaaaatttaagcttggaccaagctgactcaagagcggcaattacaaatttccctaaacccagaggggaccagcaaacacttgtagaagattagagatttcctgtgagtgcaaagggctcagagtgtcctgatgctgtagaccaaatcttactgtcccctccaattcatgtgttaaaatctaattccctatgtgatgggatttggaggtgaggccttggaaggtgattaagtgatgaaagcagagaacccgtgaaggggatcagtgtccctatcaaagggacggctgagaactcctcatcccttctgtcatgtgaggacacagtacaaagatggccgtctatgaaccaggaaggaagccctcaccagacacaaaatgtgctgaccactcactgctgactccagtgagtcagaggagcgcaggccacatacctgggtctctgcctccatgcctcccacagtgcccagggctgagagcagagtggcagctgctgactggggctgtgctggccacctgctctcttctacctcttgctcaagccatgctttcagccccatggctgaggccagtggctagagcaggtgccatgatgtcaggcagctccttaatgggctggtccttggcaggaccagggcaggggcaggagggctctgcagctgcctctagctccagttctgtccctgaagggggctcttcccctagtgctggcactggctcatcagctggtgctggaaggtcctggattgccgcacattgagcaggagatgaaaaagaagaaagagtcaccaatgtcagtcactttccactggaatttccacacacagaatcagcctcactgaattaaaggaattccagtccaaaaacactgcccccgcaaagtctccaaaactacaggccccccctcaccatgtgcctgtgcctggaggaactccagaggctccagcaggccaaggacaatgcacggatgtggcccggatgggatcaccagtgaggcctggcctcgtagggcctgcccagggctgtcctgtggtacctgggtgcgccttcggccagaggtgcctggggtgaggaatgagcctgcatcggcatcatgggaaaaggctgtcactctgggccctcctgaagcaggagcctcaagatatgcggatgcagcatgagaacatcttgctctcctgagcatctcccaccaagggaactggctgcgggactgtctctaggatgtgggtgcctggttaccagaattctaagttctgtgagggtatatcaccaaggaagtgaagtcacttctttaaggttccgtatcctcagccccttccttccataagacctactcagaaccccctgggctgctggctgctcaccctccccccaggccagatccttacctgtacacaggtaagtccacccagggcctgcttgtacacgtgctcctgatgtgcacctgggacctaggaatccacttagggcctgtgatccaacaggggcctaatgttgtttaaaagtaatttttattattcctacaggaaagaaaaggccttctagcaataagaagcacagtttcacatcaaaaacataaaaatgatcaaaatcttggggaagaaatgtatcaattttaatcactgaaatgttaacttttgataaatatttaagtttataaggaaaaataaaaccatgctgataaaaccacagttgtagggaatgctatagagtttctcctttgtggtttgaacacagaaaggtcccacctagttaggctcataattttctaccttaatcttcttgttcttatgattaatggaaaaaataccatgacaatgatggtgatgatggttcaagtacacactgaggtttagtgacagaaacatcaggtgctcccagttacagtgcagctgttcttattggggtgggaaaatcaatcttgtgttcagtatacacgggaagcaggagtacatgtggatatgaccacatttcactggacttatattttaaacagaagatctacagtttattcttcaaaaaataataacacttgccatgcaaagtatatatataagatgtctcaaataattgtacttacattgcatatgaaagtgatacattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacaggggctgaggagtgacctggtgcaggaagccccatctccatccataggacattggtgtgaacccagggagaggcgctggtgtaagagagatgagaacacaggtgtgaaccacctgcttgtgcaggggactgagccttcacataagttgacacttaaaaagccaccacaccccacccttgtcaacaggaaacccattcacatctccatcagccacacaatctccaagattcttcaaaaagtaataacaatagccatgcaaagtatatgatatatatcataaataattgtacttacattatatatgaaaatgatactctttttgatatgctaggtaaataaaatacattatttaaactcattgacttcttctctttgtatttataacatgacaactagacagtgggattcccatgaggctcacatcatattgtgattgaacaaggctggtctgcagggcttcaggttacaggggctgtggagtgacctggtgcaggaagccccgtctccttccataggacatcagtgtgaacccagggagaggcgctggtatgagagagatgagaacacaggtgtgaaccacctgcttgtgcaggggactgagccttcacttggagccaaagttttctttcccaggttcaatcctgaacaagagggccttctggacttctttttgttttcaggcttgtgccccttcaggtttggggctgtctggatcccagccaggggacactgaggaaatccaggagtctcacactgactgttctatttcatctgctggggccatcccaaactgctgtgtaccatttcctttcctggtgctcaaatagctgctccatgcccttgtcatggtttcagagatgaatctaggtgggaagacaggacagtgtatgttataatatttaaatggaagctgaatccattaatatttattttaatatgaaacattaaaagaattttgtcataagcaatgaggaaagaggaaaagatattcaagttattttgagaaaaaataaaaatgtatttatcaaatgtctgtgtgtcttcagtgtcgcagggttgagagcagccagctttaggttgccctgaggatgcgctcagatgggaaaaagcgagaaagcaggaaacgcgtctctgtgacctgacagataaatcacagtaatggaaataagtctttcaataattcaaacattcacaataaatatcactctgatgcacacagaaaggcctggtaacaaactttccctttgacctgctggctcatatccccatggatcacctgtgtgcagagtggactctctggtccccatttctcaggctgagaactagaggctgggaaggacaagtggcctgctcatgagtgggaagggcgggattgggagcagcagactcgggctcaggactctggccctggtcagtgctccttgttccctccacagggtccctcccacatgtgcccgtgtggatgtgggtgcactgcctggggtggctgatgtgctccagggattcaatgcggcagatgcttcagcaccaaaggtagggagtagggatgggacgaggctgcagctgtggagaccagggacccatgatgcccagcagaggtttccacggggtgggtagccccatttcctgacagtagagacagcctagaggtgggtgccaagcagagggcactgtgccatgtgcccaggcctggagggccacagagacacaggcgccacacagcagagacactgagagccaggagctcactcaggtaagggatgtcagcagatctttctctcctgagcaaatcaggtacaaaaaaattaagatcctgccatcagaatagacaaacagggactttaatctcctcggctgagccccgctgtccagggaagaagaagtctctgagcccaggcccaggtgagggtggagtgaggagaggagctcagggtgcagatttgcataaaggccccgccctcctctgaggcagaggggataagacagggctggggtcaggcccagtgctgggatctcaggaggcagctctctcggaatatctccaccatggcctgggctctgctcctcctcaccctcctcactcagggcacaggtgaggcctccagggaaggggcttcggggacctctgggctgatccttaactcctgctcctcaggctcacctgggcccagcactgacttactaaaatgtgtttcttcctttttccaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttccacagaggtccaagttcctggggaactgagaccaaaacctgccctgggctctcaggccccctccttgctctgaagatgcttcctcgcccagtgcaagcggcttcctgcagtgcggccttgagaattcttctctctcagctccttccctttccaccatgaattccaaaaggaaacccgctctgtggtttctcatccaggacagggacagcttcctgatgcttgtgcgctgtggtccctcaatgtgcagctcttcccagctcttcaaatgcagggacagtgacaaggagctgcctgagtggtgcagtcactgcttttttcagggatgtcttcaccctacatgcatcaccatcccctacactgtgggtagaattttagcaactacattctaatggttatcgccacaactttgatcttaaataacagtgcagcgaacatccctacgcagactcctttgagttcctgtgtgaatatgaccacaggattcatttctaaaagtgaaattgcaggtcagaaagattgtgtgtttgtaattttcacccattgttgtcagattcccctccagagggattgtaccaattttcaatgccagctggaagtacttgttcagagtacattgttgaaagtggaaatttttgccagcttatcagacagaaaaatgttaccttgttacagttttatttttgagtctcctgttctgcttacattttggccctttcagaaatagttcagtactttttctttttttaggatttagtaaactttataaaaaatatccagataaggagaattttagtgtttgtgggcaggcacagtggctcacacctgtaatcccaagcacttcgaaagagtaagacaggtgaattgcttgttcccaggagtttgagattagtctgggccacacagcaaaccctcatctctattaaattaatgcaaataaaaataaattttaaaaagaattattttagtctttgtggcccaagaatcaactttagggatattacataggtacttataacatcatttacaatgtaaccatttaaaaagataaaaatcactgttatctctgggccatgcaaaaacagttgtcaggccaggagtggccacaggatgtggttgaacggtccctggtttgcagagttatctgaatgttgaaaattccaccagcatatgatctaggtggggatctctctgtgagggtcactgtatttcacctcctgtattcggctgaggtctttccttggataagaacatgctcacatcatctatttgatgggctcatgggtttgcccaagacaaccctgtgtcacaatcacataacttttatctgcattgcttgttctgagttttgggagagctttaatatatcaggaatagactcctcctaagggaaaagtctgagggatatggatgggcaaggggtcaagaaagcttctaccaaagctggaatatccagggcaggctcagagagaaggatcctaatatcagcatttgactgaagccaaaaccagaagagaacatggacgttctgagaataataagtaaataaacagtttaaattttaaatgtattgaatattcttatactccatgaaaattctagaacggaatttaacaatgggataaggaagagagcttgagatgttaaactataaagaccacaaggcaagttgccaggaaaagaacaggacctttttagtggaaataggtttctgctgcaaattacctttcctatgaaattggtttttaggtataaggaaacatcccatggaacattcttctttcctacagtcaagatcaccctcaccccacaagggaacctcaatatcaaatagaaaaaataatgcactttgtataaccattaggagagtctttatttgcacatcaaaatgaggatggttaatggtaacattggaaatagtagtttaatatgcataagtgatgaatttcttttgactataccatttctgtctgtgatttatctttcttaatagggacatactctgttcttaaaacaatttaacttgtgttatcttttgttctattatctgtatcagctctgttttttttttcaaacactggcaaagttattccatggttaatgattattaaattcaatttatggatatttagattatttaaattatttcaagagtggacagatgtgatttccccacatatacctcacagatgttgctgatgctgacttgttcatctcttccaacctctgcaaacaaagtgggaaattggatttttctgaacacccagatgacaacgggagaggaggtgaaacccccctaaagctgttatcctttaacccctcatggtgaatctcccatccacacttgagttggatgatatgtaaatgagagtttggtcttagagttggtgctgagttagttcaggatttgggttattgggatggagtgaatgtgctttacaagtcaaaaactatgagtttttgtgtgcataggttggagagctcttggctgaattgtgtcccccagaattatacaatgaagttctaatgcacagtgtgtgactgaatttggagacagcctttacagaggtgattaagtgaaaatgaggtcatgagggtggcttcttctccaatctgactggtgttctgagaagagaaaatttgcacacatagaaatgagacactagagatgagcatgcggaggaaaaaccatgtgatgacacagcaaggaggtagccacctgcaagccgaggagagaggcctcagggaaaaccaaacccaccaacacctttatcttgactccccagcttcagaactgtgagaaaataagtgtctgctctttaggccagcaggtctttggtatctcattaaggtagcactagcaaatgaaaacaaaagggaccccaaagaccttgggtgccagagaaggaggagatggaggatggtgcaggaggcggggcagggaggggctggaagttcaggctctgaggtgcatctcttgggtgcaatcctgactccactcactgctgtctggggacttggggaagaatcattaacctcccaatattaattccataataaagattgggtcttgagcatagggctgctcatcctcctattccatatgatgcaaatcttcttgaggtcatgcttgtaaaacactcagcaatgtatctggcatacactatggcctcagaagtggttattctgaattttctagtgatacatagagaatggcattgttcctgtgggcagaggaggcactgtggaccttggtttgaggactcagaaagacaccaagtcctctggtagtgctcaagtgcgaagagcgtcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgcggagtagatttgcattcactgctcatcagggagcccacccaacaaggatacaagaataaaagaagtagatttgcatgaagagcctctccttcctatgataagagagggctgaaggtccctccccgctgtgggctcagagacagagctctggagcatctccaccgtggcctggacccctcccctgctcaccctcttcactctctgaactgcctcccagggctcagcccccaaaggaccagagatcagcctggacctgagcttcagctcagcacagggagtgatggagagtgtggggtctgggaatgaccctcatcctcataattacctcttctgtcctctcttataggctttgtggcttcccgtaagctgactccagagccagcagtgtctgtggacagtcagcaagggtaacctgccagggagaaaacctaagaagccatggtacaaactggtaccagcagaaccctgccagatgcctgtgcaggtcatacatggtaacaacaaccagccctcagggatcccagaccgattctctggctccaagtcaggaacacagccaccctgaccatcactggggctcaggttgaacatgaagctgactattaccgtcactcatgggacaacagtggtactcatctcacagtgacacagacagattggaaagtgagatctaaagaccttcactgtctgtatcaccctctttctccagccatagcaggactgagcagggctggcccgggtcacctggatcgaagcccttcaggctgcccttccctccagccctcccggcagactgcagagagtaggtcaggataggatttggggctggcagaaccaggctgtcctgctgttatttggaatggatgtaccttggctcaagatgacctgagtggaaggacagtaagagggagacagctactgagtgctcatggtcactgaatttcctcctgtgtgttgactgaacccaagacagtgcctctactctgtggcccaaataccctggattatttctctgaactgcccatgtttaactgagaccctcaagccccagctttgtgcatcctgatgttctgaacatggaagcctttcataatgtgcactgtgacatccttcagattcccatttcaggacttatgcacccaccatccacccagggctgcagggagttcctggcttctcacagctcttccccaccagaaactgccatgcagtacagagaatagctttgctcaaagaattgcccatttcaaaatgtgtttcatgggcagtgactccctgattgccttaatctgaaagtcatgctttaatttaagaccctgaatatcaaattgaagtgccttctagctgaacgctcaattgtaaaacattcccagtcacacactccacacttctttcctgagaatgtatcctgaaaccctactgcatggaatcctccctctcagagtaggattgcagggaactcaaaaattaaaaacaaacaaacaaaaaacagtctagagggaaaagtattgaagaggagagagagagtgcacaaggagacaactctgaagtctgcaaatattcatgcactgaagagcgcttgtgtgtacagaaactccctctgaaagagaaagacccttgagggaacactccaaagagcgcgcgcgcacgcgcgcgcacacacacacacacacacacacacacacattccagtcacagaggaaaggcctgagttatggggcatgaggtggactcatcagaagagcttcggctcagtattgaggaaaatgtcgccctagacatagggctactctgctctcaactaagaaagtgtagaagcaaactgagaaaagttaagacagtttccaagtaactttactgaatccaaaaataaaagacgaaaatagagaagaaaatgcaaaagaattataaactcaacaaagaaaacttcacaatgattggcattcaatcaacatttcctgcaaggaaaaaagaaaatatatgctctaacacagagaaaaatgaatcaatccaaagtggcaataaaattgtatacgtgatagatagaccttgtatgcaaaaattttggagcaattcttataactcttctccttgctcatgaggatagaggattgattgaaggtgttaagtgaagaaatggaaggcatgaagaaaaatccaagtttaacttttagaaatggtctctaaatatctgcattgaaaaaatgcactgaatgagaatgattgcaggttaggtgctgtgaaagaatagttgagtgaacttgaagacatggcaatggaagctattcaagatgaagtacaaaaaaagtgaagagagcaccagtgaatttcaggacatcttcaagctgacttacttggtataattaaaggcatgaaaggagataacattggtgaggggagaggaaaggtagaaaagccgtttaaaggaatcatggccaaaatttcccaaatttgttgaaagctagaaacctacaactccaaaaatcttaacaagttacacacacacacacacacgcaagtaatacaacaccaatactcatcataatgatattgctaaaaaactatgataaagacatacttttaaaagtagccatagagtaaagacatggtaggtacaggcgaacaacataagaagaagaacagatttcgttttctttgtaaaattttcttcaacatctgggggaacatagtagatatatgtatttgtggaatacatgagatattttgatacaggcatgcaatgtgaaacagtaacatcatggagaattgggtatccatcccctcaagcatttatcctttgtgttacaaactactcaattacagtattttaggtattttaaattgtacaattaagttgttatcgatgtgctatcaaatagtattgacataactctgatgcgctatcaaatagtaggtcttattcattctttctattttatttacccattaagcatccacaaataagagcagatttcttcttagaagtcatgcgagcaggaagctcgcatgtggagctatatttataaaatattaaaagaaaaaacttactacccaaacccatctccagaccatgaatttctctctggatatcttattaaaatattgtctcctatcaaatctctatcaaaataccaatgacattcacagaagcagaaaaaaaattctgtaactggtatggaaccacaaaagcccctgaatagccaagcaataccaaacaaaaaaccccaagatgaatatatcacattatctgaatcaaaatatactacaaattatggtaaccaaaacaggatcaatggtattggcataaaatcagacattgagactaataaaattgtatagaacacaccaaaataaattcatgtatttacatccaactgattttcagcataaattccaagaacatacattgagaaaaggacgcacttttcaataaatggtgctgagaaagtggatacccgtatacagaagaatggaactagacccttgtctctctccgtatacaacaatcaactcaaaatctattaaaaaccccaagtataagacccaaaactataaaacaactaggagggaacgtagaggacatagggaaagttcttcaggacattggtctagacaaaaattccatagctaagacttcaaaaacacaggcaacaacaaaaactagacatatgggacttcattaaactaaaaatcttctgaaaagcaaaggaaacaatcaacagagtgaagacaacttgtagaatgagagaaaatatttgcaaacaattcaactcaaaaggacctaagatccagtataagaaaataagacaaggagctgaaataactcatcagaatagaaaaccagtaatagcattaaaaagtgtacaaatgatatgaatagacttttcacagtcaaagacatacaaaaggccaataggttaattaaaaaatgcccaatatccctaatcaccggggcatgcaaatcaaaacctccatgagatatcatctcatcccagctaggacagctatcattaagaagacaaaaaaataacaaatgctggtgacgatgtagcaaaaatagaagacaaaaccacatggtcatctcagcagtcacatcaaatgttttcatgtaaggaaacattaccatttgctgtttttctagtcttgctagagcaccataaaagataagactagtggtgccaatactgtagaaaatgttattacatgcagagaatctcactatcccataccaaactacatggattcttactgttaaatgctaaaagattacaactctgcatttccaaatgttctggtggtcagagaccacttccttgacaagtgatgagtacggtgatgtgaaaggatagttagcatttacgcaggtattgggtgaagaatagtgatatacacaggaaagctttcaaagagagaaacacatggaggttggaacacagaagagaacataatatgtctgagaaataaagaaagtccagactcactggagctgagtgagaacaagaaaaacggcatgaaccatgtatttcactctggatatctcattaaaatattgtctcctccccaacacaccaccgatgtgaattgtaaaaatgcccgttcttaaattattttttgcacatcatgacagggtcaagcatgtgaatcaagctgagtttgatgagtccaggtctgtctgatgagtccagacccaggtggcctcagaaggacttggtggaacgagggcttgttgtcaaaagtagaggaagtgagattttccattgtggcttagacaagagattcttaaatttcagtggacacacaaggcccctgaggggtctcggtaagatgtagatgcagcctcagcagttctggatgtggccccaaattctctgtgtccagcaactcccaggtgaggctgctgctgctggtcctcccaggaccacactttgaatggcttagctcttattcacccacctcactcaagccacaggtaagactcacacaaggagagcatattctagaagcacaggtcacttctcactcctccccttgtgtcttagatccttttctgttacaacaaagaagtacccaaggctgggtaatttatagagaaaataaaaggtttatttggctcacaattccaatggccacagagttcaagatatggcatctgctcttgttgaagacctcaggctgcttctagtcatggtgaaaggtgaaggggagccagtgtaggcagaggtcaatgggggagaggaagcaagagagaagaggaagatgccaggctcttttaaataaccagctctttcggaaacagtgggaattcactcaccccaagtgaggacattaatctattcatgagagatccactcccatcaccctaaaagctcccattagttcccacctccaacactggggatccaatttcaacatgagatttggaggcgacaaagatcaaagccatagcaccctgaggtttggccacgcacttgctcatctccacatttgtccctcccctcatgactggggtcctgaccactctgactcagtctccctccacttcatggacacctggcagtcggtcatcatctgttttgctgaatcaacagcagtattgggggtattcaacattccacatttgtattgtttgaaaattgcccaatcttaggtgttttgttattgctacacaaacagactaagacatttactatttaatggttacatttcattctctttttatgaaattttgttgctaacagggactttctgcttggtcagaagattaacaattgtgtctcctggttccaccagaaacagagtagagacccacacagctgaggtatggggtcatagattaaaactaagagacataagattgattctcaggctccaagtctggcaagtgagcttctttgagactccctgggatctcagcagtcagactgatcattattgctgtcccaaacatcctatgtgatatggaagtaatatcaaaaccctcctgagattcctgacttgtgtcccgacatgaagtctgttgggattcctgtcattccttcaagattgttcaaataagcagcaacaatcactctcatatgagatatgaaaagaagaattccacatgaaccaaaccctgaagcccacactgaagtctgccaagttatctgcagtccagcgcgatggagggagcattttcgtggggacttttgagagtatggagaaggcctgaggaaacgaggctcagctatgggttccagaaacaaagctctgggatgtctccccatggcctcgacctctcacgtgctacctctcctcactctttgcacagatgctgccccaggctaagcccccacaggaccctaatcctagtcctgaccctgagctcagcccaggtgatatttcaggagatgggaccctgagaatgagccctaaagtctccttatcctgcagcccctgtggtctcttagactcagctacccccagtagagttggccatgagacacctgtcccccacctgctcaggagagagtgcagcaggcaacagtgcagagagaaccagcaggagccaggccaggcgctgcattcagagcagcccccaatccaacagattctccagctctagcctggggtacagcccccaccttctgcgggctgaagtgggcttctcaggatgggcaggccatgatggggattggcagtgtgtccatgggacacagccctactgcctgcctggccctcatgccccctccctccccatcctggttaagcaccaccccaacgggcccagtttcagaactcaggacacctgggccagctcctggacttgcccccactgctctctgttctcctgagccacttagtctcttttggcctcagtgttacctgctgtgaagtgaggagccttatactgaactgaggaagctctttcttcattcaaaattaaaagacagaaaaacaacgaaagtcatgcgaattaaagcctgatgaggggatgtcacttaatgggcttcaatgggcttcagacaaaacttcttgtctttcctctgcagggattccaagaaagggactcaaaaagagcttgctttctgtatggtgggaagagcagtccccagctgagaataagcaggagagtcccagtttaatcaggaagacagactagggtagtgtagaaatcctctcagcacaaactctgagaagtatggaatgaaataaagacaaacaagaaattaatggtgccgacggtggtgatgttagctcacagctaagctgcagaaccagaaacatgcggtgatgggctgagtctcctccaccagctgggggcagcagagctgcagccaggagctttcaggagagaggctggggctgcccagctggggcaaagagaaggccagcctggggttcaacaggtgtccaagaatctgtcttcagactgaaagtgagtgcagttcatcctatcccctcaggcttcagtgaccacgctctgagggtcagacacacggtgtcaccccaggacactgacagaagcctggcacagtgaaggcctcaccagggaaatgcagctggaggaggctgggcccagatgtgagcttgggcagcttcctcaggaaggggaatccctgggaggcgtcccaaggtcgaggtgctctaggagggggtatagtgtgaggtgatggggctcccagggcccgggttcttcacccaggatggcggcctgagcctcctgccactctcagggtgtcatccctcctggtccagcagtgtcctggggagctgagccctctgtcctgggcacttccagatacacccgacccctcctccctctgcctttccttccagctccaggcggactctgactcagggggcagctcctgtactcaggggagtctcgggtgggtgtggtggggcatttgggaccctggccctggatgggcatccccagcctccttcaggagacactcttcagagggacagggcttctcacctgcctcaggccacagctctgaccatggtgctgtccacgctcagtgacaggacactgagcaggggcctggctggagtaaccagggaccacccaatctctggagctcacatgctgtgcagagaccatgaccctgggacccttacagagaccatggacctaacgttagattctcagtccagtgtggttttctgctgctttttgcaagtttacataaaatattgatgagaaaaacatgaataaataacagacaagttgacggtgctgattgctaatctcttgtggcaatgaggggtgatgtagcaggagcagcaccacgactgaaatgagaccagatgccatgttgactccacaggggtgtgtggttgcttaaatgacccaaatattcccactgaataatcagcaagtgtcctaatgacacagcacagcatttagatgaaatgaacaagaggggactgagtctgagggaccaggaggaggaagatcatgggtccctgggccacctgctgctgagtcaggtgtcatcatgatctctccacagagcccagctcagccccatggccaacctcctggaaggtccacagctctgctgagcctggcccaggacagaccccaggtcagcgaggtttgggacagtggtcatgaggttaattcccacaaaggtctatgatcacagggcttgaaggctgcagctgattttctaaccagagaccctgcttgttcctcctgttgcctgtgctgccctcacagctggtttgagagacatctctccaggaagagccacagaggatgtaaatttgcataaacgcttaacactgactgcccccgaaagcctgagagggaataagagaggcctgcggagcccaactgttctgtgggtccaggaggcacagctctgggaatctcaccatggcctggatccctctcctgctccccctcctcactctctgcacaggtgctgaccccaggcccttccccaggctcagtccccacagattccaagttgagcctgacctgaatcctgagcaaagcccagacacagcctctgggtgggactcctggaaatgggtcctttgtcttcaagccccctctcttgttcttccttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtacttatcccacagtgacacaaggagacagggaagtgaaacataaacccctccccctctatttcatccccttccttctgccccaggaggactgtggacaaagccatgagcaggcttggccaaattcacccaaatttgaacccccaggctgcccttccctccagccctccaggcaggcgctgcaaaggagtcagtctgcagtggatttgtgcctggcaggcctggcagtcctgtgtttctttgcctggggtttgagttgttgatggagggtctgactggaaagacagacacagggagacatccatgcaggcatgtccagagggatgtggggaactctcaggtctcagttcagtgcagtcattgttgtatcctctgggaaagcattcctccagtgcacctaagacctctagacccacagagcctgaggtcgggatgagagaatgtcaaatttttgctgatggatcactaaaggcatttttgagtggagccactacaatttactccttgattctggactcgtggatcctgactgtgggagaaacagcaccatctattgggcactgatgcacagcacatgccccatcctggaagacattgcccaaccctacacatacttgccacttgcctggtgcagtaatggagtctccatgcagtcattaaaccattcatataagccacatgtctcagaatgttggggacaagagtaagaatcttgaatgccaggagaaaaggcccatagccctttatttgcggtgaaacgagttccttggtcagaacctcctgtggaataccatcgtgatgggtgcatcattctgtaatccagagataacagttttggcagaagcattgctgtcaatgaaagcaaatcctctgtacatgccaatgctagtaaggaaaaagagctgtctctcccatgatggaagagctctaatgaaattaatatcaagcaggcccctggctgttttccacagagaaggtcatcctatagggatgcctgtgttggtctctgctgttgacagattgtcacccagcagtggcttcagccaggccagctccagttagtggaaattcacattgatgagcccattatcagcctctatccctgccaccatggccacatttttttggagtctgttggacaatgacaggagtggttgacggaggctgcctggtgtccatagaacaggtcaccctactcacctgattagcaaaatcacttcattttcacagaagacttagtgagtatttatatatggaaaaaaattctcatgctttttgcccactggaggaggtctactcacacatctctccccctgacatatttgtgatcagtattcctgttgtatctctcccaagttcctgaacatccttgaccatattccaggaccctgagtcacagcccatgaattaggaacctctgcccatctctttgcaggtgacatgagccaattacactgcttaaaattctgctttaaggagaatgttcttccaccactgctgttcagggattctcagaggccaggtggagtactagcaccgttcacaccagtggtggatgcatgtcctgcagaaacatctgtaaccccagcctaattgcctcctactaggcagctgatctcagggagccactctggaggccaaggctgtagggtgagaggaaggcatggtgcagggcttgggtcatgtctgtttggccaactcttcacgcaacttacttggccctcgtaacctaatccctcaagtcacaaatacatccctgccgtgtgattggggagctgcctaaaatggccacccgggactgtgtttcagacgaaatccagcatatcagcaacttgagtctcgtggtgagctctgtggccacaatcacacagagcctctgccaaggctcaggagccctcgcagtctttctcaaatggtgttttctgctcattcaaaacaaaataagtaggggggggggctgctcacgtgcttccagtctgggacactaggaccacctaaaccacacccacgatcttgtctgattattttgattccttgttggctcagttatgcattatggcaaccaaaccacagtgtcattggccataaaatgccaatccttggtccccacctaccctgggatcccctcaaccacatcttgctacccagttaaggtttcagcaacactgagaaaaatgtatttttatattgagagaggaaacattctttcaattgtgaaaaatttataaggcaggaatgtgaaaatattttaaaagacattttacaaagggtgaaagaccctccattaaaccactcaatatatgacactgtaattggcctcccaaaccctgacttcagctctgggttgggaccttctgtaaaggggcctttcatcctcaagccctcctctcctctcctctcctctcctctcctctcctctcctctcctctcctctcctctgctctcctctcctctcagcctgtgcctcctacatacagagacagctgctctcagtcttggtggccctgagactgacaaccatgatcacatgctctggagataaactcaggataaacatacacttaggaaccagcagatgccaggccaggcctcggtgcttgtaatctggtataacagcaagtgaccctcagggacctctgcccaattcttaggctccaaatcaaggaacatggccaccatgaccattagtggggcccaggcccgcgacaaggctgactattactatactgcagataataacagtgggagcagctggcagggactcatagtaacacagagagatagggactagccacagtactgtcccacctcggcctgcctctcattctcacctgccctctgagcagctataggtcaggcctcagggtcaggtgtcctctctggtcttaacctggcccctgaggggctggaggttctgagcagcttctccatcctctcagggcctgcatgtgtccaatgagaagtggacagggtgaaggtggtcagagctgccaggacctttgtcaggtttgtggtgtacatgaacagtttaggaatccacacaaaagcacatggtcccagttgtaatcatacgtcatgcaggggaggagagagctgtcgcagagggcacagtcctgcagaatttctcctttccttgggtaaaaccagctcagtggaagccccaggggctgtgtctcctctggtttccagatgagttgacccccacattctaataggttgcctgatgcctgacaaggactggagacccagccccttttggcctcagggccctttctgtactgatatttctcagaaactgaagaggaagcacagacactacctttggtcccacctgggaactgtgtttggggcacactgacctcccatggcccccaaagtcccatcaccttccccaggtaggtcagtcctgactggatgtgcccccagcgccctgatagtttggagtttatctttgggctctgggctgctttctgaggagctcactaagaaacccttgatgccaggcccaggacctgcgcctctgctgcatgtcccagggctgcaggtgtgaagggagggtcctgctgggtgagggtgatgcccttttccaggagagatgtctgattccagtctctagggccacatttattgggctttcttttctcactaggatgtctcagtctttttatttccttctttaaaagtacaactggtttagggtgacctgctcgggtccccttccacattgtagaagctttgttatttcactcttcacaaaaaatctcgctgctgctcactctttgggtccatgccaccttaaaaaaaaagtacaactggtttaatcatgaaatcatgtgtacacactgaagtttacagattattgccatcagcatatatatatatatatatatatatatatatatatatatactgtttctggttgggacaactgtggacaaggccatactggggtctctgtctctctcgttatcacaagtgaggatactaacagctctcttttatgcagactgtggtcatgtttcccagttgcacacgaatgtctcttatggttgtttagtttccttaccagccaagacccttaagttttcatgcagacaattggatgttatttctctctgacccaacatttttcaaacagtattccttggaacccaacaaaagttccacaagaaaagctcaagtctctggtgcacagttggaccaggttcattgtgtgcagtaggaccttgctcaagtgatgggtccatttgatattttcactatcaaggggaagggtgttacgacttttgggcactgagttgatagagggaagatagcagctgatgatggccctacccaccaatgtgtgtgtgggcagtacctattgatggatttagaagttgagggaactgtttattctgcagatggaatttccagtactgaatctccagcacccagccactagcattcagcaggtgctctgtaagaagaccttcactgccaatcacagccattacacaggtgaaggagaggatgacttttaacagccactgactcacagtaaactgaggtagaaattcagcttcacaaagtgactttgagggaacagactgaggaagcaggttaattattcgctgaaggctttgcccagagcaggaacaatacagggttgatgaggacgtagggatgccctggtgtggaaggaacaaggcctgaaccaggagcaggaagaagcatgggaaagaccacgctgccacatgtgatgagtcagcacatggaaggcacagcaaatgttgcgcaaaggtttttgtgtaataacctggcaaacagctgcttctctatccagattcatgagccaaaaaatgttactgatgcattgctgtcacatgttaaaatgctgggaagcatggtgacattcaaggaaacctgttctctgcaaacacctacccaccggcacaggagacaccccagctatgccaagggctttgtcttcctctggagtaagagcctgggaacaatcaggtggcccctgaaaggggtgccgcgtcttctgctctgcatggctgagttaattggggaactcccagagaacattccagaaaacagtcaacctgtctgtgctgggtgcattgagcatgacccaggatcaatggaagagacagaagcttaatttccttatggctgcaaggtgagcactgggaggacggctgaggcaggttagccaccgcccctgagtggcttcagccccaggcaaacagggacaggtgaagggcctatctgagcgcacctgtatctaaccagtcccagcatcagcaactgcatcctgtggaccacgagggggtgtgtgtgcccagcccctcacagatcacctgagcataaacaggaaattctccaccttacacccgactgcacaacacatctgcctccagctcttcatttacaaggtgatatcacatcagacagggactgatctgggtcccagatccctcaggtttccgctatcctttccagtccccacacagagcagactcttcactgcagggtgttgagccagctcttcccctcacaatgcctgttacaggtttacaagttactgttctccaatatgattggggtttgtttcactgtttctctatatatatatatttgcattttcttgggtaagctgagccccttgtacctggtcttgagtcaggcaggggccacacagagaagaggacttcctcccctggcaccagccgtccacagatcagggcatcaaggacctgagcagcaggttctgaatccacacctagaccccggaagtccctgagctcccagccgacagtgtggagcagccaccagggggaagcagagaatcaactggcaaagcgacctggggatggggcaggcctgggtgatagggagatgctgacatgcagtaagagccagtgaccaccacctcagatttagagggaaagggtctttattgtcctagagtattgtccttgacactgatgtaaaaattctagaatcacattttgtcttcagctcttttgcatgctgactctttgtctgacacagatccaggcacttgacttctcacaacgccccctcctccacacccagttgtgctaaaactgcatccccctcatgtgcagtgtcctctctgaggtcacaggtatccccctactcccatttgatctgggaacccctgtcctgcagacatagtggctggcttctaacttcctagctgcccctccacatccaccgtccctggtctttcccgactctctcctggggaagctgccaaatcacagctcttgatttcctggtgagtcacaaaatagttgctcattaacctttagttgacttaagttcttatccattgatacattttccccagcaactggagacatcatatttataataaacattcacttctggggatcttggagtttgcagccccctctcattctctcatggagcaaacatttccttcacctcctcatctgtccctggtcctgacagcatcctggagatactgaggcacagcagcaatgacctacctagaagctcacagccaaggcagaaacttccagcatctcatggatcttccaacactctgtgcgcacttggcaaataaggaatttcattgacctctatcactcagaggttgtgggctgtggtgggacccgcacctgtccaaggtgtgcattatcacctgtacagtggagacgaagagggaacttgcattgggttctggaaagtactgtctaaaaatagatttagacctacaccagaaatgtcctctctaacataaaatatttatgataggacacattagaggcctagaccaaaatgaaatacctccctccagagccaagatagaatggaggaggggactggggaccccagataattccacagttaccagcatgactctatggtcacctcccagaccaggtcaaaacccatcccataggagggacttcatattcctttgtaaatacagacaaagtcacctctgagctctgctgtgaccaagggagcccaggagtgaggctgagcacagtgtgatgtggggatgtgtgcagagaatatggaatcaattcataaaggagatcctgtgggcaaagggtgggagggcaaggtcacccctaacctctttgggtcccttggggctgtgcccttctcgaaatcacaaggctcctccagcagcagcccctgactctgctgattggcatcatggacccttctctccaacaaggggttgagagacctgggaggagcctgcccagcctcagacttgagaagcagcattggaggcacttcagccatggcctggcccctcttttccttggtctcctgactcactgcacaggtgctgcccccagggtctcacccacctgcccagccccaggcctccaggttcagcctggccgtcagtctgagctcagcagggccctgtgtgtggtgggcaggatgctcgtgaccctgctgcagggggaggggctggttggggtgaaatgcccccactctgtgctcctgtgctcataggtgccctgagagctcttttattcctggggctcactccagccctggcaagtagccagatatccttgggttgagaccctcagtttcaagttttttctgtccccttttctttccttgtaggctctgtcacctatgagctgacacagtcaccctcagcgtcagtggccccaggacagatgaccaggatcacctgtggggaaagcagtattggaagtaaaagtgctcaatggtaccagcagaagccagccaggcccgtgtgtgggtcatctatggggatagcgggcggccttcagggatctctgagagattctctggctccaacttggggaacgtggccaccctgaccatcaacaggacccagggtggggacaaggctattactgtaagatgtgggacattagcactcctcatcccacagtgacacagggagatgaaggagcaaaacacaaaaacctcttccattggtgtcactcttgtcctccagcccaggaagacagtggacaaagccatgagtgtgtgttgcccagttaacctggatgtgagacccccaggctgccctttccacaggccctccaggcaggctctgcagagggggcatcaagagtgaatttagggctgagatgaccaggatatattgaggtgtggaggaatcagttgtgatttggggaagtggggcctggttggaagatcagaccaaggtcgacatgcttagttgggctctggatttccatagggggtgaaggctagtccttgggctgaatatcctgagtcagtttccagaactgcccagctcacgttcccgtggcatcctgccattctcttcaggaaaaccagtggagtggacactgtgggatccacccatattccctcttctgagctcacccacccagcactgctggtagctctggcagctcagagctgtgccctcactgagaagggctgtcagcagagaaaactgtctcctccaggtttatgccccttcttagcaaggtgtggtttcataactgcctgaggtgaagctctcaagactccctttcaatatgggagaaacagaaaatcctcccagcttcacagctccttattgggatggtagaagactcaatgtgggtcagagtgtccttgtgcccggtgttgcctccctcacttagtttcacacctactgtgaaagcaaagctccatctcagagtctgcttccaggcatcccaaaataacataaccagtcatcccgaacgtgagccatcaggaacctcaggaggccacagtataccagaaagcaccagtttattcctaatgatcattgtgagtttgcaaatgcccaatgagatctgagtgtttcttgcatttgtatggaatgaaaagggccctggcatgccaggcactgtggggtctgagggagagttggagtcagatctccctgcagggaaacctggggcaggaggagcagcctcatcccatgcagggaccacagatgcacctgcagggtgagctgcaggatggacactgcccacctccaccctccacattctgtgcaaaaaatcattctttccacccctccttcagcctatcaaagttgacacttaaaaagccaccacagcccacccttgtcaacaggaaacccattcacatctccatcagccacacaatctccacataaagattcttcaaaaaataataacacttgccatgcaaagtatatatataagatgtctcaaataattgtacttagattgcatatgaaagtgatactattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacagtggctgaggagtgacctggtgcaggaagccccatctccatccataggacattggtgtgaacccagggagaggcgctggtgtaagagagatgagaacacaggtgtgaaccacctgcttgtgcaggggactgagccttcactttgagccaaacaagcttcttttcctatcttcaatcctgagcaagaggactttccggacttctttttgttttcaggtttgtgcccctccaggcctgaggctgtctggatcccagccaggggacacagaggaaatccagaagtctcacaccgaccctgttgtatttcatctgctggggccatcccaaactgctgcgtaccatttcctttcctggtgctcaaatagctgctctatgcacttgtcatggtttcagagatgactctaggtgggaagacaggataatgtatgttattatatttaaaaggaacttaaattcattaatatttattttaatatgaatcattaaaaaaatttgtcataggcaatggggaaggaggaaaagatattaaaattattttgaggaaaaaaccaaaattgtatttctcgaatgtctgagtgtcttcagtgtctcagggttgacagcggtcagctttaggttgtcctgaggatgtactccattgggggaaagcaagaaagcatgaaacacacatctctgtgacctgacacataaatcacagtaaaatggaagtaaatcttttaataaatcaaacactcacaataaatatcactctggtgaacacagaaatgcctgttaacaaactttccctttcccctgctggctcatatccccatggatcacctgtgtgcagagtggactctgtggtccccatttctcaggctgagaaccagaggctgggaaggacaagtcacctgcttgtgagtggcaggggaaggattgggagcagtggactcggtctcaggactgcggccctcaggaccaatgccacctagcagaggtttccacggggcgggctgccccatttcctgacagtagggacaacctggaggtgggtgccaagcagagggcactgcagggtgtgcccaggcctggagggtcacagagacacaggcaccacacagcagagacactgagggccagaagatcactcaggtaagggacttcagcagatctttctcctgagcaaatcaggtacaaaaaaattaagatcctgccatcagaatagataaacaaggactttaatctcagctgagctccactatccaaggaagcagaagcctctgagcccaggcccaggtgagggtggggtgaagggaggagctcaaggtggagatttgcatgcaggccccaccctcctctttggcagaggagataagacagggctgggggcaggcccagtgctggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctccacagtggtccaagttcctggggaactgagaccaaaacctgccctgggctctcaggccccctccttgctctgaagatgcttcctcacccagtgcaagcggcttcctgcagtgcggccttgagaattcttctctctcagctccttccctttccaccatgaattccaaaaggaaacccgctctgtggtttctcatccaggacagggacagcttcctgatgcttgtgtgccgtggtccctgaatgtgcaactcttgttagctcttcaaatgcagggacagtgacaaggagcttcctgattgatgcagtcactgcttttttcagggatgtcttcaccctacatgcatcaccatctcccacactgtgggtagaattttagcaactacattctgatggttatcgccacaactttgatcttaaataacaatgcagcgaacatccctgtgcagcctcctttgagttcctgtgtgaatatgaccacaggattcatttctaaaagtgaaattgagggtcagaaagatgtgtgtgtgtaattttcacccgttgttgtcagattcccctccagagggattctaccaattttcaatgccagccggaagtacttgttcagagtacattgttgaaagtggaagtttttgccaacctgtcagactcaaaaatgatacctgttatggttttatttttgagtctcctgttctgcttaagtttgggccttttcagaaatagttcagtactttttcttttttaggatttgggaaactttttcttaaatatccagataagaagaattttaatcttcgtggccggacaccgtggctcacgcctgtaatcccaagtgtgttggaagggtaggatgggtcaattgcttgctcccaggagttgagattagtccgggccacacagtgaactctcatctctattaaattaaagaacataaaaataaattttaaaaggaagtattttagtctttgtggctcaagaatcaactttggggatattccataggtatgtatagcatcatttacaatgtaaccatttaaaatgataaaagccactgtcagctctaggccatacaaaaacaggtgtcaggccagggatggccacaggatgtggttgaacagtccctggtttgtagggttatctgagggttgaaaattccaccagaatatgatctaggtgggaatctctctgtgagggtcactgtatttcacctcctgtattagcctgaggtctttcattggataagaacatgctcacatcatctatttgattgtatcatgggtttaagacaaccccgtgtcacaatcacataacatttatctgcattgcttgctccgagttttgggagagctttaatttatcaggaatagactcctcctaaggcaaaagtctgagagagagggatgggcatgtgggcaagatagtttgtaccaaagctggaatatccagggcaggctcagagagaaggttactaatatcagcatttgactgcagccaaaaacagaagagaacatggaggttctgagaatgacaaataaacaaatagtttaagttttaaatgtattgaatgtttttataatccatgaaaattctagaacagaatttaacaatgggataaggaagagagcttgagatgttaaaactataaagaccccaagccaagctgccaggaaaagaacaggatctttttggtggaaatatgtttctgctgcaaattattattttatgtgtgtgtgtgtgtgtgtgtgtgtgtgtgtgtgtgtgtgtgtgtgtgtgtaaggaaacctcccatggaacatccttcttccctacagtcaagatcaccctcaccctacaagggaacctaaacaaaatgtcaatatcaaatagaaaaaaataatgcactttgtataaccattagagagtctctatttgcacatcaaaatgtggatgcttaacgttaacattggaaatagtattttaatatgcatatgagatgaattttctttagactatttttgtgaattatctttcttaataaggacatactcttctcttagaacaatttaacttgtgatattttttctattttctgtatcagttctgttttttctaaacactggcaaagatatcctatggctactgattaataaattagattaatgtgtatttaacttaggtaagttagttcaagagtggacagatgtgatttccccacatatcctatggctactgattaataaattcaattaatgggtatttaacttaggtaagttagttcaagagtggacagatgtgatttccccacatatcctatggctactgattaataaattcaattaatgggtatttaacttaggtaagttagttcaagagtggacagatgtgatttctccacatatacctcacagatgttgctggtgcttactcactcttctcttctaatcttagcaaataaagtgggaaatttgacattcctaaacacccagatgacaacaggagagaggaggtgaagccccaaagctgttattctttaaatcctcaggatgaatcaccctggagaatcacccacacttcagttggatgatacgcaaatgagagtttggtcttagagtggtgctgagttagttcaggatttgggtcactgggatggggtgaatgtgttttacaagtgaaaaatacatgagttttggggtctgcagggtagagagttcttggctgaattgtgtcccccagatctgggttgagtgacatcccaccaagaggagtccaggagaagtaaatttgtgtaaacaccaaacatgcactgccccactaggcctgagaggaaataagcgaggcctgggaagcccacctgtgctttgggttcaggaggcagagctctgggtgtcttaccatggcctggaccccctctctgcctctccttcctcaccctctacaaaggtgatgcccccaaccctgccttaggctcagcccttacaggatcctgagctggtcctgccctgaaccctgagctcagcctaggcatagcctcagggtgacaccactggaaatgtgtttgttatcttcaagccccctctcctttcctctcctgcaggctctgtggcctcctatgagctgacacagccacccgcggtgtcagtgtccccaggacagacagccaggatcagctgctctggagatgtactgagggataattatgctgactggtacccgcaaaagccaggccaggcccctgtgctggtgatatataaagatggtgagcggccctctggaatccctgagcgattctctgggtccacctcagggaacacaaccgccctgaccattagcagggtcctgaccaaaggcggggctgactattactgtttttctggtgattagaacaatctcacagtgacacaggcagatggggaagtgagacacaaatccatttttcatctgtctcatcttttcctccagcaccaggatgactgtgggccaagccatgagcaggtctggccaagttctactggatatgagacctccaggccatccttttgttcagccctacaggttggtgctgcagagggtagagcaggagtggatttagggctgctataatcagaattttcttgtgttttcaggcccctgaagtgacttggggaaataagaacgggatggaagatgagagagatgtagagaacaatcacttggccttagatttccatacgatggtgattgggtcactccttccaaatatcttacatcagtccccaaaaatgcccagctcagctcaacacctgagcttccaggcttccatggcagcctgggattttgaacaggaaaagcagaggaacaggaaaagcactgtggcatctgcctagatatgcttttctgagctcacccaccctcaactgctgggagcttctagaagcttagagctgtgccctcacaggaaagtgctattgtttccagaaaacttcctttctcatatttaggctcagttttgagagttttggtttgatgactgcctgagccaagaacccaaggccccgccttaatacaggatgacactgaaaggccttccagctccagacctcccattgtggatgcctgaggcctcagttgcaatcttatgatgggtcagggtctccttctggtgggtgatgcttctctcactcctttcagattctctgtgcatgaaaatgtttatctcaaagtctactttcagggaacccaaactaagacggccagctgtcaccaaaatgagccaccatagacctgaggtggccactataccctggaatgcatcagcgaatttcctaaatttccactgtgagcatccaaatgcccaacgatttctgagagatccttgtattcttataaaatgaaaagggatcctgaaatgccaggtgctctgagtcctgaaggagaggtggaggcagatcttcctgcaaggattccacggaaaagggagcagcctcactccatgcagggaccagagatgctcccacgggggcagctgtaggatggatgctgcccacctccatcctgcacatcctgcacaaacaatcactctttcacccctccttcagcttatcaaagttgacacttacgaagccagcacagctcatccttgtcagactccttcaaacctccatcaaccacacaatctcaacataaagaatctccccaaaataataatagtaacaaaataataataataataaaataatagtaacaaaatagtaatagtaatagtaatagattttcaggcacagaaatagtaatatagtagctatgaaaacttctataaaaatctcataaataattttagattgtgtgcatgtgtaaatattatttttcacactttgtgttaaataaagtatattattgaacctagtttacctttttattttttatgtctactatggtgactagacaataggattcacatgagactcacatcatgttgtgattgtacaatgctgatctggtcttaccccttcacatgacaggtgctttggagtaacctgcttcagcaagccccatctccacccataggacatatgtgtgaagccacggagaggcactggtggaagagaaataagaatatgggtgtggaccagctgtttatgcaggtgactgagtgctggagccctgaccctgctctaacctagatgtgtcacatccatctcaccagagaccactcctggcctgcctgagctcacaactggggggaaatcgcatttctggcaacatggtcacttgatgtccagtgttatcctgtctctcccagggcccagtaagacaaaagaagctgtttttagaaaggggagtaacactctactgcacatgacatggccttcttccaaaaacccaggagtctacattgggattctccaacggggtttgccatgtgcaggaggttttatttcccatggtggagtctgctggattctctggccccaacagcaggacactcacaaccctgcctgcacctgctgcagagccttcctgctctgggcctggaaaacaatgggtgacatttatggctcctgatacatggattggagtcacatccccagtagtaaaatatgctactcctagatcttataggccttgtgtctctttcttcctggggaaaattgaaggttataataacatcttttttttttttttttttttttaagatggagtctcgctctgtagcccaggctggagtgcagtggcccgatcttggctcactgcaagctccacctcccagattcacaccgttctcctgcctcagcctccctagtagctgggactacaggcacgcgccaccgcacccggctaatttttttgtatttttttattttagtagagatgagttttcaccgtgttagccaggatggtctcaatctcctgacctcgtgatctgcccgcttcggcctcccaaagtgctgggattacaggtgtgagccaccgcgctcggccataacgtgttgtttattttgtaggagactctcagctgctccagacaactaaagtcccaatttcagctaatatggaggaggaaacatctttgtttatttcccactctcaaaagtgcatggatctcacaaaagcttccaataggccgtgcccatcatgtacatgtgattgaactatgatatccagatggtctgagcccccatgatgatatcatgatagggaagggagagctaatgaagctgggcagaaaaagtgtgaatgtatactgttgtccattccacgtgaatgcacactgattctgatcctattctctgaggacaatagacaagacctcagtatctgcttcagtggtttaactgtgcacctgcagccatagcattctgttccaggagatccccatctggcacagatattgctaatgccactattgcccatctgggtctgtacaaatccaaattcatcttccaggatcattcaactattgtagagatcagtccagtaaactgaaagtgaggaccccagaagtaatcacacgtactgcaggagaggagagagctgtttcagaggccacaatcctgttgaaattcctctgctccttgggaagaaacagcccagaaaaggccccaggggctgcgtctcatctgggttcctggatgaggcacaccccctactgcactgagattccacagaagctgggggtgaagtgcaaacaccgtctttggttcatccttgggattttctttttatcacacactcgtcattttgtccacaatgtccaaagtttctaaagtgctgtctaatagatagaggttctttgtgcgctgaactaaaagctcttgggttggctaatggtgatgtttgcacatttttactgtacttactgccgcttaattacacacttaaaaatgattaaaaggatgaaacattttgttatgtttattttaccataataaaaatattgcatgctcaggaagcaaagtaatactagtttaattttgaaatcacacaactggtaaaaatggaaagaaaagcaccattttctctgttctatatgctacaactcaactttctctctctctctctttctctaattaacaatgatatcctgtctggtccaaggtcacacatttccagtgttgcaggaatgtctgttgaatctgctaatttgttgccaggaagaatactcaaacttctcatgctcatatttgattgtcaactgtctccagccaacatttctaaaccaggatcctttgacaagacttgtgaagaattttgtaaaaagtaccccccaagatgacagtgttcgctgttggcagcaggactgtttccacgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctgctggacactgagtcacacagagagacagaaggtggctgaggacaccttatctctgatgagaataaggggattagatctgctggtggaacaggaagctgaagaaacttctggctctaaacatggaatttccagccctctgtctctgctgtccatgcccttctcatctgtatgttcctgggagatgtggaccacgggggtcagaggtgaaggggattgggaagctttcatgttctctctcaccatctcccttgtttatctaacacactcttacacacctactttattagagcttctgctctacaaacatggctgagctctaaattagagacttttgaaagtgcagacggatgcaggaactcgtccatctggagactttccaccacttgaagcagtgaacacatctctgcaaggctccaaatttcaagtgacaggattttgggatttcaaagaaaactaaatctttggtgaaccacgacagaagagggaaggttcacacatttccctgctgcttgggcctcagtgaggactgactcagccagtctcaggctcctggaaacctcctaggagatgtgcactaggaaagtcttttcagtacaacctggggcaggtaagtggcccttactctgatattctgctccctgataattttgctttcagagaagaacaaagacctgtgattctgggaagttcaaagcccccagacaaggtcttctcattctcccgtgacagcctgagctctgcattcccaaaaggaggagcatcttcccggcatgaagagccaggagtagagagggagcttctcccaggggtgagcagggcagaagccaccttggtcagtgggaaggaaacgtgctcagctcacatctgacccagaatgactcagtcacacccgtgcagggtcacctgcatgtgagcatcatctatttgctccatgagaaaataccttgtgtgactcttgggtaaaatcataccgtaggtgacatttctctggctattgcttcagccaatgtttttcaaaattcactgtaggacacttacataaggtaagcatgtcaggtgtgggatgtgttgaataggaaaagcacaggcttcctgtatcaatgttcatggcttgtattcatggccataactcgtggaaatggaaaaaaaaaaaaaacagaaaagaaaatgataccctgctcaaaaaagcactgagaaataccattgtagtaatatatcttcaacttataagttgagctaattgaacattaacttagatagatcatttttatggggggattcctaaacctaaaacattgtattaaaaattttgtcaggttaaaagatcattaaaaggccaatgtttgattaaaatctggagtcttttactttgggctgcaatcagccaatgagtgcatggagttggctgccctcccagaccctgactggctccacgtcgaggtagagcagcgctcccgacaggcagctggaggaactgacgaggggaagctgtttgcatcagggcctcaaaaatttggctcaggattttcccacgtcccctccccaagcccaagctggtcccaggacactcagaagagctcatcattatgggtctaaaacttctctgatctcgctcttctttcttccttccccagagaccttggaattgtcagtccctctcacaggcccttcctttccttgtcaagtgcactccctgaattatctgctcctgggtcagcaattctctagaacttcagggaaagcagtgctgggtcacccacatggggccccagaaagctggctaaggaccagacacacaggcagcaggctaggtccccacagggctgcatggttggcatcgggtagaggggagggaccaggaaccactcgctgagtgtccgtagggccaggtgaactagggaagggctggaacctggtcaaagaattgtgtactaagcaccactttctctgttctatatgctacaactcaactttctctctctctctcttctctaattaacaatgatatcctgtctggtccaaggtcacacatttccagtgttgcaggaatgtctgttgaatctgctaatttgttgctgggaagaatactcaaatttctcatgctcatatttgattgtcaactgtctccagccagcatttctaaaccaggatcctttgacaagacttgtgaagaattttgtaaaaagtagcccccaggatgtcagtgttcactgttggcagcaggactgtttccacgcagtagggctactgcaagccacacctgtccccacacagtagcatcttcctggaggtcaagagtgattttgtttgctatgctgccccagatcacctaatttattacctgtgaatttcacacactacacatcctgcctgtccccaaattcttcacttatgggcaaatgtcacatctgacctgaactggtttacatcccagatccccttcaggcttcccactgtcctttcagatcctcacacacccaagacccttctccgcagggcacagacacagctccctgcacacgcttccatcacttgtctcttcactccttcctcaaaggaactccacagactcttcttcagggaggccttctccaatcactgaagctacagcagccagccagtcagcttctgtcagaactttcaatgattagctgcatagagcttacaattacacatttgttttttctatcgttatcttttgactgatttatttctattaatcattgcattatcagtcagaaatgctttttcactacaagaacacatgtggcaggaaccagggagcttccaattttcttccacaaaaataagtctgcacgtgcttggtggttgttttccagatgctctccagttccataggaagctcaaatatttctacctctccattccctttcaatgagatgttgactttgttttcattgttgttgatgtaagacctcagcatggctgctgcagctccagctatcacacccaagttcaagagaaaaagcaaagcacaaacccaatctagtccttccttcataagaggaaaagtttcctgagaagaatctcagccatctgactcttacatcctatggaccaacgctgggctacatggtcactgctggctagaagaaactggaaatttgcctgactttcaagtgaatagaggggatgacacacaagtagaaggtggtagggagtatctgctgggtctgtaaacccaatctgcctactgcactgatccagcaacaggacaggaaactcctcagagcaaggactgtgtcttcctcatgctgaattcctaaaatgcattcttgccaggacagagtgggtcagggtgaatatttgttgggtgaatgagcttctgtctctgttgtattgcaggagtcaccaccagtgcacattggccctgtatttgtatccagaaccaatcaaagccacccctgagtcctgcatctctcagtaccaagctccagtcccccttcaagaccacccaccacacagacgtgcagggagcctcaggagggcactgtcacctccttctccacatgtgagtgtttgtatttccatcaggaatctgagcacctcgtgcccaggtttgaggcaggaaggggccacaaacagaagagaaatttcttctctgaagtcaacagtccatgaatcaaggaatcagggacctgagcagcagattctgaagctacacctgaacccaggaggcccctgagcctccagctgacagtgtagagtggccacctgggggcagcagagagtaacctggcaaaaatccctggaaagggggtggagctgggcatcagggagatgctgacatgcagggagggtcagtgaccatgacctgagacctggagggaaagaggttcctcttttcttagaatatttgtcattgacactgatgtttaaattcttctgacctcctgtctctcagatttgactcttggaaatggtgcttatttttctgatacagattcagacaatttgcctcttctcattgccctggcccccatctcactgtcacacatgccattccattctgtagtcacgcgtgtcccacctccctgcccttttctctggtagctcgtcctgcagacacaggggcttctccttccctggccactcctccacgtccactgtccccagtctttcccaacactgtcctggggaacctgccaaatcacagctcttgatttccttatgaggcacaaaatacttgctccttaatcttttgttgacttaagtttttatccattgatatattttcccagcaagtgaagacaacttagttataataaacattcacctccagggtcttggagtttgcagccccctctcattctctcacaaagccaacatttccttcacctcctgatgtgtccctggccctgacagcaccctggggatactgaggcacagcacctatgacctggcattagaactcacagccaagtagaaacttatcacatcccatggatcttccaaaactctgtgtgcacttggcaaccaagaattgcattctcctctagcactgaggggctgtgccctggggtggggcctgtactggtgcaaggcttgtgctgtcccctgtagagtgggaagtaaaaggtccctgcattgggttctggattgtgtcttcaaaatgaatttaggcctataccaaacatctcatgtctgacataaaatatttatgaccaggacatttctagagaagcagaagaaagttaaccacctccctcctgagccaggatggaatggaggaggggactgtggaccccagataattcccccatcaccactgtgactctggtaacctcttgaacagggccaaccactatcccataggaaggactttatatcccctagaaaatacagagaaactcagctctgagtttttccatgaccaactcagcccaggggcaaaagtgggcacaatctgggtaaagatgtgaactcagaccatgggaccagtgggtggaggagaatcccatgggctgagggggtgggcaagcagtggtcaccccttttctctctctctctgtgtcccttgggactgagcccttctctggaaaccacaaagctcctccagcagcaacccctgactctgctggtttgcatcatgggctgttctctccagcaaggggataagagaggtctgggaggaacctgcctagcctgggcctcaggaagcagcatcagcagtgcctcagccatggcctggacccctctcctcctcagcctcctcgctcactgcacaggtgctctgcccagggtatcaccaacctgcccatccccagggctctgggtccagtgtggccatgactatgagctcaggagggccctgcctgtggtgggcaggatgctcatgaccctgctgcagggtgagggactggcggagctgaagtcccctcaaactctgctcagaggcttgtgagagcctgaggggctgcacctgccaggagagagtactgggttttcagttcaaaggctccatgcagagggaaagtccatgggccactggggctagggctgattgcaggggataccctgagggttcacagactctctgaagcttttccaggacagcagggcaggggatttcatacggatcttttacctaaaagccatcctctcctttttttttttttttaatctttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatcccacggtgacacaggcagatggggaagtgagacaaaaacaccctcccagcctcggtcaccctcttgctccagccccgggaggcctatggatagagccatgagtgaatctggtccagttcacctggatctgagcctcccaggccgcccttccctccagccccctccaggagtctctatagagcatacatcaggcatacacatggcctggaaggaccagaatcatctaatgacttggggctgtcgtgtgagttagagaatgagggcctgggtggaaagacagacagaagcaacctctgtcctctgtcttacccctggatggtaatggggtggggatgaggccagtccttagaccagctatctggctcagtccccagaaccaaccctgctgaggtcctggcccccaggctgtgtggcagtctgtgattcccaacagaccaaaccagaggaggggacactgtgaagtctgcccaggtcccctcttcaatgtgacccacctagcactgctgagaagcccagcagctcagagctgtgcccacaatgggaagcgctgttggttgcagaaagcttcctcaagtttatgtcctttctcagatggttttggtttaatcaaccaagatctcaagtccctgccttaatgtaagatgccactgaatgaagggcctcccagctccagagctccctgtgtggacggacacctgaggcctcagtggcaaccccattatgagtcagggtctccttctgcccactgttgcctccctcactctcttccaaatcttctgtgcatggaaatcattgcagtcaccttccagggaaccccatctaagatggccagctgtccccaacatgggctgtcagcgacccgaggagtccactatccactgaaaattctggtttctgtcctaaattttcagagtacatgttcaaatggccaatctgatggttccttgaatttttatggaatgaaaagggagcctgacatgctctaggttgagagatagttggagtcagatctccctgcagggaaacctggggcaggcagagcatcctcgccccacgcagggaccacagatgcacccacagggtgagctgcaggatggacactgcccatctccgccttccacatcttctccaaatgtcacccctttctacaaccccaacccaaatcattgatctccagaaaaataacagtaacaatagccatgaaaatctatgtaattcatctcataatttcatgttaacatgtgaaaatgatagtattttgctttattgacataaataaaatatactatttatccaattttatttgtcttatatttttatatttaatgtggtgaccagacactaggggtcacaggaggatcgtgtcatactgttatgggacagagctggtcaggactctttcaggtgacaggtgctgttgagtaacctggtgcaggaagccccatctccaccagacccaggtgtgaacccaggaagaggcgctggaacaatggagaggagaacctgcttctgcggaatacagtgcccttgagccctgcccctgctccatcctacgtgtgccacctccatctcaatgtggatcatttcttgccctgcctgaggtcatgactgaggggatctggcaggtctggctgtgtggccactgctgtctcatgtggttctggttgtaacaaagcccaggaacatagaagaggctgttttcaaaaggtaaataataatctactgcacatgacatagacttgttgctaaatcccatgggtctacagtaggattctcctgttgaggtttgccttaagcagaaggtttcagttcctttgtccagttcctctattatgatagggtctgcagtttctctggcccaatagcaggacactcacacccccgcctgcacctgctgcagagcctttctgctcttggccccaaaacaacgggtgacacagttctcagacccatgatttatggtgtcagtattcaggcctcgggggtccctgacggcttctctggctccaagtctggaaacacagcctccatgaccatctctgggttccaggctgaggatgaggctgattattactgcagctcacataggagaggtggcactttccacagtggtccaggttcatggggaattgagacccaaacctgccctgggctctcagcctctctcttgttctgaagatgcttcctcaccctgtgcaagtggcttcttgcagcaccaccttgagaatttcccctctcccagctcctctcctttctcaccaggaagtccaaaaggaaacctgctctgtgatttctcatccaggacagtgacagcttcctgttgcttgtgtgttgtggtccatgaatgtgcaactcttcctagctcttcaaatgcaggcacatagtgagaaaagctgcctgactcatgaagtcattgctgtttttaggggcgccctcaccctaaatgcatcctcatctcccacgctgtgcaggccaatctgcacagaagtcattacagggagtttcaagaaattgcaccttagtcaactctgtgtccactatgctctcgtgaagatggccctcctggctgggctattcctctgtacctctgtcctgaagcagtgaccactgtgagagctgagcatgtttttgagggattaagaaccagaggaagctgttgtttttcattattattattattattattattattattattttgagacagagtctcgctctgtcaccaggctggagtgcagtggcacaatcttggctcaccgtaacttcagcttcccaggttcaagcaattctccctgccttagactcctcagtagctgggattacaggtgcccaccaccatgcctggctaatttttgtatatttggtagaaacggggtttcgtcatgttggccaggctggtcttgaacttctgacctcaggtgatccacccgccttggcctccgaagtggtgggaatacacacgtgcgccaccacacctggctgcgtttttcttatttttgttcctcttctttgcctcaatacctcaggttgctgagctggggagattttgagtgacagactcagtattctctcaaaatccccctctctcacatcgctgaggccctgtcctggaaactctccaaaagtggatggtctccctataggatgggagcttccaaaatggctccacagggaagagttaacctgagttcattccttcctcctcattgacatccagcatttgtaatttccatggccatcaatactactatagctgaaatcttcattaatctactaaaggtgagagtgaatttcatacatattcaaacattagtttcatccaacatttaaattttatgagtcaattggtaaacatagccatgattacatgtagtttaggcttcataaactttgattaaatggattttatttaaaacaatgtaatcattttactatatgtgtatcctacctatatcaacatgttgttacttgaaatatccacaagaaactatatttcaaaaaccaaattgtatttattgtctattgttacataaaaattgctccctaatagttagcatattaagagaacacgtgtttgtgatcttgtcactttggtgcatctggaattgagagcagcttagttttgtggttctggccctgggttggtcatgaagtcgcagccaagctgtcaggccaggctgcattcagaggccagagcaggtggccaggcccagcctgaggggcttccactgtccctaacctgtttggctgattggaaaactcagcggaaaaggagagagtgaagtgtaaggtgcctgtcctggtcccccatgtcaaagaccattccatacatgcaccatttcttattctttcctgcaacatcctaggcatagagcactgcccattcattctaaggctgtagagtattccacagtagaattttagccatgcaacctctaatggttaacaccatgattttgatcttacaaataacactgcagcaagcatccttatgccgactcctttgagttattgtgtgcatatgatcataggataaattttcagaagtggaattactgggtcaaaatgatgtgcatttgtaatgtttacccattgttttcacatgtttcaccagtttacaatgccagccctaaatattgattggaattcattggtgaaagtgcaaatttttgccaacctatcagatataaaaaagttaccttgttacacttttatttttgatttctcctattgtgcttgaagttgagcatttgctcaaatgtttcagtgctcattactttttaaaattcggtaaactttttcttaaatgtataaataagaagtattttagtctttgccacacaggagtcaactttggggatactatgtaggtactgacagcaccatctgcaatgtaaacattaaaatatataaaaaccattttaacccattaaccatccccagataatagctgatttcttattagaagtaatgcaagccagagtcagtggagttatatttagaaaatattaaatgaaaaaacttactacccaaagcaatctacaaactcaatgcaattcctttcaaaataccaatgacattattcacagaaatttaaaaaaacctctaaaattggtataaaaccaagaaagatcctgaatagccaaagcaatactgagcaaaatgaacacagctaaagatgtcacactactagaattaaaatatactacaaactatagtaaccaaaacaggaaggtaggtattggcaatcagacactgagaccaatataacagaatagacaacccagaaataaacccatctatcatatagagccaatcgattttcaacaaagatgccaagaacatacactgagaaaatggcacaattttcaataaatggttctgagaaaactggatatccatgtacggaacaatgaaactagacacttatccccctccatataaaaaatcaactaaaaatggattaaagactcaaatataagacccaggctataaaactactagaaaggaacttagagaacattggggaagaacaattctttaggacattgttctagataaaagttgtatggccaagaggcaacaacaaataatagagatatgggacatcattaaactgaaaagctcctgaaaagcaaaggaaacaatcaacagagtaaagacaatgtgtagaatgagagaaaatatttgcaaactactcacctgacaaggacctaatattcagtataagaaaagttaaaaactgaaataactcatcaacaacaacaaaaaaaactaataataccattaaatagtgggccaagaatttgaatagacttttctcaatagaagacatacaaacggccaacaggcatatgagaaaaatgttcaacatcactaatcagcgagggaattaaaatcaaaaccccagtgagatacaatctcaccctagctggaatggctatgatcaaaaagacaaaaaatacaaatgctgatgaagatatgcgacttcatatttttctagtccaattctctgggaacaatgagagtgctctctttgctctccctttagtaactatttttcacatgcaaaaatatgggccctactgggaaataatgcctaagaccaccaacaccttaactgtttgttcatcacactagaaatgaaactgttttccaaataatattaacatctatctgtgtctatcaccattgtgtcaatgtttgtgtgatcctataaagtttagaaggcctagaagaatgcccttgctttttgcaatacaaaaatggcctaacagatatagatgacatagatatagatatagatatagatgatatagatatagatatagatgatatagatatagatatagatagatagggggttgtatcttggaatttgtttctctaagggacttatttcacatctaatttgaaattattctggttttaaacattatagaatgataacacaattggtgaaccaatcattctgtgttgaggttaacagtatttttttacttcaattctcactgaatgagagcagtttttatacggaggggccatgccataacaatatcacatactggggttgttctcagactgtgaggttctgcctacaccaagccaggatgagaattttatttgtcaaactgctctctccacttgtttgtatcccataatataccccaaaaatgagcataatttcattttttatgctgtttgttcttacatttaatacatgtaccaaaaagttgtctttgtttttaaaataaaattttatgctatcttttaatctatgtccctatagaaaaatcatgatccatacacatttgttatcacagaaagaacaagataaatttcctctctctctcataaatgccatgaccgctgctttttgggattatttttcttaaattattttttaaacagaaattcatataacttaccttaatcaaatttcttttcaaagtaatcacatttcttttatgtgaaaaattatttaccttcttttatcaaaaattatcttaatacaaaatatgtattgttttacttttagaagaaatggaaactatctacacattactaatctaaaaatacatgctctgggtttatatggtgttaacatgtcttccaaattttaaggaataggtatttaaatgtcatgcactttgtttttaaatttagaaaatgtttcaaccttttgcctgggcatggtggctcatgcctagaatccctgcactttgggaggccaaggtgggaagatcacctgagctcaagaccagcctgtgcaatatggcgaaaccccatctctacaaaaaatttcaaaaattggccaggcatggtggcaccacccacaatcccagctactcgagaggctaagatgggaggattgctggagccggagaagttgaggctacagaaggtaaactgttgaggctaaaacatggtaaatatttaattgttcacttaaaagaaatgttggttacattgaaaagaaatttggttaacgtaagttagataaatatctgcttaaaaaataatttaagcgagctgttagcactactgcattccagcctggtcaacagagcaaaatctgttgaaagaaagaaaaagaaggagagaagggaagggaagagggaagggaaaggggaaggggaagaggaagacagaggtggagggggaggggtggaggaggaagagggaaggggagagagagagagaaagagacaaagagagaaagaaagacaaagaaagaaggaaagaaagaaagaaagaaagaaagaaagaaagaaagaaagaaagaaagaagaaagagaaagaaaaagaaagaaggaaggaaggaaaaaaagaaggagaaaagaaagggacagaaaaaggaaggaacgacggggaaagaaagaaaaaaagaaaaaatatttcaagcttttcagtagcagagacacttcgtaatcaataagcaacagaaccaaaacaaaaaaaaaaatctacagaacagtctaaatacaattataaacttctgattcggatatcaaaaccatttcaataataaatatatggtatgaaaacctcacaaaggtcaagtagaatgtattatatttgaaagaaattacgagttgagagtaggaaatttataaatttaatcaaacaaataagcattatgaggaagttgtattgctaatgtattatttggcaagctgttcagtggaacaccaagatattcttaaggaagttgcaaatatctttttttttttttttttttttttgagacggagtctcgctctgtcgccccggctggagcccaccaccacgcccagctaattttttgtatttttagtagaaacagggtttcaccgtgttggccaggatggtctcgatctcctgacctcgtgatccacccgcctcggcctcccaaagtgctgggattacaggcgtgagccaccgtgcccggctgcaaatatcttttaagatgttgtcattgaagtggatttaaaagtgaggacatgaatacctttaaaaaatattcagggataaagagagaaaattaaatttagattgtatacatatataaaatgtattttaaaagatcagcttggctgggcgcggtggctcacgcctgtaatcccagcactttgggaggccgaggggggcgcggatcatgaggtcaggagatcgagaccatcctggccaacatggtgaaaccccgtctccactaaaaatacaaaaattagctgggcatggtggcgggcacctgtaatcccagctactggggagggtgaagcaggagaatcgcttgaacccaggaggcggaggctgcagtgagccgagatcgcaccactgcactccagcctggcaatagagtgagactctatcaaaaaataaaaaataaaaaaataagcttgtctctttttattccttaaataaaaggagcagacacttaaattccttgccttttattttaaaatttagaaaatgcttacagcttcccacagtgaaatttatacttagataatctaatcaatggataataatatcaaaacagaattctttgaccaatctattttcttcatttttaagtctaaatgtatactcaaagaaataaaactatttataattgattctgctgtttgaaaatatttactgatcatttaccttgcaccaactgacctccagctctgaagataggtcagtggtaaagtatacaaagttgcccagcttcgttaaacttaaattctaatgaggaaaaaagaagtaattaatcagggactttaaaacaggagtgttgtgatatggcttggaattctaattgcttcctgtgcttgctgtgtggagactggattgaaaaatagggcgatgataggagcttaaattcatacagaatatggctagcctgtattttgagggcccctgaaataagaatgtatagtagttctcattatttcctcaagaaatctctgcagtagagctttggccttgggagggaagtactatagtcaccaagtggtgagggtgggaaggtgaatttgcaaataccatttggaatgagttcactttaaaggtaaagctggcaggattttcatacatgtcagatctgaaaatctgtgtgtgcgtgtgtgtgtgtgtgatagagagagagaaagagagagaattagaacaagacagatacagacagacaatgacagagctgcagagacagagagaattaaatggggacaccaagaatattgagctgagaaactataaaatgggaggtgccattaaacagaatggggaagagcagttttggggagtgtcagtggctccacgtagacttattaattttgagattcctaaaccacatccaagtggagaagacagacagtattgtgtgtagtctagtgttatggtatcatataaaatatcaggaaatgaatgacacaaaaattagtaagaaagcaaagataagaaagataaaagtcccgagcctagtggttatctactgcctaaaaagtagtaggctgggcatggtggctcaggcctgtaattccagcactttgggaggccaagttgggcagatcacctggggttgggagttcaaggccagcctgaccaacatggagacacctcgtctctactaaaaatacaaaattagccaggcatggtggcgcatgcctgtaatactcaggaggctgaggcaagagaattgcttgaacccaggaggtggaggttgcagtgagtcgagatcgaatcattgctctccagcctgggcaaccagagcaaaacttggtctcaaacaaaaaaaaaaaagaaaagaaaagaaaagaaaagaaaaagaaaattagcaaagatgagaagaaaccagcaaaaagtactaggtataattatcaaaaatgtcaagaggaaagtaggttaagtgttctagaattctatcaaagaaagttttgaaaaaaaagagggagagatcaactgcattaaatgctgctaatacataaattaagcaaaggctgaggaattacgcttcaattcatcatttaacaatatggataccatttgtgctttgataagagcaattttcttggaatgagtaggtgagaaaccatattggagtggtttctcaaaggaatgcctgatctctgggttcttaaggaaactttttattgaacaggggaggcacaaattggattagttttaattccggggtccggacacactctaaacatgtgcctctgcatgcctcgctttttaaagctaggtatcctattatctttcgataacaaaataatcacctgcaaaaccaacacacatttaatggacacacttgtaaagtgtgtactagaggttgttggagaggatgtgattccacgtgatagcttacgagtcactgatgggcaggtaagctggtaaaatatctttggaaaactcaccatacctgttatacttaaatattcagataccaaacagcagaaaatccatattgtaatatatttccatgagaaaaaacaagagctctgtattaaaatattgattattattaaaaataatcccactgggtttcctgacttttttattagcaagtcagtctccgcctgttttcagtagtacaacctctatttaacaaatgttttgtatttttaatcagccacttagaaaaaatattatattttatatcaattctacgttcagtgccaaaaccagtgttttgtacattccacagaattatttgttgaataaataatgaataacttaaataagttatagtatccatatataaataatatatcatctccgaatacagtgataacatttgttatgtagaaaatgatttcaatctcagttaaaaatattttgggcataggagttactgtcatataaagattctcacattgttttgtttatatgaaaatgtttgcagttaacgtacatttttggtacctaaggcttttgctcttgctgccatagcaaacagtgtgcctattaagaacacgaacctgagttttatttcattttaacagatttcttaataaaatatatgccaccttatttggtttaatacataagcaaagagccatccactccaccattgccccttgtccctcctccaatgcagctccttaagatgttactgatagcagaggactttgtgttcaacctaagcactttatagcccttttattttcaactaggtatgaggtaaaataattcagcaccaataaaacaaacactctttaaacaatgaccctttttcttagcctgttcaacaaaacgcagcaagacagagtacacttctctttcccagcaaatcagtgttgccactacattctctacgttctgaaaacttgtattattgactttcttacaaacaccctttgagcttataatttagatgtcatcaaataatgtacaaaaacacgctacttcctcccccttctcttctcttcttaccagactattgtcagtttgcttttctatccaactcctttcttctgtctacttgatttttaaaagactttctacatatttactatcttggtattgtagagaccaactatgtggtcaaactacacatataggaagaactgaattatatgcaagcatttttaaataaacgattcctcctcagttttctgtgattatttcatataatcaaatgtcttccagatacacatcccaaacgagtggttgtcaagctctgctttgttgtctaattttatcagaattatccaaaattcttatgataaatacagatgaattagcataactccagatttatgaaatgaaaatttccagaacccaggaatatgcattgaaaaaatgtattcctcacgtggtgctgatgtgatatgggatctgagtttagaatccaaggaaaattaccctccttgccctctagttggccagaattacctagttgaccagagttgctctcttgttatctagaggtcctcttcccttttcacattctgctctctctccttctgtaccttcctcctctcctccctccacttctgctcatccagatcccaagcccttctccattgattctcctaaaactccaaatggtcagttgccactaaagtccctctgtcccatgaacaagatttgtgggcaaatgtagaatttaagcttggacagagctgaatcagagctgcaattaaagatttccctaaacccagcagggaccagcaaatacttatagaagattagagatttcttgtgagtgcaaagggctcagagtgacctgatgctatagaccaaatcttatggtcccctcaaattcatgtgttaaaatctaattccccatatgatgggatttggaggtgaggccttggaaggtgattagatcatgaaagcagagactgtatgaatgggatcagtgtccctatcaaagggactgctgagagctccctcatctcttctgtcatgtgaggacacagtaaaaagatggcagtctatgaacaaggaaggaagccctcatcagacacgaaacctgctgacgagttgaccttggattttaccatctccagaagcatgagaaatgaatttgtttctctgctacctagtgcagtgcattatcttttggcacccagattggctacagtaccaacatatcaacttgtacacgtaatttttgaaattctgatgccaaatctttgatggcaacaggtgattgatctgctggaggaatggactgacatgatccctctttccacaataaaccagagagtaaaaacaagcaaaagtaggtcaaggtcttctaaaagccgtacctgaaaggtttccagtaacagttgattagatggtaattcaatcacacaaacaaccacggcaaagatacacaactatcagacattttcagaatagcctctaaaacaacatctgacaacattagggagttaaagaaggcacgaactttcaaaaagtcaaactttatttaaatgttattgtagaaacttgtaattttaacactatggatgaattctagggcaggtggtggcatggcatggcgatttgggggcacaagtgctgagttttgaagcttcggttttgataccctttggagatgccccctggcctccacacccctgcccacctgtcaagaagagcctgtcctgggcagcacctcagggacaaacagcccagaagcccagttgagggcagacctccaaggttggaggaagaagccgcctctgggagcaggaggagctgctggatcccctcctcccaggtttcttttcctgccccccagcgcctcttgcaggcaggcaaacaaccccagcaggagcagcagcaggcccttcagccgcagggctgcagctctgctgaatgagagaagcctctctctggcgagtcagaggagcgcaggccatatacccgggtctctacctccatgtctcccactgtgcccaggactgagcccagcgtgggagatgcgggctggggccgtgctggccaccccctctcttccacctcttgctccagccatgctttcagctccagggctgaggccagtggctagagcagatctcatgatgtcaggtagctcctcactgggctggtccttggcaggaccaggacaggggcaggagggatctggagctgctgatagctccagttctgtccctgaaggggggtcttcccctggtgctggcactggctcatcagctggcgctggaatttcctgtgttgctgcacatggaacaggagatgaaaaagaagaaagactcaccaacgtcagtcactttccactggaattttcacacacagaatcaacctcgctgaatgtaaggtattccagcccgaaaacactgcccctgcaaaggctcatagactataggccacctcaccgtgtgcctgtgcctcgatgaactccagaggctccagctggacaagaacaatgtgcagatgtggccgcgatgggatcaccggtggggcctggcctggtagggcctgccctgggctgccctgtggtacttgggggcgcctttgcccaaatggccagaggcgcctggagtgagagatgagtgaggtattgcccctcacaagagggcattagctgcggggatccgcccacagaccctgacccaaatgacggatgaataaaacgtacactgacacagagttattctgctttgccagtcctgctgagtgtcccactgcctgcacaccaagagaggtttgtcactgcagctggccgtgaatagctcgcactgcaggcatttatttagtatagaatttacaacggaagctttgagtaaatactcttgtggataattaacatggttaagagagtagttctaccaatgattaaagctcaggtaccatggtttaaagtaaataccactgggggcaatttcccgggtctacctcccccctcctccccaagaggactatctggctcaaaggctagttaatggaagtagggtaaacagacttaactggggaagcctctattgtccctaacatttaccctatgagctaatgctctaagataagaagcagctgccttcagcctgttcaattattacaagctatgtaacctttccgccttccaaaaggtttgtgactattccctgtaactttccctaatatttccctttaatatttctgccaccatcctgagtgaatcccaatagatgagcctgcgtcagcattgtgggaaaaggctctcgctctgggccctcctgaagcaggagactcgagatgtgggaatgcagcatgagaacatcttgctctcctgagcatctcccaccaagggagctggctgcgggtctgtccctaggatgtgggtgcctgattaccagagttctaagttctgttagagtccatcaccaaggaagtgaagtcacttctttaaggttccgtaccctcggctccttccttcaaaacctactcagaaccccctgggctgctggctgctcaccctccccccaggtcagctccttacctgtacacaggtaagtccacccagtgtctgcttgtacacctgtgcctgatgtgcacctggggcctgggaatccacttagggcctgtgatccaacaggggcctaatgttgattaaaactaattttgattattcctatggagaaggaaaggccttctagcaataagaagcagagttccaaatcaaatacgtaaaaatgatcaaaaccttgtaaaagaaaagtatcttaattttaatcactgaaatgttaactttttgataaatatttaaggttataatgaaaaataaaacaatactaataaaataacagttgcaggaaatgctattgagtttcttgtttgtggtttgaacactgaaaggtcccacctagttatggtcataatttcctaccttaatcttcttgttcttatgagtaatagaaaaaaacacaatgacgatgaatgtgatgatggttcaaatacacaactgaagtttagtggcagaaacatcaggtgctcccaattacagtgcagctgttcttactgaggtgagaaaaaaaatcttgttttcaatacacacgggaagcaggagtgcacgcggatatgaccgcatttctctgaacttatgtttttcacagaagagctacagtttatcctgcattctccgttctgtgatcaaaaaccatggaacagagaagagcatttcaacctgagactcaattataagaattgcgtctgccccacctccctgcaaccatatatgccacctctctgtgctgagcctgaggggttcacatatggcacagactgaggctggactcaacagtccttaccctcgcaggtgacaggcgttctggggtcacttggaggagggaagctcctgggctctgtcttctccaccagcagggggcagcacagctgcagacagaagagaggctgaggctgcccagaaggagcctaagagggaggccagccatgaaggctcaaaaggtgtccaaggatcagtcctcaatttggaagtccagtaaagtgcatcctatcccctcgggctgcagtaactccgtcctgactgtaagactcatgcagcgtcactcagggcactgacaggagcccagggacagtgagagcctcacctgggaaatgtagctggaggcgcctgggccccggtgtcagcctggggagcttccacagggctgggattccctgggagacgccccgaggtcaaggtgctctaggagggggccacagtgtgagaggacagggtttccagggcccaagcccttcacctagtattgctgcctgagcctcctgccactctcatggtcttgtccctctctgatcagcagcattctggggagctgagccctcagtcctgggcacttccagagacctccccccgccaccccttctccctctgcctttccttccagctccaggcatactgtgactcagggggcagctcctgtgctcaggggagtctcacgtgggtggggtggtgcactcaggaccctggctccaggatgtggcatttccagcctccttgaggagatgctctccacagggaaggggattctcacctgcctcaggccagagctctggccacgaggctgtccttggctcagggacaggatacacctcattgcaggaaccaaggaccacccaccctgcagaccccacaccctgtccaaaggctgtgtccctgggatgcttacagcgaccatggggcttaaagttgaatttcccatcaatatttcatgtaaacttgcaaaaagcacaagaaaaccacactgggctgagaactctggtgctattttgctgttttttacaagtttacataaaatattgattggaaaaataaacaatggcagagctgaggatggcaatggctggtctactgtggggatggggatggcctagaagtatcagccccatgggtgaaatgagaccagacgtcctgatgactccacatgggtgagtggttccttaaatgactcaactattctcactgaaatagttaactagtgtcctaatgacacaatccatcatttagatgaaatgaccaggatgggacatttcctccagccaggaagactgtggacaaattcatgaactgggctggcccagttcacctgggtctgagaccccctggatctgagtccctccagccctccaggcaggctctgaagagggggcgtcaagagtggatttagacttaggtgaccaggatgtattggggtttgaggactcagctgtgacttagggaaatggggcctgattgaatcatcagactgaggtagacatccatcagctgggctctggatttccattggtcatgacaagccagtccttggcctgaatatcctggatcagtccccagaactgcccagctcaggctcaagtcattctctacagaaaaaccagtggagtggacactgtaggatctgcccagattctttcttctgagctcacccacccagcactgctgggagcttgtggcagctgagagctgtgcctttcctgggaagtgtggctcagcgcagaaaactgcctcctccaggtttatgcccttcctcagcaagattaggtttcatgactgcctgaggccaagttctcaagactctgcctcaatataggaggaaatgaaaatcctcccagctccacagctccctgtaggaaagactgagacctcaatgtgcgtcagggtctctttccgcccagtgttgcctccctcacatcctctgtgcatgaattcctcatctcagagtctgcttccagggaacccaaattaagatcaccagccatccccaacatgggccatgcggaacctcaggaggccactgcacactggaaagcgcccatttattcctaaattagcactgtgagtatccaaatgcccaatgagatctgagtgtttcttgcatttgtatggaatggaaagggagcctgacttgccaggtgctctgggtctgagggagagttggagtcagatctccctgcagggaaacccgggacaggaggagaagcctcaccccatgcagggaccacagatgcacccacagggtgagctgcaggatggacactgcccacagggtgagctgcaggatggacactgcccacctccaccctccatgccctgtagaaaaaatcattctttccacccctccttcagcctatcaaagttgacacttaaaaagccaccacaccccacccttgtcaacaggaaacccattcacatctccatcagccacacaatctccaagattcttcaaaaaataataacactagctatgcaaagtatatgatatatatcataaataattgtacctagattatatatgaaaatgatactttttgatatgctaggtaaataaaatatattatttaaactcattgacttcttctctttgtatttataatgcgatgactagacagtgggattcccatgaggctcacatcatattgtgattgaacaaggctggtctgcagggcttcaggttacaggggctgtggagtgacctggtgcaggaaaccccgtctccatccataggacatcagtgtgaacccagggagaggcgctggtatgagagatgagaacacaggtgtgaaccacctgcttgtgcaggggactgagccttcactttgagccaaagaagtttcttttcctatcttcaatcctgaacaagagggctttctggacttctttttgttttcagatttgtgccccttcaggtttggggctgtctggagtcccagccagaggacagtgaggaaatccaggagtctcacactgactctgttatatttcatctgctggggccatcccaaactgctgtgtaccatttcctttcctggtgctcaaatagctgctccattcacctgtcatggtttcagagatgaatctaggtgggaagacaggacagtgtatgttataatatttaaatggaagctgattccattaatatttattttaatatgaaacattaaaagaattttgttataggctatagggaaagatgaaaagagattaaaagtattttgaaaaaatgtatttatcgaatgtctgtgtgtcttcagtgttgcagggttgagagaggtcagctttaggttggatgtgctcagatgaggaaaagcaagaaagcaggaaacacgcggctctgtgacctgacacataaatcacagtaaaatggaaataaatctttcaataaatgaaacattcaaaataaacgtcactctggtgcacacagaaaggcctattagcaaactttccctttgtcctgctggctcatatccccatggatcacctgtgtgcagagtggacactgtagtccccatttctcaggctgagaactagaggctgggaaggacaagtcacctgcttgtgagtgggaggggcaggattgggagcagtggactcgggctcaggactgcggccctggtcggtgctctgtgttccctccacaggatccctcccacatgtgcccgtgtggatgtgggtgcactgcctggggtggctgatgtgctccagggattcgatggtgcagatgcttcagcacaaagcttgggggtggggatgggatgaggctgcagctggggagaccagggaccaatgccacccagcagaggtttccacggggtgggcagccccatttcctggcagtagagacagcctggaggtgggtgccaagcagagggcactgcagggtgtgcccaggcctggagggtcacaaagacacaggcaccacacagcagagtcactgaggaccagaagctcactcaggtaagggatttcagcagaactttctctcctgagcaaatcaggtacaaaaaaattaagatcctgccatcagaaaagacaaacaagaactttttatctcctcagctgagccccactgtccagggaagcagaagtctctgagcccagcccaggtgagggtggggtgaggagaggagctcagggtggagatttgcatggaggccccaccctcctctgaggcagaggggataagacagggctgggggcaggcccagtgctggggtctcaggaggcagcactctcgggacgtctccaccatggcctgggctctgctcctcctcagcctcctcactcagggcacaggtgacacctccagggaaagggtcacaggggtctctgggctgatccttggtctcctgctcctcaggctcacctgggcccagcactgactcactagagtgtgtttctccctctttccaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttccacagtggtccaagttcctggggaactgagaccaaaacccaccctgggctctcaggctcccttttgctctgaagatgcttcctcaccctgtgcaaggggcttcctgcagcacggccttgagaattcttctctctcagctcctctcctttcccaccatgaaatccaacaggaaacctgccctgtggtttctcatcccggacagggacagcttcctggtgcttgtgtgctgtggtccctgaatgtgcagctcttcccagctcttcaaatgcagggacagtgacaagcagctgcctgattggtgcagtcactgcttttttttcagagatgtcttcaccctacatgcatcaccatctcccacactgtgggtagaattttagccaaatatggctgggcgcagtggctcacacctgtaatcccagcactttgggaggccaaggctggcagatcatgaggtcaggagatcgagaccatcctggctaatacggtgaaaccccatctctattaaaaatacaaaaaattaaccgggcacggtggcgggcgcctgtagtcccagctacttgggaggctgaggcaggagaatggcatgaacccgggaggcggagcttgcagggagccaagattcgtcactgcactccagcctgggtgacagagcaagactccatctcaaaaaaaaaaaaaaaaaaaagaattttagcaactacattctaatagttatcgccacaactttgatcttaaataacagtgcagtgaacatccctatgcagcctcctttgagttcctgtgtgaatatgaccataggatacatttctaaaactgaaattgcgggtcagaaagatgtgtgtttgtaattttcacccattgttgtcagattcccctccagaggggttctaccaacttacaatgccaaccataagtatttgttcagagtacattgttgaaagtgtaaatttttgccaacctaccagactgaaaaatgttatcttgttacagttttatttttgagtctcccattctgcttaaggttgggccttttcacaaatagttcagtactctttatttttttagtatttggtaaactttttcttgaatatccaaataagaagaattttagtctttgtggcaaggcacagtgggtcatgcctgtaatcccagcagtttggaaggcttagacacgtaaattgcttgagcccaggagttcgagattagcctgggcaacatagtgaaccctcatctctattacattaaagaaaataaacataaattttaaaatgaagtattttagtctttgtggcccacgaatcaactttggggatattacataggtacttacagcaccatttataaagtaaccatttaaaatgataaaaaccactgtcagctctgggccacacaaaaacaggtgtcaggccagttctggcagggtgagggctactatggtgggaaagggaaatggaagccagtagagcttctcctacctagaaaaatagtaaatcaaaaacagtgtcatatccctggagggattgcagagattagtgccaccatcaaggacttgaaagacacagaggtggtgatcagcaccacatccctgttcaactctcccagttggcctgtgcagaagacagatggatcttggagagtgacaatggattatcataagcttaaccaaatggtgacttcaattgcagctgctgtaccagatgtggtttcattgctcaatcaaattaacacatctcctggtagctggtatgcagccattgacttggcaaatgcctttttctccattccggtccattaggcccaccagaagcaatttgccttcaactggcaaagccagcaatatacctttactgtcctacctcagagatttatcaactctccagctttgtgtcataatcttgttttttttttcttttgagacagagtctcgctctgtcaccaggctggagtgcagtggtgcaatctcagctcactgcaacctctgcctcctggattcaagcaattctcctgcctcaacctcctcagtagctggggctacacgcgcgcaccaccacgcccagctaatttttgtaattttagtagagacggggtttcaccatgttggccaggatggtcccaatctcttgacctcgtgatctgaacgcttctgcctcccaaagtgctgggattacagacctgagccaccatgcccagccctttgtgtcataatcttattcaaagagatcttgatcacttttcacttctgcaagatagcacactcgtccattacattgatgacattattggattggattcagtgagcaagaattcacaaacacaatggacttatcggtgagacatttgcatgccagagaatttgaaataaatctgactaaaattcagggaccttctacctcagtaaaatttctacgggccaagtggtgtggggcctgttgagatattccttctaaggtaaaggatacgttcctgcatttggctcctcctacaaccaagaaagaggcgcaacgcctagtgggcctatttggattttggaagcaacacattcctcatttggttgtgttactctggcccatttattgaatgaccctaaaggctgccagttttgagtgggttccagaagaagagaaagctctacaacaggtccaggctgctgtgcaagctgctctgccacttgggccatataacccagcagatccaatggtgcttgaggtgtcagtggcagatagcaatgctgtttggagcctttggcaagctcccataggtgaatcacagtgcggtcctccaggattttggagcaaggccctgccatcctctacagataactactctgcttttgagagacagctgttggcctgttactgggctttggtggtaactgaacattgactatgagtcataaagtcaccatgggacctgaactgcctgtcatgaactgggttctttctgatcaatgtagccataaaatgggtcatgcacagcagcattccatcatcaaatggaagtggtatatacatcatcaggctcgagtaggccctgaaggcacaagaaaattacatgaagaagtggctcaaatgcccatggtctccactcttcccccctgctttctctcccccagcctgcaccgatggcctcatggggagttccctatgatcagctgacagaggaagagaagactagggcctggatcacagatggttctgcaagatatgcaggcaccacctgaaagtggacagctgtagcactaaagcccctttctagaacatccctgaagaacagcggggaagggaaatcttctccgtggacagaactttgagccgtgccactgggtgtgcactttgcatggaaggattttagccaactacattctaaaggttattgccacaactttgatcttaaataacagtgcagcgaacatccctgcatccctgcatggaaggaatgccatttcccataaatcaccaaatcactcagaatgactacgcataagcccttaatatacgccagatgcattggttattgttttacaagcgggacctcaagaagactttcataatacggaataggatgatgcaaagccctatgctcaaggcccgatctttactagaaaactagtattgggaggttacatgttttccccaaacagatctttgaggaatcccgcagatgccaaagacctgctggcctaagagtagacacttattttctcacagttctgaagctggagagccaagataaaggtgtttataggtttggtttcccctgaggcctctctccttggcttgcaggttgctgcctccttgctgtgtcctcacatggtctttcctctgcacactcatttctggtgtctcacttctgcgaatgcaaatttttattagcctgggttaataatttttatatcagcctggcagattctatcactgatttacttgattatcctatttacttgattattaaactccttctctgctgaggtcacccattggtgagcactcgcatgggatacaaatatcttcacagtttttgatcactcagagggatccatccacatagctcttccccaaatttctttgtcatcaattttccaatcatgcttcttccaagtccctgatcatccaaccaaaccattggctacagcctatgaatcagtataaaattgcatatctggacatttctccttccaggcagtgctgagaaaagtggacatccacatgcagaacaatgaaactggacccatctctctccaaataaaaaatcagcccaacaaggattacaaacctaaggataagacctgaagctataaaacaactagaagggaacatagataaaattcttcaggaccttgggatacacaaaaatttttatgactaagacttcaaaagaacagacaacaaaaataaaaatagacaaatgggagtttattcaactaaaatgcttctgcaaagcaaacaacagattgaagacacccttagaatgggagaaagtattcatgtgaataggtcctaatatcctgttcatctgaaaaggcataatatccagtgtaagaatagaggacaaggctctaaaataactgattagcattaaaaaaaaaaaaagtgggcaaaggacctgaatagacttttctctaaagaagacatacaaatggcaaacaggtatgtgaaaaaatgcttaaggtgactaataatcagggaaatgctaactaaaacccaaatgagatatcatctcaccgctgctggaatgactatcatcaaaacataacaaggctaggcgcggtggctcacgcctgtaatcccagcagtttgggaggccgaggcgggcggatcaagtggtcaggagatcgagaccatcctggctaacatggtgaaaccccatctctactaaaaatacaaaaaattagctgggcatggtggtgggcacctgtagtcccagctacttgggaggctgaggcagaagaatggcatgaacccgggaggtggagcttgcagtgagccaagatcgcaccactgcactccagcctgggcgacagagcgagactccgtctcaagaaaaaacctaacaaacacccgtgacgatgaagagaaaatagaagaaaaaatcacatgactgtctcaacagtcagatcaaatgttttctttcaaggaaacatttttgttggttgttttttctagtcttgttagagcatcacgcatgataagatttgtggtacagaagttagaggggatgttgttccatgcaaaatatctgaatatcccatacccaactcttcggttacttactgataaatgctaaaaggttacaattttgtattttcaaatattctggtggccagaaacctcttccttgacaagtctggagtacaggtatctgactccagatgattagaatttaggcaggtattgtgtgagcagtgaggtcacacacaggaaacgttccagtcaaagagaaaaacagacggaggctgaaacacagagatcatatgtctgagaaataaggaaattccatactaatgggagctgagtgagaacaagatatgaaccatctatttctctctgaatatctcattgggatcttgtccctttcccagcataccactcatgtggattttaaaattgtctgctcttaaaacatttcttgcacatcattagagagtccagcactggaatcaagctcagtttgatgagaccagggcagttaagcaccaaacccaggtgttcttagaagggcttgtagaagacaaaggtgtgttgtcaaaagcagagaaagtgagactttccattgtggtttaaaccacagcttctggaatttcattgggcacacaaatcccctgaggattctggttaagatacagctgtgccctcagcacatctgggtatggccccagattctccatgtctagcagcttccaggtgaggctgatgctgctggtcctccaaggacattttgagtggcttagctcctattcaccctcctcacgcaggcacaggtaagactcacctaatgaagaaacctgagaagcacaggtgaactctccctcccctcctggtgtcttagtaccttttgtgttgctataaaggaatacctgaagctggatagtttgtaaagaaaaaaaagggtttattggggtcatgcttctgatggctggaaagatcaagattgggtatctgcgtctagtgagggcctcaggctgtctccactcatgatagaaggtgaagggaagccggtctgtgcagagatcactgggagagagaaagcaagctttttttcctaacaaagctgcagggatgtaattgagtcatattcataaagtgctcaatacagggcgtaacatattcaagtgctccttagtggacagcaattattactgaccttgctcatgaaaattagacctcagatggaggaaaggcagtgccgagggttttagattgttcgaaataagagagattaaaatgatttaaaatagaggcccaggagctgaggcaagcatccccaggtgttctcctgccaactccccccatgtctcagaagctgttttcaggcaagtcagccagggaggaaagtgggggagtttgtagaaccaaggattgcaacttcatccatgaggaggaggtgtagccagccaggtggggagaggctgctaagctcatctgaaggctgttgaaggctttctggccccatggtcctgggccatccctccctgcccagggccgcattcctcagctgacagccacaaccttgagagaggcctgtgagtctgatcagaaatcctgccagggccccgagggggcaggcatggaagggaggtgtctaaggtcacaggagacactatttgctgcctgtggggctgggacaggctccttgagaggaaattcgggcactgtacgggaggaaaacacaggacagggaggcctctccccaaaggattgtgatgatagagaccaaagcatctgcaaagagcccagccctacaggggattctctgaacacagcattcctcggggcgtctgtgttattttgccagggttaccataataaagtagcacagactggatgctcagagaaaagaaatgtcttctccactaatctgtaggtgatgttagaatctgagatcaaggtgttggcagggttggtttcttctgaggctgagcgagggcctgttctgtgcatctccctggcttcaggtgcttctggaaggatgtgctgttccctgaattacagacaaacaccccaatctctgcctccatgttcatatggcattttccctatgtgtgtctctgaccatgtttcctcggttttttgtttgtttgttttttgctgttgttgttttgttttgagatcgaatctcgctctgtcgcccaggctggagtgcagtggcatgaccttggctcactgcaacctctgcctcccaggttcaagtgattctcctgcctcagcctcccaagtagctgggattacagatgcctgccaccaccttcagctaattttcatatttttagtaaagatggggtttcatcaggttggccaggttggtctcgaattcctgacctcaggtgatccacctgcctcagcctcccaaagtgctgggattacaagcctgagccactgcattcagccatttcccccttttataacaacaccgctcctgttggattgggagcccactctacttcagtatgatgtcatgttaacccattacatctgtaaccaccccattcccatataagatcccattttgaggttctggggctgaggacttcaatatcaattcggcgggggggagcctacaatgtaaatttgtaacattgtctctgtcatgggccagctgtcaatattccctgaatatccaggatccacccatgctctctggccatcaccagagtgagcaaatccctgacacatggataagagttgcttccatgggctcccagccaggctggaaattcttgattcatggaatcaagaatctttctccagtgggtggggctaaatgcagctgcctccctgacagtctccctgggacactaggcttatcagcttttctcctaaagctgcaggtcctgactgtcctgagccccagctctgctgtggtctttgcatcttaagatcttattcaactcgcttttgtgcctcagtggactgacttacaggaaaacagtgggagatgcccctgctctctctccccagggtctcctcccctcagtggcacaagacctgccctattgactggcagtccccccatgcccatctcaacctccacactgcccactgtgcacggtcacaggtcacaaactgattgttcactttgggcagatcaccttgacagtttctgcagaactgggtgcttcttcccagaatcaggaatttacaaacaaggccagttctagagatgcaactgggagagtaatgtgcatcacagcgaatctggacaagacaaagtggttttgctgtagttctcctggaacacattctggtgatgtgtccatctcccaggatagtcttagcaagttacatccaatgctgcatcaggacccacaagaaaaggaactggcctgcatgagtggccggcagggtcctgggaggagaccctgagatgcccagtgacaggaggagtggattcttaggttggtaagcgtgtggaggaactgcgagtgatgtgctcagccaggtacaggagcaggcgtattggtgacctgtggcctcatcttatctcagttgtctctttagaccaaactccaggaaatcagcacatagagacttctgtctgtctccgagatcatcgcaggacttcacacgtcttttctatttataatacaacatcatgttgtgattgaattactttcatcacagcctcaacagtcctaggtctgaaaactaatacatatacttagaatattaattaaggaatactttcttgtcaattatgtttattaaattaaaagacttcagtatctagtgttacagctgtcctaattcaacagccttgaccttcttagaaataaaatcctgatcccaaatttttctggggatatgactggcacaaggagccaagcagacatctggatgtcccagtgtcactgctgacatgtgcttttttgttatctgtcatggggtgaacagaggaagtgtccctacctctgtccacagaacccatcaaagacagtgcacctgattaaagaagagagggttgtgatcagaggggtccggggtcctgggatgaggtgggaggaggagactcatgggaagaaaggaagcagggcaggaagaagctgaagttcaggctctgaggtgcatctcctgcatggaatcttgactccactcacttctgtcattgtgtaatctttcaatgttggttctgtcatcagtaaacttgaggagaggttatgccataagcatagggctgaggaagggttattataaatatccagtcatggttgtgcctataaaacactcaccaaagactctgaatatattaaggtctcataagtagttgttttgcataatctagtgatacatggaggatggcattcctcctgtggacagcaggaggcactgtgggtgtatcgtttggggatgctaatagctccaagtcccccagtagagctcacgtgcaaagggtgtgactgatgtttcctttcaggtccagtctttttgagtacaatccactctccactcctgacacccacttggcccttctcctgcctttgagaaatgactaccctgaggccatcagctccagggctcagctatgagctcagacagacacgcttgggaatagagaacagatttggattcaatgctccttccttcttgagcttcaagaagaggataagataggagctggttgtgtccaggctccactgggcagcctcgatcagagctctcggaagtgcctcccaccacggcctgtgtctccttctacctcctgcccttcatattctccacaggttggagcatccagagaattcagggaaaccctttcactgctatttccccccagcactggtcctcagtggcattctttccagttctcctgtgcattcagcatcattcatgaaattatatgtttccaggtctctgtgctctgtctgtgctgacccagcccccgtctgcatctgcctggctgtgagcctcagccaaggtcacctacaccagtgaatagtatcaacagagaccaaggaggtccccctagtgtataatggaggttaagagtaatggcagcgacagcaaggggaacaggatccccagtcacttattgggctccagccctggggctgaatgctacttaattatcttcaacctccaatctgaggatgaggccgagtatcactgtggagagagccacatgtttgatggtgaggatgggtgagccacagtgacacagaccaagaagtgaggccaaaacataccccctccccttcctcttcaaggactgagagtgagaagccctatgtcatctccattgaccctgagaatgttgactctccccctttcaaatttcatcatcccagatgtcctccctcaagacacccttaggcagaggcagatgcaggccatgattgaggccattttgataagtcatcaatctgtttccaccacaccagcctgtggggactacactgggagagaccagaacagcccaggcaggaaaacggccctgagagaggggtcgggctgagatgactgcatccagtgagtgccattgcaccctgcacccctgcctcaggggactgtcatggggctctgcctgaggaggcaacatggatcttgacatgtccccagccatttatgagaactgtagttgtgtgcatcctcattaacactcaatattattgtcagtttttgtttaaagccactctaatagatctgtagcgattcttattaattttttaacttgtattttcttagcaacatcaggctgagcatcttttcaggtgcttgttatctgtatatcttctttggtgaaaagcttaatcaaatcttggtctatttttaaaattcacttttccccatattccccttcatgcagtatttttcaaaaatggtgaataaatgaaagttttgctgacatttaaaaactcacagaattgttcaccaccagactgttgctattagaagggtaaaggatatccctagacagaaggaaagtgatgtcacattgaaatgtgaatttacacaaaaaagtgaaaacatcaggctgggcccagtggctcatgtctgtaatttcagcactttgggagactgaggcaggagtattgcttgagcacaggagtttgaggctgatgtgaggtatgatcataccactgcagtccagcctgggcaacatattaagaatctgtctctattaaaaaaaaaaaaggaaataaaaaaattaaatatcaggtacagtaactacatagatacttgtgaaaacctctgtattatgttaatgccaataaaatacagttcactgatcaaagataaattaataaaatacattgtgatttataatgaaaataaaggcaaattatatgacaaagacagcacaaaatctgtggtgggtgaagaacatgttatcaaggtctcatatgggaatgtgtaacaactgcaggtagattttcataagatctctatatacataaaccttaaagtagtcattaaatcaaaccttttgatcaaaaaagaattagagcgaataagctacattagggttatccacagaaacaaaattggtaagatatatatgtgtgtataacatacatatgtgtatatacacatgcatgtatgtgagcatatcgagagagagagagaaacttaaaagaagaaattggttcataggattgtcctgtctgacaaggataaaaatctcttgggcaggctgaaggctggaaatgcaggtaagagttgatgttgcgtcctgagcctgaattcagcaatacaggacttaagaaatcctcactctttgctctaaacacctaaacactttcttttttttttttttttttttttgtgagacagagtctcactctgtcacccaggctgggttacagtggtgtgatctcagctcactgcaatcgccacctcccagcttcaagtgattcttgtgcctcatcctcccaggtagctgggattacaggtgtgcaccatcacatccacctaatttttgtatttttagtagagaccggctttctccatgatgaccaggctggtctcgaactcctggcctcaagtgatcctcctgcctccttggcctcccaaagtgctgggattacaggtgtgagccaccaggcctggcctgctctatacactttctactcatgaatgaggcccaccgcattgtgatgagtaatctgcttatacaaagtctactgagttaaatgtgagtcacatctggaaaatatcttcacataaacttctatgtttgtactggacaaaatcaacctggaaccacatcctagtcaatgtgccacttaaaattaaccatcacttaagccggcatgaagatagaaaggaaccattttttaaagcaatcaaaaacagagacagagaaagggaaagaaaaacaaggaacatatccatagattgtattttttaagtcactttttgaggttttctgttgttttcctgttttctatttcattgatatttggctcttaactatattaataccttttctctatttaaattgaatttcaatgctctccttttccttagatttatgaggtagaaccttagtttattttagatcttgcttctttccactgccaaacattcaatccaatagatttatttaaaactacttacttatatctattttttaaattttaatacatttgtttttgtgttttaaaagttcagtattttctaattttgttgtgatttttttctttgacttatgaaatatgtagttttatcttctttcatttccaaaaaattgaagatttaccacagttcatcatgtatcaattccatttaattagttaattctgcattaaatcataccttgcatgagcttcatattttcaaatttgttaacatttgttttgtggcctagaataggaagtatcatgaaaaatgttccctgtgtatttgaaatagcaatgtttattctgctgctgtgggtatagttttctacgaattcaattagcctaagttggctaatagttcaaatatatattcttactgtttttttgtgtatttattttgtaggtctgtgagagagagagctattgaaatgaacaacactaattgtagaatttcccattgcttcttttgagagaggaaaatttccagtcatggttcttaatactttattctcctgacaaaaggtcacctatgattttccaacactaatcaaggaaaaaaaaaaggcagagttaaagccacactcatggatgccacgggagcagtgggtgaccacatgatgtccctccactggttcagtagatttagcgagacattatattttggcttttaaaaatcataaatctggctaagacatccatgaacaaatttgaagacatacacattgaataaaatatgaaaattaaaagaaaggtaactgcatacgtaaaacattgctatcacagcacctgactcatgggaaatggataaaaagtattataaattcaattacatttacttacacattaaacaaatatgaatttaaaccagttcactaaactgtctcatatactgtttaggtgatggagatttattggtgcacaaaaaagacaagaatacctgctctcagagtggcatcatggaagatggtggagtacgaagctccagcaaatggtccctcctgtgaaattacttgaagtggcaagagtcatgacattaactctcataaaacaacagaatcttgtcccacatttgcagtattcagggatgtgccgatgaagagagagacataaaataatctctgtcaggtcaatttctggccatggaaataattgaacagaaactgcatggatcactctgacaaggaagctggtccttaccaaaatattttggaaatgtcaccacgcaattgaataacagcacctttcagcaagcaacatcagccaaggcagagaagagagacaatctgatttcgagagtgacaatatcataacatccaaaatacccagatctcaagaaaagtttacaaagcagacaaacataaaagaaagcaagacccactaaaaggaaagaaataaatcaactgaatgcattcctcaggaagcacaggcattgcacgtgctacacaaacacttcaaatgaactgcccgtatatgctcaaaaagcaaaaggactccatggaaacagaactaaaggaaagcagggaaatgatgtttgaacaagcatgaaatatcaataatgacaagttttataaaggaaccaagcagaaatactgaaactgcaaagttcaatagctgaaatcaaaatctcaccagaggagttaagtagtggtgtgagcagacagaagaataatcggtgaacttgaagatacatcattgaaattccacaggatgagcataaatttttttagaaaagaataaatgaacaaagcctaagagacatatgagacaacatcaagcatatcaatattgctttatgggagtttcagaaagagaagaaaaacaggaaaggaaaaataaaatacataaagaaaaatagctcaaaacttctaagtttgatgaaagattagaatctatactttcgaggagctcaataaactccaagcaagttaaactgaagtctgcagtgagacacattctgatcaaagcatcaaaagccaaatacaaaaggaaaagtgtaaatagtaacaaaaggagagttggggtagctaaagcaatttcagacaatataggcttcaagttaaaaatgcttacaagagacaaagaaaggcgttataattgatgaaataaccaactagtcaagaagacagaataattatgcaccaagggatagcacttcaaagtacataaaggaagaccaatttgaaaaaaaaaatatgtagatctataatataacttggagacttcacttctccacttttactgaccacctaggccgggcatggtggctcacgcctgtaatcccagcactttgggaggctgaggcgggtggatcatgaggttaagagatcgagaccatcctggctaacacagtgaaaccccgtctctactaaaaatacaaaaaaaaaaaaattagctgggcatggtggtgggtgcctgtagtcccagctactcgggaggctgaggcaggagaatggcatggacccaggaggtggagcctgcagtgagcagagatcacaccactgcactccagcctgggcaacagagcaagactccatctccaaaaaaaaaaaaaaaaaaaaaaaaaaaaaaagataataagagaagagacacaaataagtaaaatcagaaatttgggacaatagtacaaagcttatggaaatttaaattataatagaagaacacacaagcaattgtatgccaaatcttagaagatatggacaaattcatagtaaacacagattgccaatctgactcaagaaaaaagagaaaaaaatcaacagaaatatagaaaataagggatgtaaatcagcaatggaaacttccgaaaaaagaaaaactcaaaaccagatggcctcactggtaattctgctaaatgtaaaaaggagttgatatcaaccataatcaatctcttcccaaaacagattaagaggaagtacttcccagcacattcgaagaccctagcattagcctgacaccaaaggcaaacaaggatagtattttaaaaaaactaaactaaaggctaatattccttaagaatgagcatgcaaaaatcctcaacaaaataaaagcaaaccaaatccaacgttaagttaaggggaataaaggatttcaaagatggttctacataagaacatgaatcaacgtaatatatattaacagagtgacagaaaaagtgtatgatcatctgagtagatgcagaaaaagtgtttcacaaaattcacattttcctgattaaaaaaaaaacacacactcagcaaactcggaatagaaggaaacttctacaaactaataaaggacctttatctaaagccacagtgtacatcacattaaatggtggaagagtaaaagcttccctactaagatcagggacaaaacaaggactcctgcctccacaactactatttgacattgtacagaagttttagtcaaagctcttaggcaaagaaagaaataataggtatctagaatggaaatgaaggagtaaaatcatccctatttgcacagaacccgattctaaacgtacaatatcccaaagaatacacgcacagaaaaactaacaaagtgaataaacacattgaaccaagtttcaaggtacaggaacaactggacttgccacaacttttctttgttatcctgggcattagttctcttggcctcaattttatctttaaaactgggaggcttatactgcagttgagaaaaagacacaaaaagaacctgttagttaaagatggaataagtgaatctcagagggtggacataggttggtgaggtcctgtccatctctgggggcatttttctggagtgtgggaaagcatgttcccagatgtgttagcaagatactcgcaattttctcaaaacaacagacaaggatagtgtagaaatcctcccaccacaaattgtgaacagtgtgtgatgaaataaaaataacagtcatagaaaaagatggcgatgatgatgataatgacttaagtacacaactaaggtttagtgatagaaacatcaggtgttcccaaattcaatgcagcttttcttataaaatgggggcaccagtcttagttcccatatatttaggaattgagggtccccatgaggtgtcgctgcatttctctgggcttttatgtttatcacagaagagctacagcttaccctgcactctccagcccgcaatcaaaaatcatggaccaaagaacaacatttcagcacaagactccattatgggaattgaatctgcccaccctcccgaaaccatatacacctttctgtgctgacatgagaaaaccacagtggatcacactggctcaaagtgaggctggactcctttgtccccaacctcccagatgacaggtgctgtggggtcacccggaggagaaaagctctcctaggctcagtcttgtccaccagcaaggggcagcagagctgcagccaggagcagccagaggctggggctgcccaggtggagcctaaggggtaggcagccctgggaggtctacaggtgtccaaggttcagtcctaggattggaagtcaggacagtccatcctattgcttctggttacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgaggtgctctaggagggggcccagtgggagaggatggggctcccagggctcaagtccttcacccaggatggccatctgagcatcctgccactctcggggcctcgcccctccctctccagcagtgtcctggggagctgaaccctgtcccaggcacttccagggacgcctgacccctcctccctctgcctctccttccagctcgagactgactctgactcatggggcagctcctgtgcgcaggggagtctcaggtgggtggggcggcacattcagggccccggttcctgggtggggcttcccgggcctcctagaggagatgctctccagagggaagggggttctcacctgattcaggccagagctctgaccacaaggctgtccttggctcagtgacaagagtctgctgcattgcagagaccagggaccacccaccatccagagctcacactctgtgcaaaggctgtgtccctgggatatttgcagagaccaccgggcctaaagttgaatttcccatcaatatttcatgtaaacttgtaaaaagcaccagaaaaacacactggactgagaaccccgatgcttttctggggccttttacaagtttacacaaaatactcataggaaaaaataaataaataatggaagagctgaggatggcaatggctgatctatgtggggatgggggatggcctaaaaggagcggcaccatggctgaaatgagagcagacgtccagatgatgccacaagggtgtgtggttgcgtaaatgaaccacctactcctactgaaataattaacaagtatcctgacgacacagtacgttatttagatgaaatgaccaggatgggactaagtaatgctgggggacccagagaggagggggaatatggtgggttcttggtccacctgctgctgagtcaggtttcatcaatgatctctcagcagggccaaactcagccccaagccaggtttctagaaggcccgcagccctgctgagcctggcccaggacagaccacaggtcagagaggtttgggacagtggtcatatggccagtccccaggaaggtgactgtgatcacaggcctcagaggtcgaggctaattttctgaccaaagacccaactccttcttcagtcacctgtgctgcccccacagctagtttgagtgacatctttcaatgaggagtcccagaggatagaaatttgcatgaacaccaagcacttactgccccatagggcctgggaaggaataagagaggcctggggagcccagctgtgctgtgggctcaggaggcagagctctgggaatctcaccatggcctggacccctctcctgctccccctcctcactttctgcacaggtgcttctcccaggccctgccccaggctcagtgcccatagaccccaagttggccctgccctgaaccctgtgcaaagcccagacacagtcttagggtaggacccctgggaatgggctcttgatcttcaagccccctctcctgttttccttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagcacagtgacactggcagatggggaagtgagacacaaaccccttcttcatctattttaccctctccctccagccccaggaccgctgtggaccaacccataagcaggtctggcagaattcacctggttaggagatccttaagctgcttttccctccactcctctaggcagactttgcaggaatgagtcaggagtggatttgggcctggcagggccagactgccctgtgtttccttgcccacggtttgagttgtgaatggagagtatgagtggaaagacagacacagcgggacatccatgcaggcatgaacagcccagagcgacaggggaaactttcagctctcagttcaatgcagtcattgttttatctcttggaagaagcatttctccagtgcaactaagactctagactcacagagcccgaggttgtgggggaggacattaaattttgctcatggatcactaaggacgtttttgagtggagccactacaatttattcattgattcctggactcatggatcctgactgtgggagaaatagtactgcatattgggcactgctgtacagcgcatgccccatcctcaaagtcattgcccaaccttacatgtttttgccatcctgctgccacagtaactgagtcttcaagcagacactgagccattcatataagccagatgccacattggtgaagatggtaagacacttgaatgccatgaggatgggcccatggttgctgtttatttgctgtgatatgagttccttggtcaaagccccctgtggaataccatcatggtgggtgaagcattctgtagtccagagataaaaggtttggcagaagcactgcagtcaaagaaagcaaatccctgtctatactaagtgtgtattctggcaagagcaaagagctatccctgccatgaaggaacagctttaatgaaattaatatcaaccaggcatcctatagggatcttcctgttggtcttcactgttggcagatggtcactcagcagtagctacagccaggtcagctctagtgagtggtagtccactttgatgagtccatggacagcctccttttctgcaaccatagggcatttgttattgagccaattgggcaatgatggcagtggttggggcagactgccaggtgtccagagagccacccatcctaccaacctgtttagcaaaatcaattccttctcatgtcagacttcacaaaatattcacataggagataaatattctcatgctttctgcttgctcacacatctctccctcagacacagttgtgatcaatattctgattgtatttcctgtgtccctgaacatccttgatcatcttccaagtccctgagtcacagcccatgaactaggaacctctgcccgtctctctttgcagatgacatgaaccaggtacactgctctaagttctgccttaaggagagtgttcctccaccactgctgttcagggaagcccagaggccaggtgggatactagcactgtccacagcagggatggctgcatgtcctgcagaaacctctgtaaccccagtctaagtgcctcctcctaggcagctggtcccagggagcccctcaggaggcccaggctgtaaggtgagaggatggccatggggcaggagttggcccgtgtctatctggccacctcttcatgcaacttatttgtccttgtgacctgatccatcaggtctcaggtacagcccagccatgtgatggggaggccactataaatggccacctcggactgggggtcagataacatccagctcattggcagcttgtgtcccatggtgagctctgtggccacagtcacaaagagcccctgttgaggcccaggagcccccccagtcttcctctaatggagctttctgctcatttagaaaaataacaatggggaggttgctcgcctacctcaggtctagggtcactgggaccacctagaccacatccatgatcttgtctgattattctgattccttgttggcttagctatgcattagtgtaaccaagccacagtgtcttaggcactaaaatgccactacttggcccctgcctaccctggggtcctgtcaaccacatcttggtatccaattcagttttagcaccactaagagaaatctatttttatattgagaacaggaaacattagttatttctattgtggaaattttataagacaatagtgtggaaatgttttaagagacattttacttagagtgaaagaccttccattaaaccactcaataaattgctccataaatggccagcccaaaccctgagttcagaccaggcacagcctcggtgttgggaccttctgggaatgggtctctgtcatcaacccttctctaccctcctgtctgcacagccctgggcctcctacatgcagggacagctcccctcagtgtcggtagccctgggacagatgaccatgatcatatgctctggagataacctcggaataaacacgcattttggaacaagcagaagccaagccagacctcaatgtcggtcctctagtataacatcgaccagccctcagagacctctgcttaatttttaggccacaaactagcgaacatggccaccctgaccatcagcagtgcccaggccagggacaaagctgactattactgtgcctcagattgtgacagtgggggcagctggcagggactcacagtgacaaagacagatggggacttgcaacaaactgtcccacttcagcctgcctctcattcttacctgccctctgagcagctgtaggtcaggcctcagaatcaggtgtcctctctggtcctcacctggtccctgcagggccggagattcgtaacagcttttccatactctcagggcctacatgtgttcaataaaacctgtacgggggaagctcgttgaagctgcaaggaccttttacaggtttgtagaacacatgagaacttcaggaatccatatagtgtcacatggctccatgtgtaattacacgtcacacagggaaggagagagctgtttcacagggtgcaatcctactggaattcgtcttttccttgcgtagaaacagcttagtggaagccgtgtctcctctggtttcctagatgagttgaccccacattgtaatggggcacctgaggcctaaggaggacaggagacccaacccctgtgggccccaggagccttcctgtcctgacatttcacagaaactgcagaggaagtgcaggcccaacctttggttccacctggggactgtcttcagggaacactgacctttcccagtccccaaattcccaggacctgtctgacctgactaggtgtgcctccagctccctgatagcttggattttatctctgggctctgggctgctttctgaggagctcactaagaagtccttggtgccaagtgcaggacttgcccctctgctccatatcccgggtctgcaggcacaggggacaggtcctgctaggtgaggctggcaccctcttccaggagggatctctcatcccaggccctagggacaggttcactgggctttcttttctcacttagaatctcttagtctttttgtttccttctttaagagtacaactgctttttggtgaaatcatgtgtatacatcaaagttaacagactactgtcacaagcgcatatatatacacatcctcttcctagatggggtaaccgtggacactctgccatagtcgtctttttgtttctctctctctaccacaagtgagactattaatagcactcttctatgcagaccataatcatattctccagttgcacaagaacgattcttatagttgctcaatttccttgcctttcaggaccctgaagtttcccatgcccacatttggttgccatgtctctctgatccaacagtattccttggaagccgaggcttatgaaacattttgcaaaaagttccacaagaaaactcaagttccttgtgcacagttggaccatgttcattgtgtgcagtagaacctcgttccagtgttgagtccattttatgttttgaccatcaaagggaagggcattatgacttttggggactgagtcgatggaggaaagatagcagtcgatgatgaccttatgcactgacgtgtatgtggccaatgtctatagatggatttggaacttgaaggagctgttcgttctgcagatggaatttccagtgccgcatctccaccacccagccactagcactcggcaggtgctctgtaagaggaagcccttcactgccaatcagccattacacaggtgaaggtgagtgagacttaatagctattaaccctcaaaacaaactgaggaataaactcaggttcacaaagtgactttgcgggaacagcctgaggaagcaagttaattagtagcagaaggttttgcccagagcaggaggaatcacaggatcactgaggacctagtgataccatggtgtggaggtgctgtgaggcatggtgacattcaagaaaacctgttctctacaaacacctacctacccacaggcacagcagacaccccagctatgccaagggctctgtcttcctctagagtaagagcctggtagcaaacaggtatcctctgaaaggcaggtgccccatcagtcagctctgcacgactgaaacaaaaggaaaattgccagagaactttccagaaaacagtcaacctgcttgtgctggtgcattgatggtgacccaggatcagtggaagtaacagtagcttaatttccccatggctgcatgatggacaccgggagagaagtgtggaggcggattaaccaccactctaagtggcttcagccctaggtaagcaggaacaagtgagggggctgagcccacttgtgtctaatcagtcccagcctcagcgactgcatcctggagaccaacagggagtgtatgcgctcagcccctcccagattgctgagcataagcaagaaatttccctccgcacacctgacgcaccacacacctgcccccagctcctcacttacaagacaatatcaaatcagacagggactggtctgggtcccagatcccctcaggttgccgctgtcctctcagatccccacacacagcagactcttcccctcacactcctgttccaggttactcttctccaatatgatgggggtttgctttcattgtttctgtattttttgtatttttatgggtaagctgagccccttttacctggtcttgagtcaggcaggggccacacagagaagaggaattcctccccaggggccagcagtccacggatcaaggcatcagggacctgagcagtaggttctgttcctatgcctggacccaggaggcccatgagcctccagcagtcagtatggagcagccaccaggggggcagcaaagagtcacctgggaaagccacctcgggatggggtggacctgggcatcagggagatgctgacatgcagggagggtcagtgaccacgacctgacacctggagggaaaataggtccttctttttctagagtgttgtccttgacactgatgtaaaaattctagcatcaaattttatcttcagcttttgtagatgctcctatttccctgacaaaggtccaggcacttgacttccccacacatcctctcctcacacacccagttgtgctaaaatgctgtccctgtcatgcacagtgtccttcctgaggtgacacgtgtccccctccctgccctttgctctgggagcccctgtcctgtagacacagcagcttcttcttccctggctgctccccatctccactgtccctgggctttcccatctgtctcctgggaaagctgccaaatcacaggtctcaatttccttgtgaggcacaaaatagttgctcattaaccttctgttgacttaattaagtttttaattccttgatttgttttccccagcaactgaagacaacttagtcataataaacattcacttccaggggtcttgcagtttgctgacccctctcattctctcatggagcaaacattttcttgacctccttatctgtcattggtcctcacagcaccctggggacactgaggcacagcatgtacgacctgccctggagctcacagccaacgaggaaacttaccgcatcccatggatcttccaacactccatgtgcacttggcaaccaagaaattttattcttctctagcactgaggagctgtgccctggggtggggtctgtacctatccaaggcacatgctgtcacctgtagagtgtggatagagggtccttgcattaggttctggaaagtgtcttcaaaaacggatttaggcctacacccaaaatctcctctctggcacaaattattcatgatcaggatacatctagaggcctagaccaaaattcaccacctccctcctgagccagaatggaatggaggaggggactggggaccccagataatttccccatcaccactgtgactctatggccacctcctgcaacagttagggataatcacataggaagggcttcatgtatcctaggaaaaacacccaaagtcatttatgagctctaccatgaccaagtgagcccaggagtcgggttgagcacagcgtggtgtggagatatctgcagagaccgtggaaccagtttgtaaaggagatcctgtaggctgagggtgagagtgcaaggccactcctccccctctctgcatcctttggggctaagcccttctctggaaaccacaaagctcctccagtagcagcccttgactctgctgatttgcatcacaggctgctctcttcagcaaggggataagagagggctggaaggaacctgcccagcctgggcctcaggaagcagcatcgggggtgccgcagccatggcctggaccgctctccttctgagcctccttgctcactttacaggtgctgcccccagtgtcccagccacctacccagctccaaggctctgggtccagcctggcctgacagtgatctcagcagggccctgcctgtggtgtgcaggatgctcatgatcctgctgcagggggaggggctgctggaggtgaaatccccccacactgttcttctgtgctcatggtcccctgaggacacttctattcctgaaactcaggccaggcaggtgggaaggcattgttgggttgagcctctcagtttcaagtctattctattctctccccttttcttgcaggttctgtggcctcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactgcacacagtaacacaggcagatgaagaagtgagacacaaaccctttcgccatctatgtcaccctctttctctaattcaaggaggactatgaacaaagccttacgcagatctggttaaattctctttaatctctgcccccagcctgtccctccctccagtccttcaggcggggtctgcagaaagtgcatcagtagttcatttagggtgatgtgatcaggatggactggtgttttggtgactcagctgtgacttgggaaaatagggcctgcatggaagatcagactgaggtagacatccacagttgtctctggatttccataggtggtgacaggccagtccttgccccaaatgtcctagatcagtccccagaactgcccagctcaggctcctgtggtagcctgtcattctttagagaaacaccaatggagtagacactgtgggatctgcccagatcccctgttctgagcttacccactaagcactactgggagcttctggcaggtcagagctgtgtcctcactggaaagtgctgttcggtgcagaaaacagactcctccaggtctatgccctttctcagtgaggttagatttcatgactgcctgaggccgagttctcgactctgcctcaatataggaagacctgaaaatcctcccagctccacagctctctgtaggaaagacttgagacctcaatgagggtcagggtctcctgcccagggttgcctccctcacctcctttcacatcctctgtgcatgcaattcctcatctcagagtctgcttccagggaacccaattaagatcaccagccatccccaacatgggccatgtgggacttcaggaggccactgtatgctggaaagcacctgtttattcctaaattagcactgtgagtatccacacgcccaatgagatctgagtgtttcttgcatttgcatggaatgagaagggagcctgactcgccaggtgctctggggtctaagggagagttggagtcagatctccctgcagggaaacctggggcaggaggagcagccttaccccatgcagggaccacagatgcacccacagggtgagcttaagtatggacactgcctacctccaccctccacatcctgtgtaaaaaatcattctttccacccctcctccagcctatcaaagttgacacttaaaaagccaccacaacccacccttgtcaacaggaaacccattcacatctccatcagccacacaatctccacataaagattcttcaaaaaataataacaatagccatgcaaagtatatgatatatatcataaataattgtacttagattatatatgaaaatgatactctttttgatatgctaggtaaataaaatacattatttaaactcattgacttcttctctttgtatttataacatgatgactagacagtgggattcccatgaggctcacatcacattgtgattgaacaaggctggtctgcagggcttcaggttacaggggctgtggagtgacctggtgcaggaagccccgtctccatccataggacatcagtgtgaacccagggagaggcgctggtataagagagatgagaacacaggtgtgaaccacctgcttgtgcaggggactgagccttcactttgagccaaataagttttctttcccaagttcgatcctgaacaagagggctttctggacttctttttgttttcaggtttgtgccccttcaggtttggggctgtctggagtcccagccaggggacagtgaggaaatccagcagtctcacactgactctgttgtatttcatctgctggggccatcccaaactgctgcgtaccatttcctttcctggtgctcaaatagctgctccatgcacttgtcatggttttatagctcaatctagatgggaagacaggatagtgtatgttacaatatttaaatagaacctgaatcccttaatagttattttaatatggaacattaaaagagttgcatcataggcaatggggaaagatgaagaaagattaaacgcatttggaggaaaaactaaaaatgtctttattgaatgtctgtgtgtcttcagtgacgaagggttgagagaggtcagctttaggttgtcctgaggatgtgctcagatgggggaaagtaagaaagcaggaaacgtgcatctctgtgacctgacacataaatcacagtaaaatggaagtaaatctttcaataaacctttcaagataacatcactctggtgcacatagaaaggcctgttagcaaactttcccttttccctgctggctcatatccccatggatcacctgtatgcagaacggactctgtggtctccatttatcaggctgagaaccagaggctgggaaggacaagtcacctgctcatgagtgggaggggcaggattgggagcagcggactcaggctcaggactgtggccctggttggtgctccttgttcccttcacagggtcccacccacatgtgcccgtgtggatgtgggtgcactgcctggggtggctgatgtgctccagggatttgatggtgcagatgcttcaggacaaagcatgggagtggggatgggacgagctgccgctgggcagaccaaggaccaacgccacccagcagaggcttccagtggggttgggcagccccatttcctgagaatagagagaacctggcaatgagtgccagaaagaagttacttcgaggtgtgcccaggcctggagggtcacagagacacaggcaccacacagcagagacactgaaggccaagagctcactcaggtgaagggcttcaacagatttttctctcctgagcaaatcacgtgcaaagaaatcaacttcctgtcatcagaatagacaatcaggactttagtctccttggctgagccccgctgtcaagggaagcagaagtctctaagcccaggcccaagtgagggtggggtgagaagaggagctcaggatgcagatttgcatggaggtcccgcccttctctgaggcagagggataagacagggctgggggcaggcccagtgctggggtctcaggaggcagcgctctcaggacgtcaccaccatggcctgggctctgctcctcctcaccctcctcactcagggcacaggtgatgcctccagggaaggggccacagggacctctgggctgatccttggtctcctgctcctcaggctcacctgggcccagcactgactcactagactgtgtttctccctttccagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttccacagtgttttaagtcaatgaggaagtaagatcaaaacctgccctgggctctcaggccccttcttgctctgcagatgcttcctcacgctgtataagggtttcctgcaggatggccttgacaattctcctctctcagctcctctcctttcccaccatgaggtctaaaaggaaacctgctcgtgatttctcgttcaggactgtggcaacttccttttgcttgtgtgctctggtcccttaacgtgcaactattcctagctcttcaatgcagggacgtagggacaaggagtttactgcttggtgcagtccctcctgttttcaggaacatcctcattctaaatgcatcccccatctgccacactatgcagatcaatctggacagaagccatcagggggatggcttccagtttccaggaattgcatcttgttccactctgtgtccaccacgctctaatgaagatggccctcctagctggtctattcctctgcacctgggtcctgaagcagtgaccactttaagaagacttgaagatgtttttgagggattaagaacaaagaggatgctgctgtttttctttttattgctcctgctctttgccgaaattcctcaggttgctgagctggggagattttgagtgacaggctcagtgctctcgcagaattctcctcccctcacatcgctgaggccctgtcctggaaactcctcacaagtggacggtcttcccataggatgggggattccaaaatggctccacaggaaagagttaacctgagtccacctcccttcctcatggacatcgagcatttctaattttcatggctgtcaatacttttgtacctggaatccctaataatctaatggtgagaattgatttagaacacattcggacattagctgggtccaatatttaaattttctgagccagttgttaaatacagctattatcatatatagtttaggctccttaaacttcgattatacagattatatttaaaacaaagtaactagtttactatatatatttacaaagtaactactatataacatcatgttgtgtacctgaaatataaacactaaaatttatttcaaaaaccaaagtgtattgtctattgatgcataaaaaaacactcacaaaacttagcacactaagagaacacatgtctgtgaccttgtgacttggatgcacctagaattgggagtagcttagtttggtcattctcgctcctggttaatcacgaggttgcagccaagctgtcaggccaggctgcattcaggctacatctgccaaagaggttaggaactgtggaagcctccctctggctgtggaagcctccctctggctgtggaagcctccctctggctgggagacttccgcagttcctaacctctttggcagacgtagatcatctcaaggataaaggagagagtggagtgaaggcccctgtccttgtcctccatgtaaaaggccatcccatgcatgcactattttttattctttgctgagacatcctaggcatagagcactgccccattcattcaaaggttgtagagtattctatggtagaattttagccaactcacttttaatggttattatcactattttgatcttataaataacactgcagcgaacatccttatgtagactcctttgattttatatgtagacatgaccatagaataaatttctagaagtcaaattgctgagtcaaaaggatgtgtgcttgtaattttcactcactgtcctcagattctcctctagaggggttatctacaaattcgcaatgtcagccataaatattcgaacagagtacactggggaaagtttaaatgtttttcaacctagcagatttaaaaatgttatctttttttagttttgatttctcctgttctgcttgaagttgagcattttctctaatacttcagtgctatttatttttataatttggtaaacattttcttaaatgtccagataagaaggattttggtctgtggttcccaagagtcaactttgaggatattctgtaggtatttttagcaccatttatagtgtaaccatttaaacctataaaaaccactctcagctctggggccatggaaaaacaggtggcaggacagggatggcccacaggatgtggtttaacggtccctgatttgtagggtaatttgaagtttgagaattccaccgcatatgttctaggtggagatctctatttgaaggatactgtattttacctcctatagtggcctgaggcttttggataagaacatacttgtatcatctatttaattggatcttgggtcttcccaggacagccctgtgtcacagtctcatgtttttcatctcatccatttgctctgagttttcagaaagctttagtatatcagaaatagactgaccctaggtggaaaatcagaggtaccgggagcagcaaatggtcagggaagcttgcaccaactctggaataaaccagtacaggctcagagaaaaacatcataaaatcagcattgtagctgaaaccaaaaacatgcatgatctttgaagttctggggattataaataaataaatgaagtttaaggtttaaatgtgttgcaaatttacataaagcatgtagattttaaaactcagaatgcagcaatgaaatatggaagcttgagattttaagctgttaaggccctacaacaaattgccaggaacagaacaggaacttgatagtcataatgtcttatgctggaaattatcattttctctaaatgaaatttttttcccttttttcttagacataaggaaacatctcattgaacacccttcttttccactgtcaaacacccttacccagaaaggaactgtaacattaagtaggaaacaactgctttttttcataactattgagagatttctttatttgcacatcaaaatgttgattgtcaatgctaaaattggaattagtagtttaatatgcacacaagagattaattttgtttggattatcccatttctgtctattatttgtcttagttaactcagacatattctgcttttggtattttttgttttattttctttgccaactacatgtaaaccaaaaataaaattctaatgctcccccaacaaccccaccatctgagtggactctcttctcttggtgggggcactccaaagttaatctgaaagactggttcaggccatggcagaaaaggggtgtcagacatgtctcattaagcccttttcctttttggaattcaggaaaagccaacctgcacttaacatcaatacaaatcttaagtctgataagaaacatttacaatctattctctctgaagcctgctacctggaggcttcctctgcatgataaaactttggtctccacaacttattataacccagacattcttttctattaatactttcaaccaactgctatcagaaaaatttaaaatctatctataatccagaaggccccacaaccctgcctcccatcaccctcttgttttgacttatcctgcctttctggactgaaccaatgtatatcttgaatgtatataattgatatatcttgtctccctaaaatatataaaaccaagctgtgccccaacctccttgagcacaagctctcagggtctcctgagggttgtgttcaccagtcatggtcactgatacttggctcaggataaatatcttaaaatattttacacagtttgactctttgtcaacatatggctcttttcaaaacaccatttgacacccagacataacccgctgctaatgattacaaaattcaattttattagcatttaaattattactttaaattatttcaagaatgcatggatgtgatttcccccacatctaactcacaaatgttgctgatgctgacttgctcttttctttcagtcttagcaaataaagagggagtttacttttcttgataccagaagataacaggagaaagtaggtgaaactcccgaaagctgttatcgtttccaccctcaggatgaatcacacaaggagtcacctgcacttcatttggatgataaataaatgagatggatcttagagttggtgctgatctagtcaatgatttgggatgttgggctgaggtgaatgtgtttcacaggtgagaaagacatgagttttagagtccacagtgtggagggttattggctgaagtgtgcccgagaattcatacaatgaagctctaatcacagtgcatgaatgaattggaacataggtctttaatggggtgattaagtgaaaatgaagccagtaggatgggttcttttccatctgacaggtgtcctctgaagatgaagaaatttgagcacacagaaatgagacaccatagatgagcatgcagaggaaagatcacgtgaggacacagaagaagggagtgatttgcaagccaaggagatgttacagtagataactaggcagacgtgacagggcaggagaccccctgccccaggaatgtcacgcaagcatcagatgatggtcaggtagttgttaaactgtctctgtgaattaataattagtcacagccggcaccaaggaaaggcggtctcccaatagatagaaaatacctgaagctggtgatcagcagctttctgataagatctcaggccttgggtgagtgggctcaagcaggcaaactaaaaggcaaaacagaggccaggcatggtggctcacccctgtaatcccagcactttgggaggccgaggtgggccaatcacttgaggtcaggagctctagaccagcctgaccaacatggtgaaaccctgtctctactaaaaatgcaaaaattagccaggtgtggtggtgcatgcctataatcccagctactcagaaggctgagccaggagaatcacttgaacctgggagatggaggctgcagtgagccgagattgcatcactgcaccccagcccaggtgacagagcaagggtccttcaaaaaaaaaaatgcaaaatagcagagtttaacctggatctgagactcccatgctgcccttccctccagccctacaggcaggctctgcagagagtgaatcaccagtaaatacacaaacaaatatgattacgttccttttgtttaagaagtagaggaatgattgaatatattaagtgaaaataaggaataccaacacaaagaaaaatttaactgtaagtatggttaaaaatacactgggtgagatagacaagttagatgtcgcaaaacaagagattagcaaactgtatagtgtaacactagaaactattcaaaatgaaacacatagcaaaaaataacgataaaaataaacagcatcaatgagatgtaggagaacttcagacaggctaatatacgtgtaattgaagtcctcagaatagaagatggggtaagaatgaaaagaaaaaatatttgaatgaataatgacaaaatatgttccacatttggtgaaaaccataaactgatataacccagaagctcgataaaacttaagcataggaaacacaaagacaacaactccaaaacacatcataatcaaattaataaaatctagtgatgaaaagtagtcatttaggacaaaactacaaagagcagatttctcattaggagcaatgcaagcaagaagatagtgaagcaatgtcttgaaaataataacatgcaaaatccaacaaccttgaattctttatccaccagaaacatctttcaaaactggaggcaaaataagactttttcagacatgtgaaatcctacagaattgatcaccattagactctcgctattagaaatgataaaggacacccctaaacagaaagaaaataatcctacattgaaatgtggtttgacacaaagaaatgaaaaatcagatatggtagctacctggatcaattagaaacctctgtattatgtaatgtctataaaaagaacagtaatgtctataaagagaactgttcagagaaaaattaataagaatacactatgatttgtaataaaaataaaagcaaactatatgacaaagcagaaaagcgaaggtgggtgaagaacatgtaataatggttttgtactatatgtgaatatataatagcacctgaaggtagattttggtaagttatgtatttactgtataccctaaaacaaccattaaaataaaaccctcaacaaaaaagaaatatggctagtacgctatattagacttgtccaccaaaaattaataggatatgtatggatatgaatatatatgtataatgtatctatatggtgagagagacagacagaaacttattttaagaagctggttcatacaatagtggtggctgatggacaaaatctgttgggcaggctataggctggaaatttaggtaagagttgatattgccgtcctgagttcaaattctgcaagaagctaatgtttccccaagacagcatcagctgttattatgcacactggctccaaatcgaggaaagtgtcccccctgaccattagcagagctcatgccaagaacaaggctgatcattaacatcaatcactgggaaacttcagtatttattctaaaaaccttgaactcattaatgagactcacacacattgtggaaagtagtattgatacaggagacagaaattatttaggcagatagtgagggtgacagggtcctcagcagagcttctcatctaacaaaaagcagccctaaaaatcatttcttttataacaaagagcagcctgaaaaaatcgtgctgcaaacatagataagcaagctggaagcttgcatggggcaatgccagcagctatgccaatagaaaagtactacctgggggtcagccatgtccaacatggaggctccatcttccctttttttgtcaccatgtgtatagcaatagagaaatgggcaacatggagcagctcaggcagataacccacctgcgtaataacagattagggcagggttggccagaaatgtgcaccctatgcaaatggtacacctagtcctaatcagtttttcatgccctgtgcaagtagcacacctggtctaaccagtctttgacacccaccttatgtagatcagatactgcctcctcaccagctcatctataaaattccctacatttcactgcagatccggcaacccatttttctgggtcccctctctgcagcagagagctattatctttctttcacctattaaacttctgctgtcaacctcatttgttgtcagatcatgtcctagttttccatggccctgagacaatgaactttgagtattcaccccagacaatgaggctatttcaatatgcttatacaaagtctactggtttgaatatttatcacatttgaaaaatatcttcatgacaatgtctacactggtgcttaacaaaatcaacctggtaccatgtcttagccaatctgacacttaaaattcaccaccacttaagccaggagctaaagaaaaccaatttttaaaaataaatttcaaaagagagaaaaaggaaagaggaacaatgaacatataagacaaatagaaaaaaagagcaagatggtatattttaacaaagtatattcctaatcacattaactataaatggtctaaataccacaattaaaaggcaggtattatcatctatattctaaaggagttcaggtagggttggtatgctttcttccataaaaatgtgataccagtgaagctatttgggtataggtgggcttttcttagcacggagattttaaattgctactttaatatctttaagtgtcatagacttattcagattttctatgtattcatgagtcaattttcataatttatgtctttccagaaattttacttcatttatctataattttggcatttactgttcataatattccctataaccattctcacccttttagtgtctatagtgatgtcattattttagccatggttttggcaacttgtgtttctttttcttttttttatcatggtcactttacctaaagataaaaatctattgattttattaatctttttgaagagccaagtgttttttttttttttttttgaggttttctattgttttcctattttctatttcatgaatgtttggctgtgatccctattattaccctctattcacttagaatttgaatgttcaccttttttaggtttatgaggtagaagcttagattattttctttaattctttcttctttccaatactaagcatttaatgccatagtttttcttcaaagcagacttagctgcattccttaaattttaatatgttgtgtttttatgtttaaaaaggttcagtatcttctaatttatgttgtgatttttctttgattcatggattacttaacagtctgttctttcactttcaaataattgaagatttcctatggttcttccggtattaattcaagttaattagttaattctgcattaaattatatcttctatgattttcatcctttcaaatttatcaatatttgatttatagcctaaactatgaactatcatgaaaaatgttccatatgtatttgaaaagataacatgtattctgctgttgtgggtgcagttttctacaaatttattataattaagataacttggcaaatggttcaaatctatattcttactagatttctgtgtagttattttgtagatctctgagacagagctattgaaatgaacaacacaaactgtagaatttcccaatgattattttgagagagatcatttttaaaatcatggatctaaataatttattctcctcacaaaatgtcttctatgatttccaaatactaatcaagggaagaaggcagagttaaactcacacttgtagataccacgggaacagtgagtgatcatgtgatgtgcctccagaggttaggctaatgtagttagagtggtttatatttatttatttatttatttatttatttatttatttatttagacagagtctcgctctgtcacccaggctggagtgcagtggcgctatctcggctcactgcaagctccgcctcccaggttcatgccattctcctgcctcagcctcctgagtagctgggactacaggcacccgccaccacgcccagctaattttttgtattttttagtagagacggggtttcactgttagccaggatggtctcgatctcctgatctcgtgatccgcccacctgggcctcccaaagtgctgggattacaggcgtgagccaccgcacccggctggttttttttttttttttaaacacacagttgggctaaaatatccatgaaaaaatttgaagcatgtaccttgaataaaatatgaaaatcaaaaaagttaattgcacacgtacaacattgttaccacggtgcctgccgcatgggaaatgaacaacaagtgttattaattcaattctattttcttacacattcaatgaatatgtattgaaacaaattcactgaatggtcccagatactgaataggtccttgagatgtactggcaaacaagacaaaaaaaaaaatacatgttctccgggtggcctcatggaagatggtggagtaagaagctccaagaaatggtccctcctgtgatataactattgaagtggcaagaaccatcagcattcactctaataaaactatggtatctcatcccatatttgcagcatccagggaagagctgaagaagaaagagacaggcttaaggaagtctctgtcaggtagatctctgaccacagagataactgaacagaaatttcgtggatcactctgacaagaaaggtagtccttgcgaaaatattcaggaaaagtcacaacacaaataaacaactgcacccctcagatgaacaactgcacaatatcagccaaggggcataatctgataatctgatcctgggagttaacaacatcacaatattcaaaatactcagatctcaacaaaaatttgcacagcatacaaagtcacaagagagcacgactcattcccaggaaaataatcgactgaaaatcttccttaagaagcattcatttgctcccatcttctcccttggttatataacacgtccttccacatatacttgattagagcttgtgccccacaaacatgcctggcatgtacattagtgacttctgagagggaggtgggggcaggaaacagtccctctggatacatttcgcatcacatgaaccagtgaacacatctctgcaaggtcctgcattctaataaacaagatttttctgtttaaaagaaaacttaagtctttcagaaaactgcatttcaaaagggaaccttgtctctgctgcttgggctgcagtgaggacagatttactaagtgctggttgctgtgttttgtcttctagtgtgggtacacacatctagaaaagttttaaagaagattggggaacccccacccagcactggtgggactttgagtttgctacggttgtgaacagaacatggaacagaggacaaggtggcccctcctgaagatgagagttttgcttcttgctggaagtccctggactcctggagtgttctcaggggacctcttaacaggatctcaagggaaagaatccagggtactggatccacacaatcaacctcacggatttctgagtaggtcattaacctatcatgcctttagcgttatctcaaattatacatggtatcatctcaactaatgtctaaaacaatatacggcatagatatctaaagaactagtggtacatggaggatggctttctacctctgagccctagaagggactgtgggccttggtttggggactctaatgactctaagtcccctggtagtgctcaagtgcaaagggaatgactgacgctttttttgaggccccttctattgtgtaaaatttattctgtacttgtgacacccacctggtccttcttctgaacatgggaaattgccaagatgaagtctccaggctaacggctcagacaggagctcagataaacatgctgggaagtggagagcaaattgacattcaaagctcctcccaacaagcttcaagaagagggtaacacaagaagtccttgtaaccaggttccacggggcagcctcaagcagagctcttggaagtccctcccaccacggtctgggtctccttctacctcctgcccttcattttctccacaggtcagaacatccagggaattcagggaaaccctttcactgctatttctccacaagctccaatcctcaggggcattctttccagttctcccgagcattcggcatcattcatgaaattctatgtttccaggtctctgtgctctggctgtgctaactcagcccccgtctgcatctgcctcactgggagcctcagtcaagctcacctgcaccctgagcagtgagcacagtacctacatcatcaaatggtatcaacagagaccagagaggtccccctagtatataatgaagtttcacagcgatggcagacacagaaaggaggacaggatccccaattgcttctcgggctccagctctggggctgactgctccctcaccatgtccaacctccagtctgaggacgaggctgagtatcactatggagagagccacaagattgatggccaggatgggtgagccacacacagtgacacaaagggaaagtgaggccaaaaccccccacctcccctttctcctcagggactcagagtcagcagtcacatgtccccttccaagtccctgagacttctgactctcctcctgcagagacacccctaggcagaggcagatgcaggccatgatttaggccattttgacaactcatcattctgtctcctcaacaccagtctgtggggaccatactaggagagaccagagcagcccaggcagaaggaccctgagagagtggccaggctgagatgaccgtgtcccagtgtctcactgtgccctgtgctcccttaccgggctctgccccaggaaaggacatggatcttgacctgtcaccccccatttatgagagttcaatgtgtgtgcatcctcgttagcacttgatattgtcagtttttccttaaagtctttcagatagagctgtagcgatatctaattatgtttttaacttttatttctttaatgacttattatgctaagtatcttttcaggtacttatctgtcctttgtatgtcttctttggtgaaatatttaatcaaatctttgcatttttaaaattcaggtttctcaggttcacatttcctcatgtatttgtatgagtttatatgcatgcatgtgtgtctatgcattccattctgtgtgatttcccaacatgtatcagcacaggtatccaccactacaatcaagacacaaaccaggtccatcacaacatttcctggtgtttccctttgataatatctacctcctcccacccagttccctcccttgcccaaccctggcaaccactgatttggttccctattcctaaaattttgtcttgcaaaaacgtgatacaaatacaaccctattgtagtagacagactttggggttggaattttttacttagcatcattccctataaagtcattggaaaggtgtgtgtatcaatagtcagttcctttcaattgctgagcagtatctcttggtattagtttaacaaaacctgatgaattactcacccaccgaagggtatctggattgttttcagtttggagctactacacctgagggtgctacgaacatcagtttgtatgtttcttgtgaacataagtattcagttctttgaaatgaaggtccaatattataattgctgtgtcatacactaattaggtctttagttttctgagaagctgacaaactgttccctgaagtgaatgtaacatttttttctggccagtaatgaaggaatgatcaaatttctctgcttctttgggaattgtgtgtttttactctttttttaggtaactattgtgataggtgtgtagtgatattccattttttaaaatttcatgtctctgatcgttaatgatgatcaccttgtcctgtgcttatttgccatctgtatgtcctctttgatcacgtttgtgccctttgcacattttctaattagattgtcttttgttttgctcttaactggtattcagtgttgggtgttttgtttttttgagacaggattttactttgtcattcagcctggagtggagtgatgcaatcacagctcactgtagcttggactttcctgactcaagcaatcctcttgcctcagcctcccaagtagctgggacaacacgcacacacactgcctcactaatcgtttacagaattttctttgtagagacaagatctccctatttgcccaggctggccacgaactccttaggctcacgcaatcctccctgctcaacctcccaaggtgttagaattacaagcatgagccaatgcactcggccagttttcactgttctttatgtattttttatactagtcatttactggatatgtgattggcaaatacttaatgccagtctgtagcttctgttcacatcctctcaagagagatttttgcaaagcaaaaattgatggttttgttaaggttcaatttatcagtctttcatttcatgacttgtgtacttggtgaagtctaagaattctttgcatagacatagatcttgaagattttctccttttttttttctttttttttgacagagtctcgctgtcgcccaggctggagtgcagtggcgtgatctctgctcactgcaagctccacctcccgagttcacaccattctcctgcctcagcctcctgggtagctgggaccacaggcacccgctaccacactcggctaatttttttgtatttttagtagagacagggtttcacagtattagccaggatggtctcgatctcctgacctcatgatctgcccccttcgacctctcaaagtgttggtattacaggcgtgagccaccgcacctagccgattttctcccatttttaatataaaaataatagtatcgctgggcacggtggctcacgcctgtaatcccaacacgttgggaggccaaggtgggcagatcacaaggtcaggagattgagaccatcctgacacggtgaaaccccgtctctactaaaaatacaaaaaattagccgggcatgatggcaggtgcctttagtcccagctacttgggaggctgaggcaggagaatggcgtgaacccgggaggcagcgattgcagtgagccgagatcgcgtcactgcactccagcctgggtgacagagcgagactccgtctcaaaaaaaaaaaaaaaaaaaacagataaataaaaaataaatctgagagatggctgagcaatttcactgagtttcatcatggaattctggcctcccaaacaccagcatggcccctgttcctacaatctcctgcttcaagatcaacccaaccctgctacccagaccagatgctagatggtcaagacagggctgtgagagctaaagaatcttcagggtccacgatgaatttacattggagcttccttttccacggatattcacatcaatagagaagatgactgagttcttgcctacctctgtgaatacctgagacatgaactgagatgtgtgtgtgcatatggtgcgggcagcacttcctcactcaatactagggagagtgtgaggaaactggatacagacctggagatagggcacatttttacactctctattaagccctgtccttctgtgctcaccaaggagtcacccaacaaggccacaacaggaagagaagcaggtttctatgaagagacttctctttttgtgatgagggcccaggaagtccactgtctagctatgaactcagaggcagaactctgatgcatctccaccatgacctgaatccctctcctctactcacccttcctgctgtcggcacaggttctgccttccagggctcagccccataagactagggatcagcctggccctgaccttcagctcagcacagggagtgacgcagtgtgtggggctctgagaatgagaccctcatcttcagactcacctctcctgtcctatcttgtaggctcagtggcctcctctgagcggactcagttgcctgcagcgtctgtggctttgggacagagggccaggatcacctaccagggagacagcatagaatacttttatgcaaacttttgtaccagcagaagctaggacaggtccctgtgctggtaatctatggtgacagcaactggcactcagtgattcctgaacaactctctgactccatatcagagaacatggccaccctgataatcaatgggccccaggctggaaacaaggctattactgtcaatcatgagacagcactgatactcatctcacagtgacacaggcagacaggaaagtgagacacaaaccccttcccacctatgtcaccctccccctccaacctcaggaggacagtggtcagagctataagcaggtctggcccagttcactcagatttgagacccccaggctgcccttccctccagccttccaggcaggctcagcagagtgtaaattaagagtggatacacaatgaattattagaattgtatttcagtttttcaagaagtagaggaatgattgaacatgttaagtggaagtatagaataccaaaaaaggactaattgagcttgtactgctaataattacagcatctgagacattaaaaacacactggatgtgattaacaacagatgatgcaacacaaaagattagcaaactcaataatgtagcactagaaaatattcaaaatgcagcacataaagaaaaaataatgatgaaaatgaagagagtgttacagtatatttatagaaaaaatgaagagtgagttataggacaacttcaaacagcctgaggttggctgggaggggtggctcacacctgtaatcccagcactttgggaggtctcggagggagaatccttttgagactagaagctcaacaccagactagacaacataacgagacttcatctctacaaattttttttaagaaaattaactaggcatcatagcctgcagctgtagtcctacctacttaggagcctgagacaggaagattgcttgagcccagaaattcaagatggcagtgagtgaggtacgatcatgccactgcactctaacctaggacacagagcaagttcctgggtctcactctgtggttcaggctggagtgccatggtgcaattacagctcactgcagccttgacttcccaggcccaagagatcctcccagctaagcctcccaaagtttctgggactacaggcatgcatcacatgcctggttaattctttgtattttttgtagagatggggttctccctatgttgcccaggctggtcacaaactcctgggctcgagcaatcctcccgactcagccccgcaaagtgttgggattacaagcataagccacgccacctgatgtgaagaaatatttaaatacaacaacctaaagtatgtataattgacatccatggaatagaaaagatgaggtggagggtcagtagaaaatatatttgaataaataatggccaaatatgttccacatttggtgaaaaccaaaaattggtatatccaagaaggtcaacaaaactcaagcacaggaaacatgaagaaaacaactccaaaacacatcataatcaaattataaaatctagtaatgaatacccactttaaagtttaattccaagagcacatctctcattagaagtaatgcaaggcacagtggaacaatatttcgaaaatgctgaaaggaaaaacttgtgaaccttctgttatttatctaacagaaataacattcaagagcggagggtaaataaaatgttttcagacacataaaaacttacagaattgatcactatcacttttggcattagaaatggtaacagacatccatagacagaaggaaaatcatacccagttgaaaagcaaattcacacgaagaaatgaaaacttcagatagggcaatgacatggatacctatagaaacccctgtattatgttaacatctatgaaagataactgttcaaaggaaaattagtaaaaaaatcactgtgatttattgtgaaaacaaaattaaattatatgacaaacagcacaaaagcagagaggagtgaagaacatgttataatggtcttataccctgtatgaatatctaatcacacttgaagacagattttggtaagttatatatgtaccattaaccctgaagtaattattaaaataaacccttttaacaaaaaagaattatgactagtagtaacctgtattaggattctccacagaaacaatatcaatcagatatgcgtgtgtgtgtgtgtgtgtgtgtgtgtgtattgagagaaaaaagagtgaaagaaatgtattttgaggaagtggatcatatgattgtagtggctgacaaggattaaatctgttgggcatgctgaagtctggaaattcaaataagagttaatgttgcggtcatgcatgcaaatttagcaagccagcacatcaggaaatctccatatttgttctaaataccttcaactcactaatgagtcccacctacattgtgcagagcaatctgcttatacaaggtcaactaattaaaatgttcatcacatctgaaaagtatcttcatgttaactcctatactggtgtttgacaaaatcaacctggcccatatcctagcctatctgacacttaaaattaaccatcatttaagccagaaagaaaattttaaaaatatttctaaaaataaatcagaaaaggaaacaatagaaggggaaaaataacgaacatatgggatgaataaaaaatgaggagcaagaaggtatatttcagtaggattatattactaatctcattaattgtaaatggtctaaatatcacaactaaaatattgtcaaattgaaattaacagcaagactcaactatatatgctacctagaataaacctacttgaaattttagaaccacaaaaagccaaatacaaatcaacgacaatcttcccaacccctggtttcccaacaaagcattacaaaccgaattcacagggattaacacatagttaaaaaatatgtctcacttccaccaacactcttacctctcttcagcctctaatgcctagatcccagtaccagagttgcaagaaaacagggcacacaaatgttaaatcaaggttactaagggtcaccctcaagaggtaggtgaaaagagaatgagggaattgaagccacaagggtcccacttgcatggggcagctcctgcatcacaatgttgattgatacattattgatgagtttttgtccatgttcatggtggacataggtctataactttcttttcttgtcatgactttggctttggtattggagtaatgcaggcctcaaagagtaagtagaaaaatgtttcccctgctgtataatctgaagaagttcttgtaggattggtatcatttcttaattaaaaatttgatagaaatttactatttaaaactgggtgagcttttcttagcaggaagacttttaattgccaattcaataccttcaaataccatagatctatttggattttccatttcttcctgagtcagttttgatcatttatgtcttttaaggaatttttccacttaagtcatttatacttttggcattaattgcttgtaataatttccctaaccattttaacttttgtaaggttggtagtcatggcactcttttatcatggttttagtactttgtgtcctctttcatgttttcctagtcagtctacctaaaagtaaaatcaataggttgtatttatctttttgaagagccaagttttgttttttagaggctgtctattgtttttttttgctatttcattaatatttggctctgatctttcttattaacttttcttttttttgctttgaatttaaatgctcacctttagcctaaatttatgaggtacaagcttagataattcattttagatctttcttctttccaacattaagcattaaatgcaatagatttccttcaaagcactgatttaagctgtatttcttaagttttgatatgttgtctttttgtgttttaaaggttcagtatcttctaatttatgttgtgttttttctttagctcatggattacttagttgtgttctttcctgctcaaataattgaagatttcccatagttcatcaggtattaatccaatttaattaattattttggcattaaataataccttctatgatattcatccactgaaatccactaagatttgacttgtaacctagaacacagattatttcaaaatcatttaaaaatgtgctaaatgtatttaaaagcataatgggtattctgctctcatgtttgaaagtgtaatgggtattctgccattgtgggtgtagttttctacaaattcaattaggataaattggctatttgggaggctgaggcgagcaggtcatctgaggtcaggagttcaagaccagcctggccaacatggtgaaaccccgtctctactaaaaaataatacaaaacttagccaggcgcggtggcaggcaccttaatcccagctacttgggaggcagaggcaggagaatcgtttgaacccaggaggcagaggttgcagtgagcctagataaagccattgcactcaaacctgggggataagagagggacttctctcaaaaaaaaaaaaaaaaaaaaaaaaaaagataaattggctgatcattcaagtctgtatcttgattgaatttctgtatagttgttgtgtggatcaatgtcagggagctactggaatgatttaacactaattttagaatttctgattgattttttgagagaggaaattttcatgggtctaagtactttattcttctgacaaaaggccttttatgatttcccaagactaatctaggaagaaaaggcagagttcaagccacagttggtgataccatgggagcactgaatgatcatgtgaggtgcctccactggttaggtgtatgtaaatgaagattttttaaaaaactaattgggaggccgggtgcagtggctcatgcctgtaatcctagcactttgggaggctgaggcaggtggatcatgaggtcaggagatcaagaccatcctggttaacacagtgaaaccccgtctctactaaaaatacaaaaaaaaaaaattagccgggcatggtggcaggcacctgtcgtcccagctactcgggaggctgaggcaggagaatggcgtgaacccaggaggcagagcttgcagtgagccgagatcgtgccactgcactccagcctgggcgacacagtgagactccgtctcaaaaaataattaaaaaattaaaaaatacaaaacaaatctgggctaatatgtccagaaattttgagaaaatgtatgttgaataaagcatgaaaatgtaaagcaaggtgattgcatatgtataacattgctaccacaaggccaacctcatgggaaagaaacaaaaactgttagcagttcattatgtttacttacacactgaacaaacatgaattgaaaccaattcaatgaactgtcccagatactgtttaggtacttgagatgtattggtgaacaaaagagacaaaagtacctgatctcacagtggcattatgaaagatgatggagtaggaaattccaggaaatggtcctttctgtgaaataactactgaagggtaagaaccatcagaattaaccataataaaatgaggaaatctagtcccacattcgcagcattgaggcaagtactgatgaagaaagaaacaggcataagaaaatctctgtcaggttaatttttgcccatagaagtaactgaacagaaactttatggatcactctgataacaaagtccttgcaaaattattttggaagagtcaactacacaaacgaataactgcacccttgagcagcaacatcagccaagaaggagtagggagacaatctgattttgagagttacaacatcacacattcaaaatacacagatttcaacaaaaacttaaaaagcagacaaagttaaaaggaagcatgacccatttacaggaaaaagtttaatgaactgaatgtactcacaaggaagcaaaggcattggacaaatgacacaaatacttcaaataaccatttacatatgttcaaaaattcaagaaaaccatgcgagtaacaaccaaacaaaactggaagaataatgttagaacaagtgaggactatcaataaagaaaaagaagttataataaaagaacccaagcagattttctagaactgagaagttcaatagctaaaatcaaaatttcatcagataagttcagcagcagtttgagcaggcagaaaaataatcagtaaacttaaagatacattgttgtaattacacagaatgagcataaattttaaaagaataaataaaatgagcagagcctaagagatacatgggacatcatcaagcatatcaatatacgcattgtgggagactcagaaggaagagaaaaaagaaagtataaaatacatgtaaaaataatggctagaaacttccaaaattgatgaaagatatgaatctatactttcaaggagctcagtggccttcatcaggttaacctgacacagactcacagtgaggcacaatatgctcaaaccatcgaaaaccaaatacaaaagaaaaatattgaaagcagcaagagaaagagactcatcacaaacagtagattctcatgaaattaacatttggtctttgatcagaaacaaaacagtccaaaaggcagcacaataatctataaagtgatttataaaaatatattatctaccaattctgcatttagtcaaacaaatcttctaaaataaaaaataaaataagataatcatagataagcaaagtttagtagacctggtagatctgccctaccagaaacactacaggaagtccttaagtctgagaaaagacactacataatttgaatacatgtgaagaattaaagatctcttttaaatataaagctagtgctgttgtattgttggtatggagctgctgtgttttccatgttatttatgagatatatggaaaaaaatcaataattataaagccatgtacataggcacaaaatgtttaaagatgttatttgtgacattaacaaggtctaaaaggagaggaaatggaactggataggaacagaattaatggatattattgagactaagttcgtagcaattctaacaattttaaaacattaatcgttactccaatgataactagtaaaaactaaattgagtgtataagggaaagaaaatgaagaaggaatccaaatggacccagaaaaaaattaatagaacacatgggaaacaattattggggtaatttaggaacaacaacaacaaaagataaaagatatgtagaaaacaaacagcaaaatgacagactttctttgttatcagtgattactttaaatataaatggattagattcaccacttgaagcaaaataacaaaatgaaatttttaaaagtaaaaaaaaaaaatagaatccatgatctatctacatggtgtttatggagaaccaatttagacccaaagacacaaataggttgagtaaatagtaacaaaagaactggtgtggctgtcgtgacatgatgcaatattgacgttaagtgaattatagttgtaagtgagaaaaaagggtattccttattgataaaatggtcaattaatcaagaagatataatagttatacacacgtatgcaccaagcaatagcacttcaaaatatgtgaaggaagacacatttaaaataaaagctagagagatctataatataaattggagacttcagtaccccactttaaaaaagaatagaacatatgaacaaaagattaatagaaaatgcagctattgaacactataatccagctagacctaacagatatatacaaaatactgcacaaaacaaaagcagaatacacatctactcaagagcacatggaacattctccagaatggacgctattttaggccttaaaacaattctcaacagttttttaaaacttgaagtcatacagggagtcatctaaaaccaccaggaaacgaagtttgggtaggggaggaacaatatttccttctactcaacttagatttattggccagcagtccctatcacacaagacagattaaaaaataaactcatgcacatttattaaatataatttttacttggcatgggagctttaataaggaaatgaaaactcagagaaatggctgaacctgaggactttacatttaggtatgatgaggagaatacaggtgtggagaaatatgactaagaatgaagtaaatgcagtaaatgggggaaagagcaaggcctgtgttcattcttctcagcacaccttcattttagaggaaacaatgctctcttttcctcttctttctaatcaacaactcaactttacagctcatggaacaagaaagagaaaagcaaacttaaaccaaagtccacagaaggaaagaaataagaatcattagaccagagattaaagaaatagatgagaaaaaaaactataaagaatataaatggcataaaaagttcctacttggataagaagaagaaaattaacaagctgttaggcaaaccaactaaaaccataagagagaagacacaaataacaaaaataagaaatttgggataatacaaccaacgttatgggaattaaaatgattataagagaacaccataagcaactgtatgtcaaatctagaagaaattgacaaattcatagaaaaatacaaattaccaatctaactgaagaagaaataaaaaatcagcataagaaatagattaagtcggcaattgacaatttctctaaaaagaaaagcccagagccagatgtcctcactggtaattctactagagatttaaggaggaagtaataccaatcatactcaatctcttccaaaaatagatgaggagggaacactgcctagcacattctagaggccagcattagcctcgtagcaaaaacaaacaaggatactataatacagaaaactattggctaatactcctgaagaataagcatctaaaattcctaaattaaataagagaaaaccaagtctaactacacattaaagagaacacatggaatgaaaaagcgagatttatcccagaattgcaaggatggttctacataagcaaatgaatcaacgtaataaacaatatcaatagagtgacaagaaaaagcatatgatctcagaagatgcagaaaaagcatttgacaaagttcatccactttcaagacaaaaacacttagcaaactaggaacagaaggaaacctgcacaaattgattaaagaagggcctttatcaaaatccacagtgaatctcacagtaaatggtgaaagagtgaaagcctccccacaaagatcagaagcaaaacaaggactcctgctttcacagctgctattcaacattgtccaagaagtcttaaatttcattaaaacaaaaaaggctagtgctacctcccaccacaagcatggatcagcgttaggaaattaaaataatggtaatagaaaaattataatgacagtgatgatggtgatggttttttaagtacacaactgaggtttagtggcagaaatccggtacttccaattacagtgcagctgtgcttattggggtgacggaatcaatctcgttttcagtatacatgggaagcaggagtacatgtagggtacaactgcatttctctggaactgtttttcacagaagagctacagtttatcctgcactctccattctgtgatcaaaaaccatgaaacagagaaaagcacttcaacctgagactcagtcacaagaactgcacctgccccaccttcccgcaactatatatgccacctctctgtgctgaaccatgaaggccagaggggttcacatgtggcacagacggaggctggactccctggtccgcaccctcccaggtgacgggtgctctgggatcacctggagaaggcaagtgcctgggctctgtcttttccaccagcagagggcagcagagctgcagccagaagagaggctggggctgcccaggaggagcctatgaaggaggccagcctttgtggggggtggtcaacaggtgttcaagggatcagtcctcactttggaagtttggtatagtccctcctgtcacctggggctgcagtgttcatattctgagggtcagacacacagcatcacccaggatactgacaggggcccaggcacagtgacggcctcagctgggaaacacaactggaggcacctgggccctggtgtcagcctgggcagctcccatagggctaggatttcctaagagacgctccgaggtcaaggtgctctaggagggggaacagtgtgaggggacagggctcccggggctcaagcccttcacccaggatggctgcctgagcctcctgccattctaagggtctcattcctccgtgtccagcagcatcctggggagctgagccctctacacttggcacttccagagacaccctaccaccccctccctctccctctccttccagctccaggccgactctgactcagaggcagctcctatgctcaggggattctcaggtgggtggcgtgggacatttgggatcctggtccctggatggggcattcccagcctccttgcggagatgctctccagagggaagggaatgttcacctgcctcaggccacagctctgaccatgggactatcctgggctcagtgacaagatctgtctggctggagggaccagggatcccccaccctccagagctcatgggtgttcagagaccacgacgctggaaccctcacagagaccaaataacctaaagttagtttctcagtcaggtctgggtttctggtgctttttacacatttatatgaaacactgatgagaaaaaataaagaatcaaagagcagaggatggcaatttctagtctattagagagatggggggtgtcatacaaggagcaactcaggtgagaaacgagactagactgtgtaatgaatccacatgagttgtggctgctcaaaggaccaaaccatggtaatggaaatcaagtttaggatataagtatcctaaagacacagaaccacattctaattaaactaccaggacaggaccaagtgagtctgggaaacccagagctgacttggaggaggaggaagatgatgggttcctggcccacctgctgctgagtcaggtgtcattgatgatctctcagcacggcccagctcagccccatggccaggctcctggaaggtccacagccctgctgagcctggcctaggacacagcacaggccaggatggtataaaacagtggtcatgtggccaaactccaggaggtgactgtgatcacaggccttcaaggatggagtctgatcttctgaccagagaagcagataaagtgagctgggacccacttcttcttcctcagtctgctgtgcttcccacagagctggtttgagtgacatccttcagtgaggagtcccagaggatgccgatttgcatcaaacactcactgcctcaaacggcctgagaggcaataagagagagctggtgagcccagctgtgctgtgggctcaggaggcagagctctgggtgtctcaccatggcctggatccctctcctgctccccctcctcactctctgcacaggtgctgcccccaagcccttccttcaggctcagaacccataggatcctgagctgggcctgcccaaacatgagttcatcccaggcacaacctcagggtgggaccccctgggaacagattcatcatttacaagcctcctctcctgtcctctcttgcaagctcctatgagcttacacagccaccctcagtgtcagtgtcaccaggacaggcagccatgatcacctgctcttgagataacctcaaagatgagtatgtttactggttctggcagaagccagaccaggcccatactggtgatatatgaaggcagcaagcggccctcaggaatttctgattttctgagtccagctcagggaacatggccaccctgaccatcagcagggctcagactgaggacgaggctgactattactgtcacaggtacaatagaaacagtgatgagcccacagtgacacaggcagattaggaagtgagacacaaaccccttcccaatctgtgtcaccctctttctccagccccaggatggctgtggacaaagccatgagcagggctggtccagttcacccagttctgtgacccccaggctgctcttccctccagccctccaggcaggttgtgaagagggtgagttaagaagagatttgaggctgtgtgacaggctatcctggggtttttctggccaaggataaagctggtgaaagagagcctgaatggacgggcagacagagtggcccatgcacgtagtggcaaaagacctgggtttccacatgccagcccttcaggcaggctctgcagagagtgggttaggaggagatttgaggctgtgtggacaggctgttttggggttttctaacccaggataaagctggtgaaagagggcctggatgaaaggacacacaaagcgtatctttcatctagtggtaaaggatgtgagttccatatggtgaagcctgggtcaccccttggcccagacgtcctaggttagtcctcagcatttccctagcacttaagttcctgaatctcctggcagccttatattcaaaacggtgtaagctggagtggacgctgtggggtccacctagactccacgttaaggtcgacccacacactctcagagcctacgagtggatacccatgctgtggggcacatgtcacctgacagagtggctgaccacccctgatctcttctttctgaccacttgggtgtttggcactatgtccatcatggacactctatgggctattaacctatgattcaaagtttcttctgtgtggtgcccgtgcccaaagaccacccacaggcttctgcccatactccacttcccccatttccaagtttttctcttgcagtccctggaacacctgcccaggtcatttcccactgccctaagcccctatctgccctggcatccggccactcacctttcctcacaaaatgaatgaccaggcgccatgccctcatgcaggaaagatgtcccctctccattgtctcttaatgccaccccttagtacacccatatagtgcagctgtgctctacttcatggtgatccagttcattgctgggctactctggaaatttttgctccatcagctgagcagagggactgctacccacacaacgtaagtgtaaacccagggagcagtgctagagcaagagagatgcaaacttggctgtggaccacccacaggttactcagctctggggccctgctcctgctccatcctagctgtgtcacatctgtctcaccagggatcgctgctggggtctgcctgagcacacgacgggggaatctggcagttctggctgcttggtcactgaatgtccgatgctgtcctgtatctaccagggaacaagagcacatggggagagttgttttccaaatgaatataattctctcttgtggatgacatggaattgttccaaatcccatgggattggaatcccattgggaaaatctcatgggattttcccatgagagattgcgtaaacatgagttttcagttcctatcataaattcttccattcctatcaccaattctgtgactatggtagagtctgctggattctgtggtcccaacagcaggacactcatacccctgcctgaacctggtgcagaacctccctgctctgggctccaaaacagtgggcgatgttcatggctcctgatatatgagttggagccacatccccaagggttaaatatgctgcctctagacaccagaatgaccttaaagctttgtgtttctttctggtgggaattgtaagatctaataacgtgctctttattttgtgagagatactaagctgctccagagaactcaatcctaaacatttcagctactacacaggatgaatggtcttagggcttgtttcgcactctcaggaatgcgtgggtctcaccaaagcttccaatagacagggccccctcatgcacatctgatccaaatacagaatagagccctaggaggttctcctgggtgttcagatggtcaaagcccctatgacaatatcatgaaaaagaagggagagttaatgaagttgaaaaaataaaagtataaacctatactgctgtctactccttgtatgcacaccgtttctgatcctgttctgagaggaatagaatgagtttctgcattgatggtgcctgctgtgcacctgtagccatgcatggtggtgtgttctatcagggtcttcatctggcacagcaatggcagatggaactaccagctgactgcgtctgtagaaatccacttccatcttccaggatccattcaacaattgtaggaatcatttcagtaaaccaaacacaagagcctcaactataactacaagtcctccaggagaggagaacgctgtctcagagggtgcattcctactggaatttctcttctctttgggacaaaccagcccagaggaggcacaggggctgtgtgtcatctggtttcctagatgaggtgtctcctcctcactgtcctgagattttgaagaaactggggagattggtgcagacactccttggatccttacaggaaacttccttcagaccacacactcctcaatttgttcccaagctccaaagtttctaaagtcactgtctaaagggcccacagtgtttttgtggagtggtggaaaagctctggggatggaaagtggtggtggttgcaaagcattctgaatgtacttactgttgctgaatgcacacttacaaatgattgaaatggtttaaaaattgttcattttgccataataaaaatactgcacactctggaggaaagtaaacctagtttaattttgaaattgttcaatggataccaatcaaagaatagtgtagcaagcaccatttcccctctcgctatagcagcaactgatccccttgtgctcttttggactctctcccctgctctctctctctcaataataagcaatgctcttctctccagtccaagctcacacttccccagttgtgcaggaatgcctattgtaactgttaatttatttccaggcagagtcctcaagattcctctgctcatattctgttctcagctgtctggagccagcatgacaagtgagccaagatcacttgtcatgagagacttgtggaaggttttgcaaaaagttccccaagaaaaaacaatgctcattgttgacagcaggtccatttccacacagtagggccatgctgggtgtgcagtggggctgtgcacactgtgcccacaggccaggctctgcactgctgactctgatcctgtgcttggtaggaccttgtgcactgctgagtccactgcagactcgaccctgaatgggaaggtggttcctagctgctgggcactgagtctcatagagggacagatggtattgaggatgcccggcccctgatgtacataaggggacaaggtctgctggtagaacaggaagatgaaggaacctgtggctctaaaggtggggtctccagccctcagtctcagctgcccatggcctcatctgtgtgcaccttgtcaatccagaccatgtgaattagaggtgaagggaattgaaggactttcccattttctcccattttctctcttggttacagaacgcacccttccacatatactgtattagagcctgtgctctacaaacatacctgacactaaattagtgacttttgaaagtgcagataggtacagcaaccagtccctctggagacatttcccataacatgaaccagtgaacccatctctgaaagccctcatgttttaaaagacaagatttttgaatttcaaggaaaactaaacctttgaaaaaaacatgattcaaaagagaaccttgccactttccattcctgcttgggctgcagtgaggacagatgcagcaagtgcttctgatgtctgtgtctgttcccctgtgtggacgcacatatccaggcgagtttcagtgaggtaggagacttcggcagcattggccgggctctggtttgcttctggtgctaacggaacatggaagagaggacaaggtagcgtgtcctgaagatcacatatttcctttttgcaggaagtgcctgggctcctggagtgttctcagggctttgatccaggccaccggctccgcaatcaacatcactgatatttcagcaggtcattgacctaattccattttagtgctatctcaaatggaaacattattttcttgtaactattcatatagcaacatagcacttaaatatctaaataacacacacagaaacagtagtctcaaatgcaaagctgtcacctccccacaccacacactttctcacccgagcccctgagcccacccttccctcggccccccctctcctgtgctgttagaaatctctgtcttctaacagggacagtgacacaaaacagccccccctcccgcccagcactcacaccgcagagcccctagtccatctcctgagggaacgtttacgtttctattctgacagagagaagtcgccgtgaatggagtctttaccccaaacccaggagtttctgaggaacacatggggtcagccactgtctgtgtggggaggcttcacctcagggaggcgcccggctctgggctgagggggactcaacgtgcactaaaaggcaggactaaggcaagtcccgggtcacagtgtgagggacgcacgcgccctgaggaggggtccctggtgctaggcctgacccaattctaaccccaggcacctttcctcagctcctgtggccctgggacacctccctaccctgcttcccatgaggctggtcacagctcttgtgagcaccgcctcctccatgtcacactttttctgtcaacattttgaggagccagttggttttctcctcattccatgttcctgtcccacctgcctgctgggggtggatttatttcatgtatgaggtttcctcagcctgagccacagctgcctcaaggacaccaaccctgtgggacactcctctgggaaaagcaaacaagtgccaagaggagcatctgaagctctggtgtgggagatgtcctccaccctgggtcaggggagtctggaggggatgagaagggaccaggggcctgggattgagctgtgaagggaaccaaaaggcaggagggacagggcaggggctgtcagctatgactcaggggaggttcctgggcctcaggatcctccctctgaggccaccagggggcgggggtggcacatgcctggacctgggaggtccctgctgggcttcaccctgggtgggtcctaggagctccttcctcctaagtccccctaaagagacagaggcattctggggtcctaaatctgtcatgcccccataaatgcatttctacgagggccaataaatgaactccaggtttatccaagcagcagcttcaggcgtctgcagacacagagcggggaggaattagccaacctgaggcaccctagaagggctgaagggggctgaaggggactgaagggtccctgtggggcctgtggtcctggggaggggagagctggggtgtctcccagccactctgggccctgtcctgacacttctcccacaaagaagggaagggaaatcctgggaccccacagccaggaccaaccgtgaaccacaggacaggaaggacagggacccccaaggctggctccatttcccaggcactgtcatgggctgagtctcaggaaatccaagtcaaggagtttcaatccccctggctgagccccactgtccaaggaaacagaagtctacgggcccaggcccaggtgagggtggggtaagaagaggagcttaggatgcagatttgcatggaggccccgccctcctctgaggcatcagggtaagacaaggctgggggcaggcccagtgctggggtctcaggaggcagcgctctggggacgtctccaccatggcctgggctctgctcctcctcacctcctcactcagggcacaggtgacgcctccagggaaggggcctcggggacccttgggctgatccttggtctcctgctcctcaggctcacctgggcccagcactgactcactagagtgtgtttctccctctttccaggctcttgggcccagtctgccctgattcagcctccctccgtgtccgggtctcctggacagtcagtcaccatctcctgcactggaaccagcagtgatgttgggagttatgactatgtctcctggtaccaacagcacccaggcacagtccccaaacccatgatctacaatgtcaatactcagccctcaggggtccctgatcgtttctctggctccaagtctggcaatacggcctccatgaccatctctggactccaggctgaggacgaggctgattattagtgctgctcatatacaagcagtgccacttaaccacagtggtccaagttcttggggaactgagacgaaaacctgccctgggctctcaggctccctttttgctctgaagatgtttcctcacccagtgcaacgggcttcctgaagcacagccttgagaattcttctccctcagcaactctcttttcccaccatgaaatccaaaggaaacctgctctgtggtttctcatccaggacagggacagcttccttttgcttgtgtgttgtggtccctgagtgggtgcaactcttcctagctttttaaattatgggagggtgacaatgagctccctgactggtgcagtccctgctgttttcaggaacatcctcatcctaaatgcatctgaatctcccactgtgtgcagaccaatctggacagatgttattagggggagtttccagaagccacatcttactcaactctgtatccaccacactctggtgaagatgcttttttggtgcccatcctcttgggtaaagtccactctctactcatgacagccatgtgtcccatcttctgaacttgggaaattgccacaccaaaccctcaggctcagggcccacataggagctcagaaagacgcactgggaaatggagaagagatctgcatccacccctcagtggagagacacctaactagataataagataaggaagtaggtttgcatgatgagtctccccttcttatgataagagagacctagagacccccttctcaggtgtgcgctcagaggcagaactctgaagcatctccaccatggcctggacccctttcctgctcaccctgctcactctctgcacaggtgctgcttcccagggctcaacccccacagcaccagggaacagcctggccctgactttcagctcatcacggcagtgatgcagggtatggcactctgagaatgagaccctcatcttcagactcacctctcctgtcctcgcttgcaggttttgtggccttctctaagctgactcagctgcctgaagtgtctgtggctttgggacagatggccaggatcacctgccatggagaggacttagaaagctattatgcacactggtaccaacacaagtcagtccaaacccctaatctcattgtatacaatgatagaaagctgtgctcagagatcactgagcgattctctggttcctgctcagggggaacagccacactgaccattactggggctcacgttgaagacgaggctatttttgtttttctggagataaaaacacattcatagtgacacagacagatagggaagtgaggcacaaaccccatcaccatctgtatcactctctttcttaagccccaggagtattgtggacaaagtcgtgagcagggttagcccagctcagctggatgtgtgaccccgaggcacctttcactctagtcatccaggaaggctctacagagggtgggtcaggagaaaatttggggctgaaaactaagctgtcctggtgttgtttagctaggtatgaattggcttaagatgacctgactggtaggacagtcacagcaagataaccattgagtaatcatgttgcctggatttccttttgtttaatgaccaaacctaaggtagctctctggtccaaaatgccctggattagtcccctggactcctcattctttaactgagacctttgatcccagctgtcatggcatcatgatgtcgtgaacagggaagtccattgtaatggcaactgtgacatcaggggtcatttacccactatctacccaaggccgcagggaatccttggcttctcacagctttttctcaccggaaaatgccattgagtgcagagtactgtgtcttccaaggatgtgccccctccataatgtggtttgggagcaatgattgcctgatgcctagattccaaagccatgctttaattcaggatgaccttgaagtgcctcctgctgagtgctcaattgtaacacattcccagaagagcctcccacacttattttctgggactatatacccgaaccctactgcatggaattcaacctctcagagtaactttccaagaaacccaaaaattaaaaactaaacaacaacaagaaaacaatatagagagaagagtatcaaagaaaagcaagttgtacaaagagagaactctggagtcttcaaatattaataagcatcaagcagcacatgtgtggacggaaactccattttcagacaaacagcagtccaaagacactcgcgggaacactccacagagcattctttctctctctctctctctctctctctcacacacacacacacacacacacacacacacacacaaacacaaaatatgaatcctgcttgttcctacagtcacagaggaaaggcctgagttaaggagcatgaggtcgaatcctcggaacagctttgcctcagtcctggagaaaatgtcagcctagacaataggctggtctggtctcaactaagtaagttaaaaagcaagttttaaaaagtaccaagtttccgagtaattatactaaatccaagaataaaagaccaaatagacagagaagtgcaagtatattctaaatccaacaaggaaaaactcaaaatgtctagcacctatcagatttccttgcaagaaccaagaaaatacatgctataaaaagcagaaaagttcatcagtccaaagtctccctgaaattgcacagatgatagactttgtaggaagaatacaaaagcgatacttataactatcttccacttgctcaagagggtacgggattgattgaacatgttaagtggagacacggtagacataaaaagatcaaagttgaacttacagaaattacctctaaaatgtccgcgataaaaataaatacataaataaataagggccaggcatggtggctaatgcctgtaatctcagcattttgggaaatcatggtagaaggattatttgagcccaggagtttgagaacagcctgggtgacacagggagaccctgtctctacaaaaaaataacaaaatcagatagatgcatggtgcacacccatggtcctagctacttaggaagtggtggaagaattgcttgagctctgtaggtcaggatggcagtgacctgtgatcatgccgctgaactttggcttgggtgatagaatgacaccgtctcaaaaaaaaaatgtctgagaataattgtagattagctcccgcaaaataatagattactgaacctgaagatataacaatgaagctcttcaaaatgaaacaccaaaaaagagaagataaaaaattacactgagcatcaatgagttttacgacatcttcaaggagccttaattgtataattaaatgaactaaaggagacaagattggtggagggagagggagggtacaaaaaccacttaaagaaataaggaaaaacgtgcaaaatttggtgaaaactataaacttatgatttcacatagtttaacacaacccagacacccacacacaaacacaaacacacagacatcatatacacaaaaaaacacacacataaagaaaacatcaacacccgccataatcaaattgcaaaaaaaaaaaaaacaaaaacaaaaacaaaaaaaaactgtgatggagaaatgctcttaaaagcagccagagagaaaagacatgtttgatgcaggtgaacaccataatgatgagagtagctttcccattagaaacaatacaagcaagaaggcagtggaggtacattcataaaactttttaaaacttactacgcacagcattgtacatattcagtgtaatccctatcaaaacaccgatgtcattcttcacagaaatagaaaaaaaaaatcaatcttgaaatttatatggaattacaaaagacactgaatagccaaagcaatagtgagcaaaaagaataaagctgcaggtgtcacaccacttgttttcaaaatatgctacaaggatatagtaacccaaattatactatactgttttatagtataaaacagacacagaccagtgtaacagaataggaaacacagaaataatccacatatttacagacaactggtttttgtcaaaggcaccaataacatacattggttaaaagacagccttcttggtgctgctgagaaaactggacattcacaggcacaagaattaaaatagacctcgatctctcaccacatacaaaagtgaattcaaactggattaaagacttaaatgtaaaacttgacactactaaactactagaagaaaacacagggaaaatagggaaaatgcttccggacttatgtgtagacaaagattttatacctaagctttcaaaagcacaggcgacaaaaacaaacatagaccaatggagctacattaaactaaaagtttctgctcagcaaagaaaacaataagcaaagtaaagagacaacttgtagaacaggagaaaatatttacaaactgttcatctggcaatggattcacatacagaataagacaataagacaagaaagcaaaacaattcaacagcaaaaaaaaaaaatgccaaataataccattaaaaagaggtcaaagaatttgaatagacatccctcaaaagaaacatacaaatggccaaagggtgtattttttaaaatgctcaacatcactaatcatcagggcaatgcgaatcaaaatcacagtgagacatcatctcaccccagctagagtgactaatatcaaaaagacaaaacataacacattctggcaagaacgcagtgtaaaggaactcttatacactgttatatactgttggtgagaaggtaaattttaaattaatacggccattatgaaaaacatgatagtgtttcagaaacactaaaaatagactatcatcatacaatgcaataatcccactactgggtatttaatcacaggaaaaaacgtcagtatatctaaggaattcctgcactcccacgtttactgcagcactattcataatagcaaagctatagaatcaacctgttttcatcaacagatgaatgcataaggaaaatgtggcatgcatacacgatgaaatactttccagtcataaacaaaagaatgaaatcttatcctctgcagcaacatgatggaactggaggtcattatgttaagtgaaattagccaagcacagaaaaacaaatgtcacatgttctctctcatgtgggagctaaaaaaagctgatctcatggaggtatagtgtagattaatagttaccagagaggctgggaagggttaggggttgtggggatgaggggtagttggtcaatgggcacaaacatacggttacataaaagcaataaggtctattgttgtatatcacacagcagagtgaacatagttaacataatttattgtacatttcaaaatacatagaagatttgaaatattcccaacatatagaaatgacaaatgctcaaggtgatggatatcctaaacactaattcgatccttacatactgtattcatgcatcaaaatagcacgtataccccataaacatatacaattataatgtatcagtaaaacatgttctttaaattaaaaaaaactgtcaattctgaattctttactcagtgaaaatatctttcagaagggaaggcaaaataaaatggttttaaccataaatatacttgcactattcatgacctgcagacacacactatagaaaataataaagaacacttctcagatagaaaatcatactaaagatgtgactctgaataaagaaaacaaaaacatcaaatatagtaactacataaaaacatatagaaatggtaaataaacatagatataaacgacttaaattacattacaaaacaactagacttaatagacaactatagaacagtccatccaacacagcagaatacataataatctcaagtgcatatggaacactctccagggtagaacctgcaaaaaaaaaatgagtaccttaaaaaaatagaaaatctataaagtatattctttgtgttacttcactcttgtattgctataaagaagtacctgagcttgggtaatccataaagaaaagaggtttaattggctcatggttatgcaggctctacaggaaatctggtgccagtatctgctgctggtgagggactcaagaagcttacaattatggtggaatgtgaatgaggagcaggcatgtcacatggtgagagtaggagagagagaggtggaaagtgccacactcttttaaacaaccagtctcacatgaactgggagcaacaactcattgtcatgagggcagcaccaatttattcacgaaggatccacgtggccccatgacccaaacacctcccactaggcccacctcaacactggcagctacatttcaacataagatttggatgggacaaatattaaaagtatataattccacccctggcccaccaaatctcatgcctttctcacattgcaaaatgcaataatcccttctcaataatcccccaaagttctaagtcgttccagcatcaagtttaacatcctaagtctcatctgagactaacctcctgtcacctatgagcctgtagaatctaaacaagttatttacacctaagatgcaatggtggtacaggccttgggtaaacattaccattccaaaagggagaaaacaaccaaaagaacaggccccacacaagtcctaaacccaatggtgcagtaattaaatttcaaacttccacagatctctagggcatgaaaagaattcagccaagctttttactaaggcatcacaagggtgaactttgctccagttcccaataactatctcattccatctgagacctcagcagcctggacttcactgtccgtatctctatcagcatcttggtcacaaccagctgaccagtccccaggaagctccaaactttccctcatctgtctgtcttcttctgagccctctaagctcttcaaacctgtactttttacccagttccaaagctgctttcacatttgcattatccttacatcaacaatctacttttggtaccaattttctgtgttctttcattcttgcatttttatagcacctttatagcaccgctataaagatgtacctgaggctgggtaatgtataaggaaaagaggtttaattggatcactgttctgcaggctgtataggaagtatggtgccagcatctgcttctggtcaggcccttaggaagcttacaaaaatggtggaaggtaaagtgaaaccaggcatgtcacatggcaagagaaacaaaaagaagaaagagagaaaggaaaggaaaggaagagagggaaggagggaagaaagaaagaaggaaagaagcaaaaaaggaaaggaaagaaacaaaacaaaaggaagaggaaggaaggaagagagagagagaggaagaaagaaagagagagagagagaagagatgagacgagacggggggggagagaggcagggaaggagagagggagggaggaggaaggagggagagagagagagtgaaagaagaaagagagaaagaaagaaagagagaaagaaaaaaagaaagaaagagaaagagagagaagagtggggaagtgccacactcttttaaacaaccagatcttgtttaaactagtggttagaattcattcgttattatgaggacagcagcaagccaatcatgaagggtcagccctcatgacccaaacacctcctactaggcccacctcctacagtggagttcatcttccagcatgagatatggaaggaataaacaatgatatcatcctctgaacactgatattgaaaaataaaaggtattatatgagaacactgtgaaaagctgcataccaaaaattagatgaaaagaaaaaatccctaaaaacataaaaactactaaactggctcaaggaggtatagaaagtctgattaacactataacaagagtttaaattagtcattgaaacctcccacaaagaacggcccaggcatgaagggtttcattgatgaatattatgaactgtttaaggaattaataataattattcataaacccttccaaaaatataagaaaggggaacatgagcagctcattctatgaggccagaagtatgctgatacaaaaacaaaagacatgaaaagtgaactggagcacaacagcctctatgaaaacagatgcaaaacaaccacacttcaacaaaatactagcaaaatataaaaaggattaaacaccataactaactagtattcatccccaatattcaagggattcttaacctatggaaattaattattttaatgctccctattaaagaataaaaccacatggttatttcaacagtcacatcaaatgttttcatgtacgcagacaggacttcctgttgttttcccattcctgttaaagcatcataaaaggcacgatttgtggtgctactggatggggtgctacttcatgcaaactggatatgtcatgtccaaccatgaatatacttagccataaatgctaaaagattgtaatttggtgtcagagacttggtggtcagtgaccacttccttggcaagtggtaagtacagacatctgaaaggataactaggatttaggtaggtattggataaggaggtgagttacacacagaaaaagtttcacttaaaaactcatagacgcttgaacacagaagatggctcaataggtctgagaaataaacaaagtccagaataactggagctgaatggaaacaaggcaaatgacatgaaccatctgtttctctctcgacaactcactggggcattgtctcctccctataccacccacgtggattgtaaaaacatctgttcttaaaactttcttgtgcatcatgacagcatgtagcacctgaatccagctcagttaaatgagggcaggacagtcaaccacaaaacccaggtggcccaggaagcacatcagggagacaagaccttgctgtcaaaagcagaggaagtgagattttccattgtggctaagcccagagcatatgaaatttcaatgggtacacaaaaaccatatagggtttggttaagctgcagatgcagtctttgcaggtttgaatggggccccagattctccatggcaaatagcctccagttgaggttgattgatgctggtcctccaaggaacacactttgggtggcttagctcctatgcaccctcctcactcatgcacagctgaaactcacctacataacgcaccttctgagaagcataagtgacctatttctcctccactaatgtgtctcagtcccttttactaaaaaggaatatctgaagttgggtaatttgtaaagaagcaaaggtttatttgggtcatgcttctgatgtctgtaaagttcaacagtgggcatctgcatccagtgaagacctcaaactgcttccactcctgacagaaggtgaagatgagccggtgtgtgcagaaatcaattggaaacagaaagcaagttctttcctaaaaatactgcaggagtttaatgatcatatttacaaagtgtttaacacagagcctgacacaccctagctgctcatgagttggcagcaattattgctgatgtcattcatgaaaattggacctcagatggagaaactgcagtgcagagagtttgagaagtttagggacaagaaagacttagtgacttaaaatcgagttctaggaactgaggagagcatccctgggcattttactgccatcttttccaatgtctcagaaactgtttcaatgtgacgtcaaccagagaggaaagcagaggggtttgcagaaccaggggctacaacttcatccacgggagagtgatgtagtaagcgggtgggaaggggcagctgagctcatctgaagggtgtttaaggttttctggcccagggatctttggccatctctccctgcccagggcctcattcttccactgaccggcaggagctggagagtggcttctgagtctggttagagatcccagcagcacccagagggggaagacattggagagacgggtctaaggtcactggagacactgtttgctgcctagagggctgcgacaggctccttgaaaacaaaattcagacactttaggggaagaaaacacaggatgggaaggctcctcaccaggggattgtggataacagagaccaaagcatctacaaggagcccagccctactggaggtgccctgaacacagagatcctaggggtgtctgtattattttgccagggctgccatagcaaagtagcacagccctatggctcaaagaacacaaatgtattttctcactattctgcagatgatgttagaatctaagatgaaggtatctacagggttggctccttctgagcactggagaatctgttccatgcctctcccagcttctgctggctgcggaggtgtttgctgttccctgccatggagggaaatcaccccaatctctgcctcacattcaaatggagtattcctcatgtgcgtgtctgtgtcacagtttcccctttttataaggacatgagtcgtgttggattgggtacgtactctgctgcagtatgaccttttcttaactaatttcaactgtaatcaccctatttaaatataaaatcccactctgaggtccttgcagtgaggacttcattatacaaatttgaggggactgaaattcaaattcctaacagtgtgtctgccatgactcaggcctctccttggggctctgcaggtgggatgtgcaccaccaacctctcaggtggggcattacctgacagcccagaaggaccccaggccctctgaaaaatgacgtctctttcatccaccttgagggacatgttttctggctgtccttctcatcctttgcatgctgacatgggagacatcatcctctgctttttaaagaaggactccttcaccttcccaatcaccccaagtagatgcccatgctggttccacagaatcaaaccacggtgggttacgagttatattagccaccagctgacaatattccctgaatgtccaggatccacccatgctctctgaccatcaccagagtgagcaaatctctgatatgtgggtaagagtttctcccatgggctcccagccgggctgtaagtgaggcaagaccccttcttcagtgcacggggctcagtgcagctgcctccctgaccaagtcttcctgggacactaagcttatcagtttctctcccccagggacagtttttggttgtcctaagcctagctcagctctgctatgaactttgcatcctaagagcccattaaacacccccttgtgcctcaatggaataacctggagtaaatagtgtgaggtgcccctgctttctgctcccagggcctcttctcctcggtggcaccagcactgccctattgaccagcaatcctcacctgcccattcaggcctctacactgcctaccgtgaacagtcacagatcacaaactgattgccaaatttgtgcagatcatcttgacagtttctgtggaactgggtgccttctcatagaaccaggaagtcacaagccaggccagctctagagaagcaactgggggagtaacatgcatcacagcgcctggacacaacaaagggattttgctgtagtcctactaggacacatcctagtgatgtctctgagaaccagtcttggtccctgcaacagaaagcctactaaacaggacagtaggctgcaaggttgggcacaatttgtgccgtgtgtgagccatgtagattgtgcatgtgtgtatgtgtgtacatatgtgtacatgtgcatttagtgttgcaaggaagggttgtgtcaaatgtcccaactcaaaacttttctgttttcctaagttatctgcttctatctttactacctttgtactatcataagaataaggataatgattagggttgaaataggagaaggaataatgtttaattattcattcttatgtgtttaatacatatcaagcactcttcaaaacaattcatatttattaaatcactcaatacgaactactccatgagccaaatattgtcattatctctccatttccagttggagaatctgtgatacagattttgacacatgggaaagctaaggcaaagaaaggaaaaggactttgcccgatgtcagaactagaaagtgcctgacccaggagcagaacctgagtcttccagtcccagagaccctgttctttaacaacagcctgtgggcctgtcactgtgctttaaggtaaagcactgacatctccctaagactccagaaagttctctgtactttttgaatcaagtaactcatacttgcagtgatttccaatgcagtaggaattctctggtgctgaggagtctactaggaatataatttcaatgcctttaaaatttttcagtagccacattttaaaagtaataaagaacgggtggaagcaactttcgtactatattttctttaactgagcttacccaaatattatttcaatatgtaatcaacataaaaatattgagatattttatgttattttcctacaacctttttgaaatccggtgtgttttacccccacatcacatcttaacttgaactacccacattttaaggactcagaagctccctgggactcatggttgctatactggacagagcagatccacatgaatgatgatccatttggatcacagcccctgcagtacttacttagaaccatcttggggcaatggagagtcctatgacccagagggcctccttagggaagaatggctgttccattttccaaccaaagtagaaatatggcgggctctcagaaaccagggaatttttacaatgtgtttcacacttcttcccttctcaaagacattgactataacttccagttcgaagataaatctgagccatcaaaggcatttttttctattggtcagtggaatgaatggcaatggtccctgtggattgtgctccaaggatccctttctgtgggaagattcttacaataaaaccaactaaaagtaggaagttattgtttatatgtagatctagatgaaagggggctgatcatgaggaatatagtattgaaggtgagtgtgttgctattcttcacaaagggctatttttgcctaactcacaagcatcaatcatttttatgaaggtgtattttcccagagtggtcttagcaagttacatccaacgctgtatcaggacccacaagcaagggtgtcagaactgacctgcctgagcggtcagcaggaaccaatgtggagactctgaggtctccacaccaccaaccatgtccaacctccagtcaagtgacaggaggagtggaagcattggttgggaagggcttggaggagctgcagtgacatgctcagccaagtacaggagcaggcatattggtgtcatgtgacctcatcttatctcagttatctcttttcaccaaactccaaggtgcaatgtgtggaggcatctgtctgtacccatggacaccttgggcttcacacattatttctatttctaatgaaccagtgttttgttaatgaattcatttcatcacatccttagtacttctaggttggaaaagcaatacatgtctctaagatattaggtaggaaatattctcccgccactcgtatttattaaagttaaaatgcttcagtatctaatgtgacagttgtccaaattcaatacccttcaccttgttagaaatggaatcctgatcctaacttgtctggagaggaggctggcatgaggagcatgaccacacatctggatgtccccagtgtcactgctaacacacgctcttttgttacttgccgtgaagggagcagagggagcatccacacctttgtccaaaggacttggaggacagtgcacctgattaaaaaatgcagggctgtgataagtgggttccgggtcctggatgagggaagagaagatgaggaggcatggggtaggaggcagggcagggaggagctgtaaggtcaggctctgagtatgggtgaaatcctgactccactcactactctctgggaggatttgataaatcttgtaacctcctgatgttggttctcccatcaataaactaaaggagaggtcgtgtcttaagcgtatgcttgctgtggggctactgtgaatgtgtggttgaggtggtgcctgcaaaacactctccaaagggcctggcacgtattaatgtctcaaaggagtcattctgcttaagctcgtggaggatgactttcctcctgtgtgcactagagggccttgttttgaggaccccagtgacttccctggtagggctcaagcacaaagggcatgactgatgcttcctctgaggccccttctattgggtaaaattcatgctccactcatgacacccacctggcccttcttctgaccttgagaaattgccaatatgaagccctcagactcagagctcagacagtacctcagacagacatgctgtaaagtggagagcagatttgcattcaaagctcctcccttcttgagcttcaagaagaggataagacaggagctcatagtgtccaggttccactgggcagtctcgaatagagctcttggaagtccctccaaccatggcctgggtctccttctacctactgcccttcattttctccacaggtcagaacatcccagggaattcagggaaatgttttcactgctattttcccatgagcaccagtcctcaggggcattctttccagttcttctgtgcattcagcatcattcatgacattctgtttacaggtctctgtgctctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcggttgagccacagtgacacagatgaaggggaagtgaggccaaaacctcccacctcccctttctcctcagggactcagagtcaacagccctgggttcctctccagtaccctgagacctctgactctcctccctccaagacacccctaggcagaagcagatgcaggccatgactgaggccattttgaaaactcatctttctgtttcctccacaacagcctgtggggaccatgctgggagagaccagagcagcccaggcaggaaaaggaccttgagagagtggctaggatgagatgaccgtgtcccagtgtctcattgtgccctgtgctctattaccaggctctgccccaggaaaggacatggatcttgacctgtcagccatcatttatgagagttcaatttttacattttttaaaatataaaaactacaatctccaagatgctaggagcaatttcactgagtctcatcatggaattctgacctcccccagcatgtcccctgttcctacaatctcctgttcaagaccaactcaactccattacccagaccagctgctggatgatcaagacagggctgtgagagcctaagaatctttaaggtccacgatgagaacacgtcaagaaggatttatgttggaacttccttccccatggatattcacatcaacagagaagatatctgagttcttgcctacacctatgaatacctaagacatgaagtgtgtgtgtgcatatggtgtgggcagcacttcctcactcaacaccagagagtgtctgaggacactgggtacagacatggagacagggcatatttttatacactcaattaagccctcgtccttctctgctcaccaaggagccacccaacaaggccacagcaggaagagaagttgatttccatgaagagccttccctttctaagagtcctggaaacccactgtctagttgtggaatcagaggcagagctctggggcatctccaccatggcctggaccctcccctgctcaccctcccgactctctgcataggtgcttcctcccagggaataagccccatggaaccaggggtcagcctggccctgaccttgagctcagtgcagggagtgatgcagggtgtggggctatgggaatgagaccctaattctcagtctcacgtctcctgtctcctcttgcaggctgtgtggcctcctctgagctgactcagctgcctgcagtgtctgtggctttgggacgtacggccaggatcatctgccagggagatagcataggtgactctgatacaaactcgtaccagcagaagccaggtcaggtccctgtgctggtaatttatggtgacagcaaccagccctcagtgattcctgagcaattttctgactgcatatcagaggacatggccaccttgattattaatggggcacaggatggaaacaaggctattactgtcgctcggaacagcactgcttctcatctcacagtgacacagcatacagtgaagtgagatgcaaaccccttcccatctatgtcattctctcccttcaaccccaagaggactgtggtcacagccatcagcaggtctggcccagttcattcagatttgagacccccaggctgcccttccctccagtcctccaggcaggttcattagatggtaaatcaggggtggatacacaactattaaatatcatcatgttccaatttttcatgaagtagaggaatgattgaacatgttaagtagaagcacagaataaccaaaaaaggactaattgagcttgtgtacagctaataattgcaatgtctgtcaactttaaaaacatactggatgtgattaacaacagattagattatgtaaaacaaaagattagcaaacttgatcatgtagcactagaaaatattcaaaatgcagcacataaagaaaaaacaatgacaaaaatgaaaaagcattatcggatattcataaagaaaatgaaggtgagttataggacaacttcaaacagcctgaggttgactaggagtaatggttcacgcctataatcccagcactttgggaggtctaggagggaggatcttttaagactaggaattcaagaccagactaggcaacatagctctataatttaaaaaaaaaaaaaaaacttaaaaattaactgggcttcgtggcttgcacctgtagtcgtacctacttataaacctgaggcagtaagattggtagagcccagaaattcaagactgcagtgagtgagctatgatcatgccactggactgcagcctgggcaacagagcaagttcctgtctctaatatagggtctcaatctgtcattcaggctggagtgcagtggtgcaatcatggatcactgcagcactgacttcccaggcccaagtgatcctcccagctcagcctcccaagtagctgcgaatactggcgtgcaccaccatgcccagctaatttttgttttttctggagagactgggtctccttatgttacctaggcttgtctcgaactcctggactcaagcaatcctccagcctcagcctcccaaagtgttgagattacaggggtgagccgctgcacctggcctaaaaaaaaattttttttaatacaacaacctaagtatgtataattgacatccatggaatgtaaaaggtatgggtgggtagaaaagaatatttgaataaataatagtcaaatgtgctccacatttggtaaaaaccaaaaactggtatatccaagaagttcaacaaaactgaagcacaggaatcatgaagcaaatgactccaaatgacataatagtcaaattagtaaaatctggtgatgaagagccacttaaaagtatgattctaagagtacatttctcattagaagcaatgtaagcaagaagacagtggagcaataattttaaaatactgaaagaaaacagctgtcaaccttaaattctttatccaacaataataactttcaaaagtggaggataaatataatgttttcagacatataaaaacttacagaattgattactatcactcttgtcattagaaatgacaaaagacacccctagacagggggaaaatcataccaaattgaaatatgaattcacacaaatatcagataatgcaactccatttgaatatataatcacatttgaagacagattttaataagtgatatatgtatcacaaagcctaaagtaaacattaaacttttttataaaagaattatgactagtaagctgtattaggattctccacagaaacaacataaatcagatatgcatgtatgttatacgtgtgtgtatatatatacatatgtgtatagtatatatatgtgtgtatatatatacatgtgtatagtatacatatgtgtgtatatatacatgtgtatagtatacatatgtgtgtatatatacatatgtgtatagtatatatatgtgtgtatatatacatatgtgtatagtatatatatgtgtgtatatatacatatgtgtatagtatatatatgtgtgtatatatacatatgtgtatagtatatatatgtgtgtatatggtgagagaaaaagaacaagagagaaactaattttgaggaattggatcatatatttgtggtagctgacaaggatgaaatatgttggtcaggctgaaggctggaaattcaagtaagagttgatgttgcagtcctgcatccaaatttagcaaggcagcacttcaggaaacctccacatttgttctaaaaacattcagctcactaaagagtcccacccacattgtgaagagaaatctgcttatacaaagtttactaattaaaatgttcatcacatctgaaagttatcttcatgtcaactcctatactggtatttgataaaatcaatctggtgcatagcctacccaatctaacacttaaaattaactatcacttaacccagcaaggaaataaaaagataatttaaaaaatcaatcaaaaaaggagacagcaaaagggaaagaaaactaacgaacatatgggacaaatataaaataaagagcaagaagatccttccagctcagcctactgagtttctgggactacaggaaggtttgtagttctccttgaagaggtccttcacatcccttgtaagttagattcctaggtattttattctctttgaagcagttgtgaatgagagttcactcatgatttggctctttgtctgtctgttgttggtgtataagaatgcttgtgatttttgtacattgatgttgtatcctgagattttgctgaagttgcttatcagcttaaggagattttgggctgagacaatggggttttctagatatacaatcatgttgtctgcaaacagggacaatttgacttcctctttttctaactgaataccctttatttctttctcctgcctgattgccctggccagaacttccaacactatattgaataggagtggtgagagagggcatccctgtcttgtgtcagttttcaaagggaatgcttccagtttttgcccattcagtatgatattggctgtgggtttgtcgtagatagctcttattattttgagatacgtcccatcaatacctaatttattgagagtttttagcatgaagtgttgttgaattttgtcaaaggccttttctgcatctattgcgataatcatgtggtttttgtctttggttctgtttatatgctggccacttctcaaaagaagacatttatgcagccaaaaaacacatgaaaaaatgctcaccatcactggccatcagagaaatgcaaatcaaagccacaatgagataccatctcacaccagttagaatggcgatcattaaaaagtcaggaaacaacaggtgctggacaggatgtggagaaataggaacacttttacactgttggtgggactgtaaactagttcaaccattgtggaagtcagtgtggcgattcctcagggatctagaactaaaaataccatttgacccagccatcccattactgggtatatacccaaacgactataaatcatgctgctgtaaagacacatgcacatgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggcgagggatagcattgggagatatatctaatgctagatgacgagttagtgggtgcagcgcaccagcatggcacatgtatacatatgtaactaacctgcacattgtgcacatgtaccctaaaacttaaagtataataataataaattaaaaaaaaaaaagaaaagaaaatgtctctagacagcttggttcctgagctgggaatcaaccgtcttttctctccctttcaacccagagtgtggcaggcgcgccccctacaggcagctaaaagagctgactgagatgccgtctccatagggagggatttgggctgagaatttgggctgaggattttcccatgccctccctggcaggctggtcccaggacactcagaagacttactgttacaggtccagagcatttctcgtcttccttttctctctccttgccaagtgaccttggaattgttcctccccatctcagccccttcccttttgtgttaagtgcagtttgcagattttgtgttcctaggtcctgtatctgtagaattttagggaaagcagtgctggtcacccacatggaattcaagacagcgagcccaggaccagaaacacagacagcagtgggggtccccacagagcagcatggtgggcaccaggtggaggtaagaaaccaggaaccactcccctgagtgtcttcagccccaggtgaactagggaggggtcagtgggctgggctcaacccaccggggactctcctgtcactgccccagcagcaccatcctggaagcccctatatgtgctaagcagctgccaaagaacttgattaattacctgtaaatttcccttcaccacacctgaccacacatgactcctgcccccaaattactaatttattaaaatggcacaattagccgaaatggcctgaatccaggacccctttcaggtttgccgctgacctctcaggtcctcacacatgccagactctttccacaggggcctgactccactgtttccaacacaaatcccaggactcatttttctctgtcagtcctgacagcagttccagagacacttccccattaagatgtccccaggctcttataatacaacctgtctgttattttctgcctaaatctttttaattatccccatagcatttacaactgtaggaatctttgcctattgttaattttattaattgattggtgttaaatatttacttaattggtcatggatgcttttttaccacagaatcacacataaaaaacagacacaaacagctaagggtgtatttctcgctgcaataatacccaccactttcacgaagacaccagggtctttctcactttttgtcccaccatccctatgatattggctttattttcatccctgctgatgtgtgacctcagggtggctgctgcagctccagctatcactcccatattcaaggagaaaagggcctcatgaatctagtgctctttcacaagagcaaagctttcctaagaagaatttcacccactgatctcacaccccactgatcaggcctgagtcacatggtcaatcccagctgagcaggacctgggaatcacaggcaccagtcttttcggtgaatatagaagacagtgctcaggtggaaggtgacagggactgtctgctgggtctgcaaacccagttttcccgcacagccaaaccagcacgatgaacaactcacttcaagaaggctgtgtcttgttcctgctgaattcaccgcatggaacgtgtcccagaccacagtgggtctggattaacatttgatgggtggatgttcttctgtctctgactttggtgcaggagtcaccactgtacgctggtcctgcatccacagcggggaccagtaagagccagtccctgagtcctgtgatccccgccctgcatgccaagccctggtattacccccatgaccacccaccgcccagacacatgtgcaggcagcctcagatggaccttcctcctcctcttccaaatattcatgttcatattgtcatgagtaatctgcacccctcgcacctggtattgaggcaggcatgagtcacaaagagaagagaaaaatttcctccattggcaccagcagtctgcagaccagggaatcagggacctgaacagaagattttaattatacacccggacccaggaggcccttgagcctccagcagccagtatggagcagccaccaggggacagaacagagtcacctggcaaagtcacttggagatagggtagacctgggtgacaaggagatgctgacatgcagggagggtcagtgaccacaacctgagatctagaaaggtgtcgtttttctacagcatcatccttaacatcgagtacaaattctccaggctttgtgtttctcagctttgtctctggccaatgttgcatatttgacacaggtgcagacactttgcttccccctacacactggcccactcttctgtgctaaaacgctgtcattgccacaaacgccatcctcccctgtgggcacatgtgtttcatcaccctcctgtttgctctgagagccccctcattctgctacacagcaaagttttctttcagcatctaagctgtacctgaccatgaccacatactgggggtacataggcacagcacctgtgccctaccctaggagctcacagccaaggccaggaacttacagcatctcctgagtctttcaacactccgtgtgcacatgacaagggtgaagtttgattgtggaaagcaccactcagaagcaatggcaggtccctgcatgtgtgccagccttacggtgtcacctgtagagtggggtcatgagggtcactgcactgggttgaaaagtgccctccagagggggagctagaaccacacctaacttctggattttgccacaaaatatttagggacaggacacccctggagtcctcaattacccaagttattctgagccagtattcaacagaggaagtaccttagatctcagaataatccctcagtcgccattgtaagtcagtccctggccatctccacgcaggacaaggaatggccacatgggcaggacatcatactacctggaaaacgcacaaagaattcctctcagagttctgcatggccagatcagctcaggagtgaggccataacacaacctacagtgacgatgtcaacccagatgatgggaccagaaggagaatgagaattctgtgtgctgagggtgggtctttaggggccccctctctctctgtcccttggggctgagcccttctctggaaaccacacagctcctcctgcagcagcccctgactgctgatttgcatcacgggccgctctttccagcaaggggataagagaggcctggaagaacctgcccagcctgggcctcaggaagcagcatcggaggtgcctcagccatggcatggatccctctcttcctcggcgtccttgcttactgcacaggtgctgcccctagggtcctagccactggtccagtcccagggctctgggtccagcctggccctgactctgagctcagcagggcccccgcctgtggtgggcaggatgctcatgaccctgctgcaggtggatgggctcggcggggctgaaatccccccacacagtgctcatgtgctcacactgccttagggctctttcatccctggatctgtgtccaggccaggcacgtgggaagatttacttggagttcagctcctcagtttcaagccttttctctcccgttttctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcacacagtgacacaggcagatgcggaagtgagacagaaaccagccacctcggcctggctcacaagacccttccctctctcctgccctgtcacactgagcaggagggagccttccatgtggaatggaagtttccagtcctatccctgcccttatgttcctgagagacgggagcaagttcctgcccacctctaggctcagcttatcccagaataaactgagctagtcattttgatgatcaaatgccagctcccaaaagaccccagaaaccctgatatctaagtagcaccgactctattagtatcaagggagactagccctagggtggaatcattttagtgtctcagaaggcacagggcaatggaaagtgtttatgaggtttcaggatatgcacgtgagcagttaaaggcaggtcttacaaggaaggaacctactagaattggggcccatctgtgacatcatagcacagcctggtggacacagagaagggaaggtcctgaatcaagtcttgatcagtaaatatttattggataagtgagcaatttacataggtgagaactgtgtgctctcttgagcagaacacttacctggataattggttttcaggaattccctgaagcaatgagtgacattctttattgttttcaccctcatccacctgggaaagagtatcctggaaccagcagttaacattgacacagctggtctcggtcctcagcacaaacattcattgcaggctgaaaagtgacaacggaagagaaaggagtttattaaatccctagacacaaacaaatccataagcagagatgagagatgcgggctcagctggcccagtcccacaggggtcattcctcttgtgatggaaatgaccacatgagggtcccccaagcggtgttggggggcagtcatggggaactggcctcccagggctacctgctgcttgggctgggcagaggttagagggatggaagtctggtccagtccttcccagcagcatctccaggctcctcctccctctactggggcttcccctccactccccagaaccatcattgcttcctcatctcctgtctcctccctgccccaaggccctccctgtgctcaccctggctcctccccctgctccatgcccagcctctgcagagcagcccaggcccagagacttgggcagaagcttccgtcccaccagctgcagaaccttccctacagaaccaggccagtccctgtgtctcatatttgtagagatcccaatcaccctcagagatgacgggtgggaaaccagcccacagtgacctaggctgttgggcatatggccttcaagctggccttcaagcccacttggctgcatctccttggccaactccaacatccaggctgggagtctggaatcctagttcccctggcccattcactcccactagggttgcttctaaactccctgggcctcagcttcctagtctgcccactggaagcagcgacaggcattttccagggctgcggtaagggccctggaacaccctctctcaccctctctctccctttctctctctctctctctctctctctctctccccctccccctccccctccctctccctctctctctctgcctctgtttcctcctcagtagtgggaagaccccctgtcaggtgggccagtccatgacatctacagagggagcaggaacctctcctatttcctggaggagagctggggtggaggctgcaacccaggatcatcagaggagctggggtcttcaaggttcctagggaccccttaagcgggggtcagagtggcttcagcggtcttattgctcggtccagacagaagatgtttccagttgtgaaaaacgacttcagggacaacaaaaacagagattcgcctctccagacaccagtggttggtgtgcctggagtactcctcgtaccaggcaggggagagagtcctagacagaggaggttctaagtgtcacctagatttcaggcctcggggcctgtattgggtaggtgatgtcacagtgagttgatgctctgtagccccttccctaggaggtggcagagggaagagctggtggtcctctgaggtgtgagtgagtccaaccctgagggtcttcccaagctggaggtccctgggtgtagacggaagaggttctggtcaaagaggcctggtgttgaatcctggtccatttattcatttggtcaagaaatattcatggaggacccaatatgtgccaggtgccaagccaggtgactggggacacagtgttgagtgggacagttggctccttcactgctagaggtattatattctcaagccgagactcggctctacgattgtatgtcagatatatagcctctatgtgcatgtctccagagactggtttcctggagttccaagtgacagccatcactcacctcgaatgcaaaaattaaaggagcatccaaaaacctagtgacccagataaataatacttaatgcaatattttcaaaaatcaaaattaatgcccaacaaacccacaatgaacaaaatttcaggatctgactcactcacctcagtggttttgttcttggtcctacccacagtcccacaggtgagtgagtacccacagggatgcaaaaccagagtcaggcccctgcaccgccttctgcccggccaccagagccctcccctgggtcttggcctttctcttctgaagagctccagccagttcctcctcaggcttcctctactgctggtctcttctgccccctactggattctccccttacagctgcactccaggcagctggtggaggttaaagaacagaaacctcccaaaactccaccctccagttccaggctggctccacctcatgtccaaaaaggctggtcctccaggtctttgattgctattagtaagtcccaagacacagtctttacaccaagtcgctgtgtgccttgggcaagaaactctccctctctgagactgtgtttccacactggtagaagtagctagaagacctccctgccaggttggcaagtccactctgtgacatctacaaagggagcagggatctcttccatttcctggaggagagctggggtggaggctgcaacccaggatcaccagaggagctggggtctttggggttcctgaggactcctcagagggggatcaggagctgcagagccagcttctaactctggggactcagagatccagaacctttgtcatatccccagccaatactttgtcatcctgtgcctcagactcccccagatcccaagagtgagaagctcaagacgagacaagaaagaccagccagcttgaatttagggatggtggggagtggggagctggggacccctggacctgggggagaggagtctgcagtgcctgcaggtggagtttctgggacctgggggatggagactgggcaggggactgaccagcagaaggccaaggtgggggataccctcagacatggagcagggcagaagcaactggatggggtacatccctctgctttgggagagaagggccagggcgggacccagagagctctgcagaggcaccacagaccctcagcagggggtctgccaaacaggacagctggacttggctgcttctgcccaggcctggatccagcccttgcacatctcagggcaggggataggcctgggtggccagagctgcagctgcacctgctggggaggcctagtccagtcctccagggtccccagacagactcggatttccgactgcagccaccatggaaggatgtggtctgcggtgacgatgtctatccagaggccatggcaggtgcaagggtgggggtaggggcagcagctggggatgctacatttagggacagcccctttttatccccaagacctgggactgtccctgaaaggaaccacagcttctgggtcctgagcagtgggtgagtgtcatacccacagaggggctggaagggagcagcttcagcctagactcccagggcagaccctgccccagccccgaatatccaaggagcccaagatcagaggcaggaataggccaagctccccagtggagaagctgtgctggaccaggggtttcccagggccctcccttgtgccctgaatgatgtctgttagggcacctacaccctgttactgctcagtgccttgcctattttgaaggacagggatgtgtggtgattatttgtataatccagcccccagcacctggtcctcaaaagttacccaagcaatgtgtataaagatccagcctggagatctttgaaaaccgattcgatgagtcgaaccattaagtcatgatcaccatcctcaacttcatctctttcttcctcctcctcctcattatcatcaccttcaagaactgttaagagtctgagacttcatcctatttgcagactaaaaagtaagcctgccacagtgccatggatgctggcagaagatacaagactcctgggtcagagacaacgaataatctgtttttcacagcaatagcagttgccaaggtatcagcattgtcttgcaccagttccacaaggtgatgcaaagagggccaggtgacatctgcatgccagagctcagggatcccaaatatttcatacttgacagtaagcatatatctgtgttttgctccaaagagaggcattctctgtaccttccgaggttgttcactccacaaacactcttgaaaagataatccacaatcagtgcctttgcccgagagacatgcagaaatgcagagatccatagtagaccactgtctcccaacaaccatcaactttatcaatgaaatgaagtctcaggctatttgtctgttaccatagcccacaaaaatgtctggcttgattgtcaccaaatgtatcaaggaagttaaggagtatctgacacaaaatgtgaaccaagcaattctcaaaggagcctcccaggaaattcactttaggaagtcctaggaggctcctctgagagttgctaaaacaaaacattgagagtcctagagggctgcagatctgaacttgagcagatatttttaaagattttgtggcagaaaaagaaactggaaagcaagagggcagaccctcattgcagttctgtaatgtaagggggcagagcaggggcctttctcaccagagtatggggtcctgaagatctcctcaaacatttttatactaggctctcagggcaacagaaaagatgggagcgatgaatggggcgtaaaggagtgcaaatgacacaaggggtcacatgaagcaaaagaggtttattcaaccagatttagtccatgtttaattgagccactcctttgtgccaagctctgggttttcccatgcaccaagcagtgtgttaccacctagacccagagagccatgtcatcatcagcaaagcacgccctagtgtcatgcaaggaccaggcctcagattccgactccagacctactgcctcttggccctgtgacattaaaagagtagggaatcagcctgagcagcatttcctcatcttcaaatgtggaggacagtagatgatcttagctcccaggattagtgcttgtaaagcaataataatgtaatgcattattattgtattatgcatcatattcccatattatagtcaaaaaggaccccaacttaaagcacctgccagccctctcctcctccaccactgccgaatggagccaggcacgagtattccaggtggacagacgaatagaaatacaggggacgagccccttcctagatcctagcgcagcttgctccctacttaaggaatgatattggaccctgcattcatcttctctggatggtaattttctcacctgtaaaacagagacactggccccaaggacaccccacaagtagttgtgaatcccaaagtaagagaagaacaaaaaaagaaccagaatttattcaacacccactgagtgcttagcaaacacatggtttctttaactctcataagcttcatgctgcagaggaactctccccattttacagataaggaaactgaggcccagaggtaacctaggtctagatagactccacatttatgacttcaccactcttccttgcctgaaggatatagaatcactccctgcagggctcttgcctgactcaggaaagggccacaggatagccagccaggcttaaccaacccagccaagaaagggctggtcccaactggctggagtgcagtgtacaggcacccagcctggaagactgatcagaaaagaagccacagctccagccccagccccaaccccctgagctcaagcccttggggactcctgctgggcagctctctaggccctagggagatgctccacagacccaggctgccctttgggaagtggggaagacaagtgggtcaggtgtgcaccacccaggggcggggccaggcagccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtaaggggcaagagattccaggggatgtgggggtcctgcagcagagctgggaaagggtgaccaaggggagacaagccagaggagtgaggaggaaggttaacccctaagaggggcctgggctgacactggctttagtaatgggttgatattttgtccatcacagatttgtttgaattactgtttttaatatcatattacgatattatttttcttgatttctgagttttctggcgccacttaaattttcaccagggtcagtgcctcaatcacctagtcctagtcctctgggtagggaaggaacagaggcagggacaggacatccacagggggtggtggccactgtccccacagggtgcccaggcctgttcctccccctcctcctctctgcccatgtgcctcctgcccagtgagggcaggggccactccctggagaaggcagcaagggcttggtttggtctcccccaaggctgtctgttcaccaacttgcacataaatgcttactggggccaggctcaaggacacagggagggtgggatgaaccgaggggagctgtccagtcattggaacaggcccacggcccatgtttggagcaataaagggagaggggatctccctctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaaaaagattaagcagagaagtatataaagtaaaagcaagtgcttctgcttaccatctctcacctcttcccagagatagccactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaaccacattcattgcttataaactttgttttataagcaaagtttagatgagccagaatttatttccactaaaaaatctaaatgacaaatgatgctgcagtggaaatttgtgtgtgtgtgtgtgtgtgtgtgtgtgtgtgtgtgtgtgtgtgtgtatgtgtacaaagtgcacttatatatctccccaggatagatgcctaaaagtggaattgctggatcagagagaatgtacttttgaaatcttataggtagtgtttccaaaagtctgtgtccactcactccggtgaatggtagtgccttcgctcctacattcttaccaataatgcaaaattgttgatctttttatattctgcccatctgatgagcaaaaaattgaatgtgtttatggttttattgtgtattttattactggtgaaattattttttatatttttatttattggttttatttcgtctgtgaattaactggtcatcatgttgcccgcctttccattcagttgctttcatctttttatatatcaataacatattgggatatatttgggattttaaccacttgtttagtgtatgtattgtaaatatttttccctggtctgttttacgggtcttttgtttatggggtctcccaccataaaactgtggtaaatttttatgtgtcgaactggtttaatcttttctttatggtttctgtgacctccaccatgtgtaggaagttgtctttatttcaatattataaactcatttttctgttttattctggtacttttggtgtattggtgttttatttttttttctttacttcccctggagtttatttttgtggatgtaggaataagaccttattttccaaataggaaagccaatcatcacacatttgttgaatataaatgcaacttttctcaattactacattactgatttattacattctttctgtggttctcttggtttattgagctattcctgcgcccaccctgttttgattattttagctttatggtatgttcggtaactggtagggaaagaacccgtcattgttactttttctcaaaatagtcatgtctattatctgtcattcttagagttggactgcagaattggttctctaattttcaaaaatcattcttgtgttatgtggtaatatcacagaatatgggattaatttgagaactgctatctttataatgctcagtgtttttgttcagagacatgatgtactctccattcactcagataagtggtttaatattttattcatgcaaatcttgcacactttgttttttattcataaagggtttgtaaatataattttattgaagttataaattttttcacaattttatatcgtaaatgattactgtttctatagcaaggaaccctattaacttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataaactcttagagtgtgacctgggtgtttttctttttctctgtaggatgttaatagtatcttgtgtcatgctaggatgtctaggacagagggcaatacaatgaggggaaggcattctgcgatgtccccaggcctctggcttgaagagtaacttgctgaagtgaggactctgtggaggagcaagttatacagaaagaagtttagttgtgatctgttgagttggaggtgtctacagggcatccaagcagacataggttgaggaggcagaatatatgtgaatctggagccaagaagagaggtaagggctggaaatagggatctaagacccctggacagttgtgagtgtgcacaatgagggtcagatgcagagaaaattaggagactacagagagcagaacccagggtggggatctgggagtcagcagttgggcatgggcctggtagaaagggaagccaaggaggaggagagggggcagtctcagacaccaaggaggggagagtgactagaaagaaaaccttcttgcagagacataggggatggggaagaactgcagactgaactggggcaaaggactgttggccttaaccagagagatttgagggagagatgaggctgagagccaggggatcctgccatgtcccagcataaaaacagtacctgacacagatgggtgcttgggagctgttgtcggatgaatgagtggacagatgcatggatggacggatggatggaaggatgatagattgatggacaaacagatgaacagatgaatagctggatggacaactggatggatgggtagacagaatgatctcagagatcagaaaaagcttcatgcactaagtgggactgaaccgcgtctccatgggtagaaagcagaggaatctccacttgagtcaggaatgacccagtgctctcaatccagggagaaagccagcctggcttcactggggacacttgtgtgggggactcagaggccctttaaatgaggccagacgaggttggacaggtccaagccaactcagcactcctctgccacactgcacaggaggggatgtgtcactcagggagttgctgggacctatgggtcccagtgttgtcatcagcaccgacagcctcagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacattgcccagtgactcctggggtcaaggacagaggctgctggggtgggcctgggagctgctgagtctcatagtctaggggagcagccccaagaacagctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaatcttgttttatctcattttttttctcacataaattgctagcctccccggggttctcagtgtggggtacagggaattctgcacccagtgtgaaaatcacccaagggaggaggctcacagcctccctgagtcatctccccagagggtccttcctctcccagtcaccccttctccaactctccactgtacccctgagctaccagtctggcatcagttcagaccagtcccacaccctcctaaattttacttctcaataaatacctgatcatgtaaaacgcagcatttctaatgtgcagtctctgtctggtcatgtgtctgggctgaagggtcactgctcagggacagggggcagttccaggtgagatcccatgtctccgtcatcccacaccccacccaacctgccagggaaccgggtgagctccctgtgccagtgggaactgcaatccaaggcacaaaattgtcctgcagtccttgcccacctgggaagggacaggggcccagtgagaggtttgctggcgccctgtggggagattcaggagaaatgaagggggtccccggagaccagatgagggctagaggcagaaataatggaaaaaggacacccttgactcaaggccacggtctcagcaggaacagaaggtgaaattccccattgcatacgaggaaccagtcaggagagtgtttactgggtgagggataaataactgtgctgccactgggaacttgtaaaaacattgggaaaggaaacatgcaagtgtctttctaagacttgtacaatggacattggctaagtaaacatactgacaagtcctgcactagggaaccagtttaatatgatgagccacagcatatccaaaagcatgttgatctccttcttcacctttagaagacccaaaacactctgaaagataccagcgtttcctggaactagtttgtggaatatggggtgaggttgatgcacatgatgttacgggtatatgatcacatggctgtgggttggggatcaggctcaaagttaacactagcgtggggctggatgtcaagcatgaagggtgtggaccactaagtcaggcccaggtagagttaatttctgattggtttgtggctggagcttgatgatggtcagtctgcaggagcaggaggatgtggggaaattgggaaaatgagaaaagtcacaaatccaagctcaaactctgcatctattgattgcctgggggaggctaatcagagttgaattcaggatgagcttcagggctgggtcagactgaataagagctgagtgaatgtgggctgatggctccaggcaagtcctggcctccactaggagtcagatcccacaaaccctcctgcccgcagagcaccctctccctccgtagctcatggtggcgcagcctccccaccccatcccatgtacacctgctgcctcatctcagagacactcattccagtgtctctgacagcagatgatgtcagcctcctgggtgtggagaccccagctgtcttggagagtcctcagtgcctgggtactctcagaccccctgtctctgcctccagcacatcagagacatagcagctgcctccaccagagctgctgggtgatcccaacaggccagggacagagcctgcaaagacaggaatctctgcagtcacaatgaggcaaagaaagagccccttagagcttgatcacagccacccctgatccaaatcccagcctctcattagaaggaggcttgagggttctgttgccacagcacctgtctgagcccatttcatggaggggaaaactgagatgaccaagggccagatccatagtcctgctgggcacaaggccatccccagcagctgcctaatctttgactgtgttataagtttccattatggaaaactttgaacacatacataaggagacagagaaataataatgcccccaagttcccatcacccagcccccccaataagcaattcacagacattactgacccacccatagcagaataacccctccattacacaataccagacatcacatcttttcagctgtaaatatcccatttctatgctggaaagatatgggcttaaaagtaactgcaatattattaccaaacctaaatagaaattatcactaattccctaatatcaagaaataatcatgggctcctcaaatccctcacaaatgccagaagcgtattgacttagttaagtgttggtgctgtggttattttggggttttgggtggtttatttcagaattcaatatggcatcaaatggtgatgggcgcatgtgctgtcaggccagttgtcactggtgaatatttcctcaattgctctagtgctgcctggcaaggcaggagctgcaggagttgagagctgtccggggaccttcccacggttggaatacagccacacctcccaaaacaagaacccagggctatcatctacttctttttttttccccctgcaaaatggttctagcatggagggacttaactggattcagactagacattgcaaaatagcttccaaggacagggagctgctaacagcgagatcacccatgtcagattctcactcttgtagtaatgttagctgcataggatggtcaatagctacatccctcagaagggaaggaaggcagagggatgaggcttcagttcacctccttctcatgagtgctgcagagcatctgtgaattcagaggtctgcagctgggctctgttcacccaggagtgtgcttcatgctctaggaaggagccactttgcacacagatgatccggggcccagccatccttccagggtgaataattaatgtcttctctcatggtgaactctaggattcaagccatctaatgtttttgaagccactgtcattatatttaattgatgatgacaggtggccaccaatgatgaatattttcccagggggagtctccctaagtggctttagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtggtatttggagaccacattctggaggctcccttatgtcccccatttgaaaaagacaacggcagccaccaccccagctgtcccacccaacatgaggccagattcggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggggcaccctctgcaccaccccatggtgttaccaaaagttgaaccatgggttggttcaactttgcagagaagagaccacctaacccatctgtggaaattcactccttagcgatactgatgctccctaagaaattcaatcctgggcctgagtgatggttggtgcaaaaaacaaattcaagatcccagtgtcctccagaagcctggatttccagggatcctgctgtgagtcacaggacgtcaccggtccccttctctttgtgggttgagtgtgggggccatgtggactccctcatgagcagatgccaccagggccactggccccagcttcctccttcacagctgcagtgggggctggggctggggcatcccagggagggtttttgtatgagcctgtgtcacagtgtgtggtattcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccacaggggcaggggactagatagaatgacctactgagcctcgtctgtctgtctgtctgtctgtctctctgtttgtctctctgtctctctgtttgtctctctgactgtctgacaggcgcaggctgggtctctaagccttgttctgttctggcctcctcagtctgggttcttgtcggaacagctttgtccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagtatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcagggcatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagcctttcctgggttctcaatttgtggtggaaagaaccctgaacccagtgggaaagttgcctatgtgaaggggttctcagttccctgggcatctctgcaggtaaggccttcctcacccagacaccccttcctcagctctccactgtacccctgagccaccagcctcgcctggctgggaccaggggggtgtcacactctcctagattctgcctttcaacagaaacctaaccacgcatcacacggcacttctcgcatgccttctgtgtctgctccagtctctgggctaaagagttgctggtccgggacaggggataggtccgctcttggtcagatgccaggtccctgccatggcatccctgaccctatgcaacaagccagtgactctggtgagctctctgtgtcaggagaatccatgatccagagtttcatattgtcctgcaagcatctggtgggctgtagctcttgccaaactgggaaataccatggcccagcatcaggatgcaggacagtccggagagggaaatcaggagaagtgaaggggtctctggggagcccagatgtgggctagaggcagaagtaagggtgaagagcacctatgagtcaatgtcatggtctcagcaggaacacagttgaaaatccccattccacacaagaccgtttagcaggaaaggagtccatacttgtgctgccaccaggatgtcctgagaagccttggagaatgaaacatacaggtgcatttcctagacttgacaatgcacgttagccaagtaaaggcaatgaaaagttctctactagggaaataatttcctgtggtaaagcttagcttatgtaaagtcacatttatccatctggcacctctaaaagccccataatattctgcaagatactagtatgtcatggaagtagtttatgaaacataaagtgagatttaagaacaaagatgttacgggtgtatgataagatggctacaggctcagggtcaggctcgaggagtgaaggaggccgtgtcaaattcatgacaagagttggagctgggccaggctgggtcagggctgtgtgaatgcagacagagggctacaggcaaggtcaggcatccatgaacactcagctcccccagaccctcctgcccactgggaccttcgccctcccttggtcacagtggtggagccttcctacccaaacctctatggaggccctggatgactgtgcgttcttagtgcccacgcaaacttagactccctgtctctgcctccagcacatcaggaatgtggcagctgagttcaccagagctgctgggtggtcccgacaggccagggacagagcccgcaaagacaggaagctctgcagtcacaatgaggcagagaaatggccccttggtgcttgatcacagccacccctgatccaaatcccagcctctgaattagaagaaggctaaaaggttctagtggccacagtccctgtctaagcccatttcacaaatgagaaaactaagaccacccaaggagggccagttacgtaggcctgctgggtacaaggccaaggtctacttcacacccagcagctgtccaaagactgagctgtgtcataagtttatattatgaagaactctgaacatataaataaggagacagaaaaataacagtgtcccatgttctcatcacccagcactcaaaataagcaattcacagatgatgccgacccacccacagcaaaataaattctcccttacacaacatttagaaagaaatacaagacatcagatctgttcagctgtaagtactccattactgtcctggaatgacatggaccttaaaataactataatatcactaccaaacctaaatagaaattatcactaattccctaatatcgagaaataagcagggtctcctcaaatgcatcagaaacaccagaagtgctttggcttagttacatgttggtgctgttggtatttgggggtttaagtttatatgaggagcaatatgacatcaaatggtgatgggtgcatgtgccatcaggctggttgtcactggtgaatatttcctcaattgctctagagcctcccggcaaggcaggagctgcaggagctgagagctgtctggagaacttcccctggctgctatacagccacgcctcctggagcaggaacctagggcttccctcagcttttattttcctggaaaatgattctagcatgaaggggattaacttgattcagattggacattgcaaaatagcttgcaaggacagggagctgctaccagcagagtcacccatgtcagactgccactcttgtagtaatgttagctgcataggatggtcaatagctacatccctcagaagggaaggaaggcagagggttgaggcttcagttcacctccttctcatgagtgctgcagagtgtctgtgatgtcagaggtctgcagctgggctctgttcacccaggagtgtgcttcatgctctaggaaggagccactttgcacacagaagatccggggcccagccatccttccagggtgaacaattcatgtcttctctcatggtgaactctaggattcaagccatctaatgcttttgaagccactgtcattatatttaattgatgatgacaggtggccaccaatgatgaatattttcccagggggagtctccccaagtggcttcagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtgatatttggagaccacattctggaggctccctcatgtcccccatttgaaaaagacaacggcagcctccaccctagctgtcccacccaacatgaggccagattcaggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggagcaccctctgcaccaccccatggtgttaccaaaagttgaaccatgggttggttcaactttgcagagaagagaccacctatcccatctgtggaaattcactccttagcgacactaatgccctctaataaattcaatcctgggcctgagtgatggttggtgcaaaaaacaaattcaagatcccagtgtcctccagaagcctggatttccagggatcctgctgtgggtcacaggatgtcaccggtcccctctctctgtgggttaagtgtgggggccatgtggactccctcatgagcagatgccaccaggaccactggccccagcttcctccttcacagctgcagtgggggctggggctaggggcatcccagggagggtttttgtatgagcctgtgtcacagtgttgggtgttcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccgcaggggcaggggactagatagaatgacctactgagcctcgtctgtctgtctgtctgtctgtctctctctctctgtttgtctctctgtctgtctgacaggcgcaggctgggtctctaagccttgttctgttctggcctcctcagtctgggttcttgtcggaacagctttgcccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagcatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcaggacatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagccttccctgggttctcaatttatggtggagggaattctgcacccagtgggaaagtcacccaagggaggaggcttacagcctccccgagtcatctctctggaaggtccttcctcttccagtcaccccttccccaactctccaccatacccctgagcctccagcctggcctcagctcagaccagtcccacaccctcctcaattttacttctcaataaagacctgatcatgtaaaacccagtttccaatgtgtcgtctgtgtctggtcatgtgcctgtgctgaagggtcactgctctgggacaggaggcagtttcaggtgagatcccatgtccccgtcaccccacaccccacccaacctgccaggaaaccgggtgagctccctgtgccagggggaaccatgttccagagcagaaagttgtccctgcagagtggtccctgaaatgcagttcttgcccacctgggaaggatgtggagcctagtgaggacagagtggtggccctgagcagggcatcggggagaaacgaggagtgttccaggaccccctgctttgggctagagacagaaaacccttgagcccaggccaagatcagagcagaaacagggttgaacttccctgtcccatccatgatacccagttaggagaccatttactaggtgccatcaccttacgttacattacaacattacgtgattgtgccatcacccgggagacatgaaaaaggctggaaaatggaacccttcagtgtagtttacactttcacaatgtacgttagctatgaaagatgctgacaagtcctgcagttggaaaacagttcatgttacataaccttgcaagtcaagaattctattcagtgtcccaacccacttagccctagagcgctcttcaagacactggtgttcatgtcactagtgctgggacatgggctgaggctgaggcacacagatgattcgttgtgatcaaatgggtcaggctcagggttaacactggccaggtcagaaagagagcatagggctgagatctcaaccatgaagagtctcgaattctaaagtcaggggacgcagtagagttagattatggttatggctggagccatgatggccagcctgtgtgagggtaggactcaggtggactgggtcaaatgagaaaggcaccatcccaagcatagaatcggcatccattggttgtctgatggaggctgtgtcaaaatcatactcgcccaagaatcagggccaggtcacactaggtcagggcagggtaagtgtgacttaagggctacaggcaggtcaagttttcatgggactcagctaccttagacccctccccaccagggcctactccctccctcaatcatgtggttcagcccctccatgtgcacctacaccctgatgtcagagacacaatcatcccagggtccctgacagcgagtgaggtggccttgggagatgcacttcccagccctcctcatcagtcttgggcactgtcaggccccttcttggtgcctccagcacatcagcggtgtggcaggtgccttcaccagagctgctgggtggccaggccaggcctgagacagagcctgcaagggcagagaactctagggccatagtggggcagagaaggggttcctcttggagcctaatcatagaacccctgcctcaagtcacaacctacaagttagaaggaaacttaagggtcctgattcccaccaccctgtctggccccatttcatagatgtgaacgctgagacccctatagcaaagaggaccgctttgatctccaccttctcaatggccctgctgggtaggatcccctctggatgtcccctggtgctgtcccaagactaatctctctaattactgccttgtaagatattacggaaactgacagcaagaaaataaaaaaacaggaggataatacagctcatgttgacccacccacaatcaagtaacctcttttacacagttgtttgaagcaaattgtagacatcatgtccattagtctaaatattccatttgtgtctctaaaaatatggacccccccaaaaaaactacattcttacaaacctaaatataaatatctaattctttcatatcaaaaaaagaatgtttcccatcaaatacttcacaaatatcctatgcttctttcactagacctgtgtttgtgttgttattctgtggttttccatttcatttctatgaggattcaatatggtttgaaattgtgactggtgactgtgtttttagacctgttctgtctgcaggtatcttcctcattgatttttaatttccttgcaaggcaggagctacaggagctgggggttggtcccaggaccttcccatggtcaggatacagcctgtggcctccccaagctggaaacaagcgctcctctctgcttctgcgtttcctgaaaattggttcttggccagaaaggtttaacaaggctcagtgtgacttttcagcaagaccgcttggctactgggctcccatgtggggtcatctatttgtgacgttagctgggcttcacactttgtatccagtgccattagatggtatatggatgcaaggtgactgcatttcagttcgaccaccttttccttctactgactgtctgtaaaaggtgtgccctcatatgttctttgctcctctgggagtgtgattcttatttcagtaagaaatagcatagacatgttgagtctttcctttcatttagcatcttaataatgatgaccatgttgcctgccatctcgtgaagatgaacaattatttcatggtgagctcaaagttatgttactgtatgtgactcacttgagtccaccatggttctattttattgatgatgacaacgacccaccgtggcccactcagtgcctcttctggtggccccaggatcctcctgaaggaacccaggagacctcgatggctttccactctctgttcacaatctatcctgggcacatctttctcctgccttgtgcctggaattgcccattaaccccaagtggactagtccccataactgggaggtgggatttagtgaccacacttggggtgcttctcacacagcccttttgagtcagacactccagacatacccagaaatgagacaagaccctgaaagggtaacaggggcttgcttccaacttctccctggaggttgaggctggcatttcatactaaaacctagtgagacccatcccaaactaagacaacacaaggaggacggaagtgagacgccctggagttgtggttgtggtcacgttggagcttcccatgactgctgactctggggcaagctgcccctcctctaaggcactcactggggacacctgaggacgcctcctgctcttaccctgtagtcacaccaagagatcagggttacaacaaccctatagagaatccctgtccccttccatgtcacttcactccttcgtgaagcaaatgccctcaaggagctcattcccattcctgggtcacagtcacctggaaaacctgatccagacaccaacctcctcaggcctcgccatttccagacgtcccgttactgcatacgcttggtcgactgtcccatctcagcttgagaagggcaggcaggtgtgtggactctgctgagcaaatgccttccaggggcagtggtctggcttcctgcaccatagcttcaggtgggggatggggagggggagttaggggccccagggaagagtttttgtatgaacctgtgtcaccgcattttgtatttggtggaggaacccagctgatcattttagatgagtctcttcttccctttctttccctgccaagttggtgacaattttattctgatttcgatctttgtctgtgacttgccacagcctgtggtcagggtttcctttgggacctcggtcctgggaggctgatctctctcctccctattcagacccctgtatgcctcagctggtcactgagacaccttcatctcctctgaccccagaggcagggagctccaagacaaggccacactggtgtgtctcatgagtgacttctacccgagagccatgacagtggcctggaagatagatggcatcaccatcacccagggtgtggagaccaccacaccctccaaacagagcaacaagtatgcggccagcagctacctaagactggcacccgacagtggaagtcccacaacctctacagctgccaggtcacgcatgaaaggaacactgtggagaagacagtggcccctgcagaatgttcttaggtccccgaccctcacctacacacgggggcctagagctgcaggatcagggcatgtgtctcccctcccactccaagtcatccagcccttctccctgcacccagtaaccctcaataaatatcctcattgtcaaccagaaatcctgctgtctgtcttcatttcttatctcatatttagtttgcaacctccttaaattctaagcaaggatgaggaaaatccaggtgcccagtttatcgggtgagaagtccatggtggtgccatcaccaggaacttgtggaaaggtctgggaatggaaactcacaggtgaatttcacagattttcacaatacagggtggctaagtaaagacacttacaagtcctgcaatagggaaacaggaagtccagaatcctgctcaccatcccagccaacttagtgagccctaggatgctctgcaagatactggtgttcacgtcgctagctctggaaagtggggtgaggctggggcacacgggtgatcagttatgatcagatgggcttagggtgaggttcaaagttaaccagcacgtggctgagatctcaaccatgaagttcccaattctaaagtcaggctctggggtggagtgagtatgtgcttggtgtgtggctgagcctgtgatggtcagctcgtgtgaggggaggactcctgtggactgagacaaatgagcaaagacaccatcccaggcacagaacgggcatcccatggttgtcggggagagtctgtgtcagagtctcattctggactagagtcaaggctgggtcacgcaaggtcagcacagggtgaacatgacctaggggctatctataggcaaagtcaggctttcacgggatctcaactgccccaaacacccccatcccaccaggccccactccctctgtcactcacgttgttccgtcccctcaccccctgcaccatggtgcaccggcagcctcactcagagacaccctcatcccggggtccctgacagtgggcaatttggtcccttgaaggccttgacaggctcggttaatccatagtgcccgggctgggacccccactgtttctggttcatcagggacatggcagcagctgctgggtggccagccaggacaggaacagagctgcaaggcctgggggctttttccacaatgatacacaaagagaggggcccctttggagctcagtcccagccacccctgccccaaatcacagccgtgagctgaattgaatttcaggtgcccagagtccctcagcctctgtttgacccatttcacagctatgaaaattcaagcccatgggagacactgtcccaagcttcaccctctctataagttgtacatttttatgatgaagatctctgaacacaaaaatagggagacagaagaatagtaatgactccaaggttcccatcagccagtccgcagcatcatccattttcagataatgcggacccacccacagcagaataactaaactactccttcaagcaagggtgtgaagcaaatgctagtcatcacacacacaactggagagaatatcaaggatttcttgacatcaaaaatagttaatgagagtcttatcaaatgtcttgtgaatatcattgtgtctatttttgtcgactttgtggtgctgttgcatatttgtgatttaatttcatttctatgtggattaaatacttgacgttatcattggtgaatgtgtttttagacccattccatctgcaggtgtctcccaaattgctctagctttccctggcaaggcaggagctgcaggagcagagagctggtcccgggacctcccacagtcgggatgcaggcgccacctccctgagcaggaacccagtgcttccctcaacctctcttttcctgaaaaatggttctagcatcaagaggctcaagggggttcaggctggacattggcaaactcgcttcccaggacacgtggctacttccagcaaagccacccatgttgtgttgtcattctttcagtgacattagctgcatttgatgatcaataacttcgcgcctcagatgagaaggaaggcagatggtcaagacttcggtccacctccttctcatgagggcttccagaagggagggcacagcagctgcaccgtgcgctcaggagtgtgcttcatgctttgggaagaagaaaaaatgtacattcttcccttttgttcaccactttgataactgatgatctggtgcccagccatcctccagggcgcacagcacaatgtagtaccggagtgagctctagcgtgtgaggacatctgacatgtgggctccactgcagatatactgaattgcaatgacaatgcggctacaaaacataaacatttacccactgggcgcctcctcaggtggcatctgattttctcccattgccccaggagcttccatggctcctgatttctcggaggatgagaggttctgtctcatcatgtccctttcctgccccaggcctgggatcccgcactgacctcacctcccttagcagaaggtgatatttggagaccacactcgggagctcctttatgtccctcacatttgaataaggcagtggcagccactaccccacctcacccaccaaaatgagaccaggttgaggggtgcaggagatccttccattttaccctggaggatagggctggcatttccagtggggaccagccaggcctcactggccaggcccatcccaactaggacaagcccagggaaggctgggctgaggctcctggagtcacagataggttcatgggaagcttcccaagacaccgcactctagggtaaccagcttcttcctggagggagagggcactctctgcatcaccccagggcgtcaccaagcagtcagtgtcgagtcagctccaccagggagaccatttatccctgaccatgggagttcactcctagtgacacagtgccctccaataaactcatccccatggctgcatgatggttggtgggaaaaccaaatccactgtcctccaggaaccaggatttctagggatcctgctggtcacaggatgtcacctgtccccttctctctgtgggggtgagtgtggcagccgtgtgaactccctcatgagcagatgccaccaggggctgtggcctcagcttcctccatcacagctgcagcgggggttgggggtagaggcgtccagagagggtttttgtatgagcctgtgtcacagcactgggtgtttggtgaggggacggagctgaccgtcctagatgagtcttttccccctccttccctggtctccccaaggtactgggaaattttctgctgcttttgttcttttctgtatcttgtgttgacctgtggtgatgctttctctctggagcctaggccctggtcaaggacctctcccctccctgtttagacccttacctcagtgggtcaccaagaccccttcacctctgacctcagatgtagggcactagactggatgacctactgagactcatctgtctgtctgtctgccagagccaggctgcttccctaaaacttgctcagttctgtcctcccccacctgggcttctgtctaacgaactttgtgcaagggaaactgaggccccatctcatgagggagagggaacaaggggctcgaaggagtgaccacctggtggactttagaaggacctgaaaccctcagagccaagataggggaatgaaaactcagagtctcagggcccagtcccctggactgtgggactctggatccaggctgggaacaaggtaggaggtgcaggggcctctccaggtttctgtgggctcccagggagagagccctgagctggtctgggacccatgaagccctgtcaggagggacgggaaggctctggacatgaaggagccaggtgaagtgtcacgaaaggccatggcattcagggaggtggctgatgggtctctgtgggaggcacccctagaagcaggaacccctgagttcaccgacaggcatatcccaaggcagaaaaactgtagattggccctaaacacagagagactctaacacagactccacagacaaagagcccaggacagacagacagtgggacttgggtgagcaaaggccctgactccactgcagaagatccaggagagacggatgtgggtacaaacagagttcttacgtgagagacccactctcccccaacccagagcagctgtgtcaggtgagaaaagtttccagagtgaatctaacaagaggctcacagagctcagagaacacagccagagccggatcacgtcaggatgacagggtgaggcagcgccaggcaattgaaggtccactgtctatacaaaagcccaagtccttggaagatttccaaacaggcgatgggcaggggccaagctcagaggttttctgactgacagagttcttttaggaacatgatgtcacacccttctgagacagtgtggaccacatctgagaggtcctgcactggtactggggggcctgaacactcctcatgcactgaggtcaggggctccccaggtggacaccaggactctgacctcctgcccctcatccattctgcaggtccgctcaaggccacccccttggtcactctgttcccgccctcctctgaggagctccaagccaacaaggccatgctggtgtgtctcataaatgacttctacccaggagccatagaaggaaaatggcaccctagtcaccaagggcatagagacaaccacaccctccacacagagcaacaacaactatgcggccagcagctacctgagcctgacgcccgagcagtggaagtcccacagaagctacagctgccaggtcacgcacaaagaaagtaccatggagaagacaatggcccatgcagaatgttcttaggcccccgaccctcaccccacccacaggggcctggagctgcaggatcccagggcagaggtgttccctcccaccccaagtcatccagtccttctgccgacacccaataaaccctcaataaatgtcctccttgtcaatcagaaaacatgctgtctgctcatttttgtttatccactttccatcctaaatttttttatctccaaagatcaacagaatcctttggacttgtgacaatgcagcctgggaccatcttcgtgtttctctgagccgtactttttccatcaccttatccccatagaatgttccagaacaaggaaatagtcttcagaaggaaccagacatcttcattcttacccacgtctctgttgtgcttcctgctgccctgtgagcacgtccacctctggctgcccggggacacaccctccttacatccctatggccccgggagaacatctcagctcccttctttgttgtcctcggccctcactgtccagatgccatccctctctcaaggtgtttgtccatccccctccaaggccatgtggtcaccccacctgtatttcccctcatcaaagcctagagcatctccccttctccatgggcacactctgttcccgtcatcccagggaccctgccctcagcccccacaggccctccctataataatcactgatgggatgcttaccccctggaccctggtcactcaccccacatccccctctgggtgcctctcatcccacatgtgtcaccggatgccccagctgtattcaacattcctaggggacaagggtcggctctgctcctcactgacaccattatgaatgcctaatgtcctgctgtgcacaagttgtcaattgactggtgagttcaaagtcagattctggggttatgccaggagcttgggtgacgctgattcttcttctgaagaactcagcatgggatctgagctataatacacacacacgtgtacacacacacaatgcacataaacacacatgtccatgctgggcatccttctgggaggatcaggaaggtagaaggggctgcagtcaggcccaggtcaggacatgagcaaagcaaagctgagacctgctgtctccaggctttgggactagggggtcgcccctggatatgggagggtggggcagggttttctgtccaggccaagagggagacaggagaagatgtggacgggattctgatcagggagcagcaggccacatctcagcagtcaggggaggcgcttgctgtggggaatactgttggggactgcatggtgccaggagtgtgtcccaggtgtgagctcttcaggtgatgggcccagaccaggatgcaggtccaggctgtgtgtgtccaggccccacactgcacatgcccatccactgtgggtgccccccgtgccggtgacactccagagcacaggctgtgtgggtcacccgtgcatgtaggggactgcagagcacacacatgtgggtgtgtgtgtaagccgggggagctgaagtggacagcagagatcccccacacgtagagctcctggaggaaaccacactgccagtgaggcctatgacctcccttgagaagctctcctctgggccattgcagctctaatccagcacacatggcctataggtaggaagctgtccccatgggttcaggaggcggacttgggcagtgatctgtgagctgctccttcaggacagctgggccaaggatgctggagctcagaccttgcagtggggtctgtgtccctgtggtcaacgtcattcttcccacaacccccaattcccattccaagcccatcccatcataacctccagtgctgaggatgtggggggcatcaaggaccctccccaccattcccaacttctcaaagaggtcccagctgcaccatgtcagtggcgtcacccagccgctcacctccccttcctccctggcattcctgacaccagctgatccaggccacccaactcctcagaaatgcaattacctgggagacaattccacacacagacctgtcaacccttcccatgactgaggtggatgaacccctaagcccccaaggaagtgatattcaggtcagtagaaggtgacccccttcaccccacctatggctcacccacccatgagaaaagggggctggaccctgggccttgtgagcagctgcagggggttggggggcggggtggcctgggtcgggtgtatcaggagggtttgtgtgcagggttatatcacagtgtaatgtgttcggcagtggcaccaaggtgaccgtcctcggtgagtccccttttctattcttttgggtctagggtgagatctggggagacttttctgtcctttctgttctctctagggtagaggtctcaatctctctggggtctgccaccattgccttttttcctggccccaatttcctccagcctgtcccttcttaggcacctggtggggcatgatgggaagatcccagtgacctcttaatgctccctgctcaggcctgaacctgccgctgtcactcagggggcattctcccctgggctctgggatgttctgctccctcgcacagagtctccagtccccaaagaccagcagagcaggggctcaggctggggcaccagggccatgggacaggggaaggatgctggaaaaagttcagcttcccagggttctgggtcccaactatggggctgctttaaacaccaagaagggaggcctttgactggggacttggggaaatgaagggggacaaggatggaggaagaatgtcctgtgaggtggcgccagggtgctgggtccctcctcctcccccgggacaggcaggctgccatagacagggtggttctcaggacactcagtccaaggttagagcctccccatcccacccaaaaagagagacccccaaagcagatgctgagggaggcactcctggtgggcgcaggtgacagggacctgtcaggacagacatttgtcctaggacagccagatctcccaacgacagggagaccccatagagcagacacagcgccaggctcagaacagaaaatatacctcacatgcaagccctccatctcctggactcccaggacccggctcccaggactgacatcccctccccaccaaggggcctctgtgggaaagtggggcagagactgcaatgatggtgctgggggatatgtgaggaagaaattcacttgtcaaaagggaggagaacctaaaaacaggacacagatgccctcgtgaacagacccagaggagggacctggcaggggatgttcagacagagacgtcccccaaggaaagacgagggcccagggctgaacccagccagcgtcggggagcataggtgaggtgagagctggctgataaggaggggagaatctggagaggaggctggagcagaagaggcctgattctcctcagtcctcagatgctgaggagtttcccatcaggaggtaagcgtccccgccaccgccaagttgacctcagtacagcaagggcccagcctgaggtccctatcctgggccttagtccttcacccacctgaaaactgaggccaggggctccccaggtggacaccaggactctgaccccctgcccctcatccaccccgcaggtcagcccaaggctgccccctcggtcactctgttcccgccctcctctgaggagcttcaagccaacaaggccacactggtgtgcctgatcagtgacttctacccgggagctgtgaaagtggcctggaaggcagatggcagccccgtcaacgcgggagtggagaccaccacaccctccaaacagagcaacaacaagtacgcggccagcagctagctacctgagcctgacgcctgagcagtggaagtcccacagaagctacagttgccaggtcacgcatgaagggagcaccgtggagaagacagtggcccctgcagaatgctcttaggcccccgaccctcaccccacccacaggggcctggagctgcaggttcccaggggagggggtctctctccccatcccaagtcatccagcccttcttcctacactcaataaaccctcaataaatatcctcagtccaccagaaaccctgggttttgtgttttgcttctgtttatacattttctaccctaaattggtccaacctgcaagatgaacaaaattcttttagccttgtgggaatgaagtctggattgtttttgaggggtagttccaccatcacctagaaaggcccagagaatattccagaacagagccttgggcagcaggccccaggactgcccctttcccatacgtgctgtgtttgtgtggacatgtccacctccagcggcctggggcgaccgctccttggttccccatggcccagaagaacgagtaccctccacggatcatcaggcctcacccctggacagcctccctctctcaaggggtccctccttctgaggcggaaggagcctctccagtccatgggcccttggtctcccctactccttaggggcccaccctgttcctgactcccaggaccctgccctctacccccacatctatctctgaagcaggcacagactggaccctgaccctctggacccaggtcactcaccccacaggccagctgggtacccctggtcccacatgtgtcaccagtgtcccagttatactcaagtcccctgggggataagggtcaactctactctctctcacccctaagtaaccagcccaaaactgaccacacctcaagtacctaatgtccagttatccacggatggtcagtggggctggggaggtcaaagtcaatcatgagattccagagtggtgccatagacgtgcctgtaaaccaattggtctttttaagagctgtatgtgggatctaagaaccgggttgatgattgtcccaggaggtagcacaggatggggggcctgggctatgagacaaacacacatacatacatgttcacaaacataaacacacatgaacacctcataggcacacaggtattcacaaacaaacatgcctgcatgcaaatacatacacacacactctcctgtgctatttagaatcattaccacatgggcatcccactaggggctgtgctgggcatccaggaccctcccagggaactcggatctccataggggaccagctccaccttccctgtggcataaacaggcttctcacttcttccatggtgacagtctccaaaggagctgagccgggacacatggcttcctccaggacagagagtagcaggggacccagatgtgatgtgcagacatgcctcctccctctcccctctccctctgggggtgaagggatccctgacttccagtaaagtgtgcatccatgcatggaggggccatccccctcaccctcctatcggccagacctgcttcatgacagggccactggacctgggcgcccaagctgctgcagcggggaacgggtcgggtgtgtcaggaggggtttgtgtgtggggctgtgtcactgtgtgctgtgttcggaggaggcacccagctgaccgccctcggtaagtctccccgcttctctcctctttgagatcccaagttaaacacggggagtttttccctttcctgtctgtcgaaggctaaggtctaagcctgtctggatgtctggaatctttgcccctccttgcctgggctcctgccctcttctgtgattctgtcctctgtgggtcccagttacggggctgcattaaacacagtgacaggaggcctttgactgaggacttggagagatgggggaggaaatggcaggaggacaaagatagaggaagaatattccgtgagaaggtggccccacagcgctgggtcacacgccatcccccaagacaggcaggacaccacagacagggtggtgggtctcagaaaactcaggccctaaacgtggatgcttaccaattcctccactggaggaagacctcagagcagatgcccaggacagggacttctggtagggacggtgactgggacgggtgcctgtttgtcagggaaaacccactggagagtcagatcccccagataacttctcacgacatggagactctttcgaacagacaaagctccacgttcagctcagggagtaaaaaaaaaatgcctcaaatggaggcctttgatctactggaatccagcccccaggactgacaccctgtctcaccaggcagcccagaggggtctctgcagggaggtggggtgggggctgcaatgatggcaccagggagatgtgtgggtaagaaacccactccctgtgagagagaagagcctgaacccaggaccaacagctgccctgcatgaagagatgagaacaaggggaactggtaggaggtgttcagacagacacccccaagatagacaaatacccagggtgagatgtggtcctggactccatcccatccagtgtggagccagcaccggtgggggtctataggtgatggaaaatatgaaaaagagacagatccaagagggggtctgtgacccccaagagtgggggcaactcccatctgacagcgagtgtctccactcaccgctgacctgacctcagtccagcaagggtccggcctgaggtccctgccctgggccttagtcccatacccacttcaagactgaggtcaggggctccccaggtggacaccaggactctgaccccctgcccctcatccaccccgcaggtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctcttaggcccccgaccctcaccccacccacaggggcctggagctgcaggttcccaggggaggggtctctgcccccatcccaagtcatccagcccttctcaataaatatcctcatcgtcaacgagaaatcctgctccctctcttcttttcttatctcacacataatttgaggcctcccctgggttctcagtgttgggtgggggaatcctggcacccagtgagaaagtggccctgagggagaggctcatagcctcccggggtgtctcctggtgaaagaggcccggataggagaagtctgatcactgaacaccagtccctctgccctttcattcctcccccttctcctcaaagcatagccccccacctccctgcctcctgcctggatggagttgtctctggctgggactccagttacaccctctatctctgccctaacagagacacccttcacccaccatctcttttcccagcctgaaaaccctgctccaagcctggagcctctttgcccctggcccttgcccccggaatgccctcctccctctgtgcccagctcagctcccacccaccctcaccccctccctgtcatccctgagagccagactgtccaggacactccagcaccactgacttctcaagctgttcaatgagggacccacctcgattcctcacctgacagcaggttcagacacttaagaggaatgggaggaagccaggaaggagactcacacgaaaggcctacaggaggctcgggacacttggaaaagataggctctgagctccctaggaaccagtgcaaggagggtaataagcacttcaccacttctgtaaatttaaacaaaccctttgctgaagggaaggtggtgttctcaatgctggggccagtcatctcgtcacaactaaaagtgggaacatgttctatccaaggcctcagtagtaatgggatgtgaaccttgacacacgcacaggtaactatctggcagcccttagacatggtgattctctcaagtgcgtgaacagaaagtcactggccgtctttgggaacatcatttttgggaacacttctccattggatcccgggccttcactggaaaaccaggtccctcatcaggactttctctgtgaggttccctgagtctggggctccaactgctctctgagaggaaggggtgggggaagagaacacgacccagccccacccagcccctcctgcatggcccctcctctgtagagtgggggcacctgcaggggtcaggcctgggttactgtgggtggggcctgggaggggcccttgtggcatcctggggagtctctcccacggctccttgtttgactttcctgtggctgctggctgttatcacaaatgacccctaatttagtgccttaaaacatcacacactgattctctcccaggtctggaggtcagaagtccaaaatgagtccttgggggctaaaatcagggtcccagcagggccggctccttctggggactctggggagaattcgtttccaggacttttccagcttctagaggacaacctcagctcctggccccttcctccaacttcagagcctgagctcagcatcttcaaatctctctcttgctcttctctccctccctaccttcttctctccctctcttccttctctctctctccgtctccctccatccccacatcttgtcctctcactctgaccctcctgcctccctctttcttctataaagaccccagcttggacccacctggataacccaggagcatttcccacctcaggctcctaattgacatgacatctgcaaagtccctgtggccacacatgacacatagacaggtccaggattgggacacgactgtccccgcggggcctaatttagccgaccacagcccctttcccgagttcctctccctttctccatgccctgcccagtccaggctgagccactcctggggggccgtcccagcccagcccaagccctccctatccctggtctcttgtggccccttctcctcctggggttccaggaaggcactgggagtttagccacagctctagggcactgtcttccagcaggccccctgagactaaatgccctccaggccaaatcacccttggaggaagatcctattgtgatcctcactctaggatggtgacatcacagcccagagagcctgagtgacctgccacaggtcacagtagggactcaaacctggtccacccaactgcagatctcagctctggaccccaggtgcctggctgccctcagcccacctggccacgcccacccacttcatccagcttcctccctggagagctcaaagcccactggacccaggcccccatcccgggacccgggattcaagtgacagaattattggaccaacaagggatggaaggggacggggcctcaggttggagtagccagattcctcatgccccttctccttcctccgggtcaaatatcagggtcagggcactcggagggagggaccatgagagtccccttttcctagagaccccatctcagtcctggttctggatccagggcttacggtgtcccccacctccaggagagtcagtccctggcaggtggctccccaagcccaatcccctccattcctggtcccagttgctccctcaacatccaaaaattcctgacatcttcagtcagggactgctctcccaagggaagagcacatggggctctgggtctggggctgtgggaaagaggaaccccggtcctctcggggcccagcaccgagcgcagtaggtgttcgaggggggctgagtggtgacatgtgagactctttgtagaaccccagattcaggttcgtgtacctgatatgcagcggaggtcaaaaactgacacaagtgcttggagatagaaaaagatttatttcatttggctaaagtaagaagacaagaaagcaaattcctccactccatgttaacaaaaggatgaagcagggagtttttatgtggctaaggagtgagggaggtggcatttcaggggaaaagtctgtgtttattcagtctcaggtaacatcttaagcaactagacttgcgggcgacagcggctggtctctacgtccctaaaggcattcactcctgcaaaatacttttgtgactctgaagttatctcctccttcttgacaaagaaacaggacatctgcagcttatgatcacattgtgtgaacaagggatgctgggcaaaaagcaagcagttaacttgtacaagcaggcaagggccaaatcagaattttctttacttcagtcacaaaaatgctgggtactgaaatctcaactcacctggtgtcactcccagggcacaggctaggacaacacgcacccgtccctggagaactctgggctggttcccccttctccccctgctgaccccctcttagtctacctccgctcctcccttcccccaccggagaacctcccagggtttccatttcctcccggataacataacacgtgctgccctgtgaggaggtgctaaagtcaagagcaaggtggcagggggctttcgagcaagaggcgacctgacttcagagaccctcagtccccaagacagacgcatgccctttgagagagcggccgccccaggcacacgcaggctctgggctgtcaggatgggagcacgtggtcctcttccacccacctcccgaatctcccctgctccccgcacccatttccctgtggcccccatttccctgtggtcactgtaatcggaccccactccagtccccttccccactgactctgggagctggggttgatgctggggctggagcagtgaccagcccatggtgaccccggccccatccaggtactaggccactggccaccaatcaactatggtttcccaagcacccatatgtgcccagcctgggcttgggacccaggcctagtcctgcctggcccactgcagcagtaatggtgggctcttcctggagagaacctggaccacagtctctctgcctcaacatctcagtatgaagggccagagaccctcctgatggtcaccttaggagcacaaatgtggtcctgccaggaagaagtaataaaatgtgaatgctgccttcctctggctgcccctccctctctcctgccttttacaagtggtaatcaagggctcctggcctccacggtcccctcccttcctgcctcaagcccagcagtctcaccaccaccccatcacagccccagtggcctgcacgtggctcaatccaatggtcccctcactgtcctccttctgttgacctcaggatgggcttggcaactcacatcattctcgtcatcttgaagcccctcacccacccacccccacccccccgcccccccgccaaggtcctctcttctatggtcccctcccactttgttctgctgctgccccatcagggccaccggcagctagcacccttggtgactctttctttcactgtgtgattcatgaactaccggaatgtaaaagggttccttgctccttccccggccccagccctcagcccagtggtgcctcaggcttgatggctgcccagggctgctgaccacgctctcctggtgccgccctgcccagcaccgatctgggacaccacgggagcctggaagcaggggctgcacccctcacgtcctccgatgttcagccaggtgctgggctgggtatcactgagcccctcgatggccactgctcgacagtggaactgctcccggctctgctgaagatgctacctcacctgccacctggcccagggccacttccagggaaaccctgcactggcgtctgtcctctctatgtcatgggatcccaaaccaccccaggaggcacgtgtccatgtcccgcacaccttacagatgaggagacggagattcggagaccagcagcctgcccgagtcccacagctgcccagggctgcacagatggtgggcactgggactctgatccaaggtcaacccagagccagccccttccctaaggcgtgcagaggaggctgagcctgcccaggtcctgcaggtgttcagggcagcacagtggttgcccaggcccctgacctaggccacccttccatcctgaggccgtgcctgggcaaggccaagagatggtgctgagtgcatgaacccccttgtggctctgtgggatgggcagacctgggctcctcattctctgttgactcagtgggtgaaagaggcaggcaggagggcagccatgggggtgccctctgagtctacaaagcagagccaggacaggtgttcatgtgcccatttcacagatgagaggactgaggctccgatgggaggggtgatgacccacctagggtcacacagtaggttaccggctgacccatgcccgcctcttttcatgactcctcggccctaagggcttttcattcattcattcatccattcatttgttcagactcactcattcattcattcaacaaactctcagctgtgggccaggggctggtgtatgcagcccaggaccacctgccctagaggagctcacaagcttggagaacgacatggagacaccactgcccccaccctgtcaagtctccaaggttggcactctgcccagggagtgtctggggcagcaggagcatctccccacactcaggaaaagatttaactgaaagaaccatctgagagagccccagctgtgatccttgggccacagtgggaacatcacagtccctcactgaccctcacagtgaccctgaggcctaaagctgccattgcccacctcacagaggggacgtgaaccatgatggatgcaccagcgctgcccaggctccacccagttcaggagtagccgagttgggccttagcccacgcctgtcttcacatgccactgtgtctagctcagaccggggccagcccctcacgagtgatggcctcatgacaccgaaggagggttggtctgtgctgggggaacccctcaaggtatagggaagagtgtcacagtgggggatggggtgagaggaactcgtcctggccctggccctgcttagctgcagcctgggctgagggaggtgttctgagtcagatcagggaggggccctgtggcttcctctacagcaaagccagagcccagaatagcctgggagggggtgcaggggccctgctggaggagaggggggtggctgctcagggccctgcgggaggaaaagactgggagctactatgaactgagtgggtgactctcccatcaggcccagcctcctgtggggcctgcaaagccaccaagagagtgtccccagccaggcctggacaaaggcaccattacccttcaacccccatattcactgaatccaggggcaagaagggggacatcgacactcacctgggaacaagcaaaccagctcagatgccccataacgaggccaccagatcccaggcaagcccccattcctcaacacaaaggtccaaaatcaagtttccagccaactagaacatgcgaattttggggacatagaggaaataatcaccatccactcgcaatgcccactgctaatgacacagcacaatgctgaggatgttgctcctccctcccgacatgtcatcctcttctccagagtctctgtcacaccagggccaggttctggattccccacccaccccgcctgcaggacacgagtccttgatgttgaccccacaccctgggctccatccctgacctaaggaccagcttctacggccctgaaagagtcgtgtgtcatgacttgacactggtcctcttccctgtgctgaatgagacgtgaaggaaaaatgaacccaaatctgcccaggatcccctgcgccacacgtgagatgctccagttccctcggggattcagaagcatccctagctggcatcaacggaggccgggaagactaggtcttttcccaaaatgcttagttatgcaaacacctcaaaaggcacccgtacctcttgtaacaacccaagcgtgaggactccctctttctggggtgatctggggaaactgctctcctacatggtcatcttgaggattgcagatgggccacggaaatgtcaacacagtgacatcagcaggggcagtagggtcaggatcagggtcagtctttgtcacttggtcacttgggaccacatcaaacctgaccctgtttggccagtaatttcacaagggtggtctccccaggaaacacgtgggctgggcaaggtctgaggggagggggatgacctgcatcctgcattttccaggacattcccagtttgtgccactgactctggaagctgaggtggatgctagagcagtgtccagcccctggtgaccctagccccatccaggtccccagaccactggccaccaatcagctgcagtttcccaggtgcctatgtgtacccagcctcagctcgggacccaggcctggccgtgcctggcccattgtagcagtaatggtgggctctgcccagagacccaggcctgggctgcctccaggacccccacccacatctatcagagagactcgtgaagttattaatagtgccccttccactcccaggaacatcccagtttaaacaacaaactttggttgcccaagctcagagtaaccgtttgctaaatgactgaatgacgttcttcataatggctaataatgagggggaggaagccaagcccagccacctagcactatggtaagcagtgctggacattacaatgggggccaggggccaggagagcctcactaggggccacatccaggcagtcaccatgacattcctggtcccctgcctggagcccctagaaatgagctcactcaggcccagctcacaacacaaccaggggtggccctaataccatctcccactcagcaacagcacaccacgtccagagaccggcaagggacagctcctctgggcagccctagttcctggggagaccacaggcagcagggagaatgcctcctggctttgggacaggagccagggaggggctgggtgacttctgtggctggcaacacagagcccccgtgtcagctccaggaaagagtagcccacagccaggacgacccaccagggcacccgcagtgtgcctctttccatacaggccatccttcatggtgactctctcttcctatagcaacaccaacacccttgatctggccacgggtccctcctgcttctcacatcaggtctgatgtccactgagcatccaatgtgccagttgccgtgccaggcaccaaagcctggacccctcacaggtgtcactaggatgggccctccctgcccacccagttcccagcctgtgcagggacatgttgggactttctgactatggaaatgatagaggagaaaggggcctcatcttcacagtttcaggccaaaggggagcctcccactcagacccctagacacatcctctcctgacctgtctggggaggaggatgggaagtggtggtcagacttggcctgggctcccacaggggacagaaagtttgcaaaggtctgggcagcagagagcagctcccagaaggaaggggtgctggtccccaggggctgctgggcagagtagctgaagaaggtgagaccccagaccggccaggtaagtaagcccccttctcaggggctgcccagagcgaagtcacatgttcagctctcttctgaggacctgctgctcctggaaacccagcagggttaaggcaggcacagccaggttcagacagctcatgtttgcgggagagggaaatcaagtcaacagacaaggaacaatgtcatgtaggaggcgggatttgtgctggggagaaatagggcagaggatggggggtagggagcacctggctggggtctcacggggggcgacgtcccaggggctggaggcagccagcgactgaggagccctgactagcgccaggcccctgtggctggagttagtggctcgagctcagcctcagtttcccctctgtgcagctgggttgataataatggaaactgactctctgggtggggggagggacaatcagatggaaaatagatgttttgtttgtctctgccgttggttgttttcatccttgggctgttccagccccagacagcctcaggccagccccctgcccatgctgggctccccaccggccctggaaccctcaccccagtgcagctggcctggtgaaaccaagagtgcctgaggcccgaaatagctgggaaaccccaccaagcctcagccctggcagcaggtgcctccttctccccagggtgggaggcaggggggcgattcagtttccaaagcttccaccagcccagctggagaatggtcctgtgtccccgcaccaagacacccaagccccgtgcccaggcttgagttagacagggtctggagatcatggtcaatcaatgatcagaagtagcaccttctgctccagaagcttctattcatgcaggccctaccccctcctcacagctccccaggaaccgttctaaatgccaggttcagagctgtgcccaattggggggcacagccagacacttggagctcagaggggcctggggtgggcagggctggccagagctggacatgggaccctgctgatcacactccacctgccgcccccaggtcttggacccttcaagggagctgggccaagtaaggggatgggaagggaaacaagaacccttccaagagcttccctgggagcccagagcctgaggcagtaacgaagctcctggaagcacagctgccaagaggacttccggggtccctacccagtgggcaggacctcagactggtcagtcacttatttgtgtgtctgtccatccatatatctgaacatgcacacacacacacacgcacacacacacacacactcatccttccacaagccccgaggcctggcctgtgcagggctcttgacacatggtgtcccaggcaaggcaggactgccccagcccacccccaggtgagacctggagtgtgccttctcatgggaggagggggctgtggccttggggtgccccattccctgtccagtcttccccatgctgggtctagatgctgaggtcaaagagaggttgacaggtgtgaggaacaggccactgtggtgaggcttaatgccccctgtccgatgaccagatcctacccactgcccccgttacagacctccctgtctttctccatgtggaggaaacgttcccaggatattccagggctccaggttctgatgagagtatgggaggagaccaagtacccagcctcagggcctgggttcacccctgcagacggcaaatcccatccacctgtgggacttcaccagctcattcttagaggacaccagcctggagctcccttggcccaggaaagccaggagccaggcccgccacacgtagccattgcacatgtcacctgacacataagatgcgaactgtagggtgggcaggccagggatgagtgcccccacctctgccttcctccccacaggcccacccacgaggctgaacagggtggccctagacccagcaccatcttcaatcagctcatccactggcatcccccaccaccgtcccctcaacatgcacaggatgccagccacccaggccagttcctgaagtaaagcaagcaagggggggtacttgtccccgcccagcccagagctcagattgcagatgagacccccttgcttgaagaagacaaggggcaggagatactggggattccatgtggtcatcaaaggtagcctggtggcagcagcaacctcaaacaggcctaggagctggatcaaggactgaagggcagagagaggacgggtgtgttagggggtgagtgtgagcaaaggtataggagtgaccacagcatcccttcttcccacagggccacagtagtgcacaagggccctcatggaagcaccctgaaagctcacctcaaaggccccatactctgtcccccacgtcacctggcctgccaccctacttaatacccaggaagtccttggagtctgtgccacatggatgggctccaagatggaccaggcttccaggggggcagggaacaagggagaaaagaggtctgggccctgcataggacacaggtagtgaccacccggtggaggagagggaatgagcagaggatgctgggagccaggcccaaggcagggccctgcagggtgcacagttctctgggttggacggtggaccaaggccatgaacattcatgctggtccaggccagtggaccagagtgccccaagccccagagctctgcagaggggcaggggcagggcccagagagagcaaggccgagagtagaggccctaaacctcaggtctgaccagatctgcaactctacaggtagctgcatcctgtgttgagacgctattgagtggccttattgtcccgtaccatttataaaacacgtggacacatgttatccacctgagccactcagggattctgtgaggccacagccagaatcatggtcccatttcacaggtaggaaaactgaggcccagagcagttagatcccaaaaagccagagccagctctgtggtgtcctgacttccagcccagggcctcccatctgacaaatggagaaacagaccaggagagaaagggatctgcccgagctcacataggcgcccctgtgtggaggggcccatgtagaggggcccatgtggaggggacctgtatggagggtggcatgtggaggggcccacgtgtggaggggcccatgtgtggaggggcccgtgtggagggatcgtgtgtggaggggcccgtgtggagggatcatgtgtggaggggcccatgtggaggggcctgtgtggagaaatcatgtgtggaggggcccatgtggaggggcctgcgtggaggggcccgcgtggaggggcccgcgtggaggggcccgcgtggagggatcatgtgtgaaggggcccgcatggaggggcctgtcggtagggtgccaggtagaggggcccatgtggaggggatctgttggagggtgtctgtgtggagggggcctgtgtggaggggcccgtgaggagggcgctgtgtggtgggacccgtgtggaggagcctgcatggagaagacctgtatggagggtggctgtgtggaccactgccctctgccagagaccagattgttcacttcctccaccattccacagctccagccccatttcaggggtgcagaaaagaggcctgaaagcagcatggatgagagttagggctacaggccctgatggccattccttccctgtgccttgggagatgcaaggaaggagggtggctgcaaaggcctgtgggagcccagagcactgttcttcccaaaggggcatctgccctgggagcccagacctcagtgtcagacagagaaggggtccccccaccatgctcagccctcatcaacccttgaccttgagcaatctgcttctcttctgtagccctcagtttcctcatctgcccaagggggtgataagagtccctccccacaaggtaggtttgcggattgagatgatgcctaagctgtgcctggcctatggggaccctcacctaccctcagtcattgctcttgcctgggcctgcgggtgacactgtgtgaacctgggcaaatgcctttgccttcctgggcccagccttccctctggtcaaggaggaactgggtcagggaccccgagtgccagccattcaggaaaccagcagattcctgggtgaaggggttggccagggaggcctgagatgggagtagggtgggggccaggccaagggatggggttgggggatgcgctttcccagctctggtggccctgcctgcagctggccacccctggaaatccccaggctaaatttaaccccaagttggctgaaaccagaactcagagtgacaaaaggagaaaaataagaggaagagaaactgagctcatggccacccgggcatgggatgagtgacaaacaggcccaggtgtggcccaggaggagcatggggcagtttcagggctgctgctggatgtttgtgcagctcacaggtgggggcagtagagcctgcgccccaccccaccccctcctagtccagcccctgggcctgatgctgccccctggctgcctccccacaccctgagctccatcctgggtcccagggtccaccagaaggcatctcagaaccagccagcagtggccctgattgtcagcaggaccccagggaggggggtggccaggacagggctctgaagcccccaccccaggaccttccctgggcagaacgagttggtgagggagtgatgagcaaccacaggcctcctaacttcccaagctggcgattctgagaggcctcaaggctgagacacggttcagccttttaggccctcctgaacgtgtcccctgtctccacagcctgggaatgcactctcttttgacccagaaatcctgctcataagaatttatcatggagatgccagagggccagtgcatgtggatgttagccagggagctaagagcaaaacgtgacagaaaagagcccgagagcagatgccagcctcacatccacatccccagatggccttggagaagggtcatagacagatgttcacaacagggcaagaagaagtgaggaaagaagttcccatctttgtgataaccccatgatttcatgcagaaaaagatctggaaggcgccataccaacgcgctaacagggcctcttgggcagtgcaggatcagagacttgctttgtattcttatttaatttttcctgttttcagattttataatcggagaacaaaacattaaaccaatttaagatgtaagatcctataaaaatgctgtattcgatgatgcgaatggcatctgaaaagccttgaacatattatcccaaagaggccaccagataagacgtgacctgtgtgtgcatgaatccctgcatttttatccatacctagatgcacatccgtatccacatctattccccggggctaccggttgcgggggtaaactgtaggtaatattggttttcattttgtacatctaacttttttcattttttgacaatcattatacatttattattatgaaaaatagaaggttttgtcacttaaatcaacatgtttattccaattcacttaacattcagcaaatatttcttgtgtgtctgctacacccacaacagtcagggtgcagggtttgagattacactgatgagaagacagagtgttctctcttgaggagtagtacaatgggggattatatggaagaggtcactacgatcctaacatggattcgcatcctgtatgtcttaggtgctgcccaaagcccgaaattgtctcacagctccagccagctcagaggcaggaagcccagggaaagttgccgagtcataaaaatggaaagagagggcattccaggggggatgagtacctagcagccgacatttagcaaagaggattggaaaatgaacccccccttaaaatacagttaaacacagaggagggagcaactgcaaacaaaaagtttaagcgatttctgcaaagagcaataaaagccatagagcagcttgggacaaggtcaggtcaggatgagcagaagttgggaaggaaagaaggaagccaggatggacttggagagtttttaccagttcctcaggcaggaagaattgtatggtaggtcagagcatatttctaggaagacctcggttgacaaatttctctgccactgagagatgacaatttaccttggtaactaatctctctcctcatgttcccatctatttgatattgatttaatatgagtagctacctcccatgtgtataataggaaatgtatgggagaatgcatattaattcctgaatagaatatctggttccatgaatgatggaagttggttagaatttattattggaaactcaccctgcactacctatagttggtttattttaattatacttatattcattatatagtaactcatatatatttgtcatttcttttcttatattcaaaaagtctctacataaataaactctgcacctatggtcattgctgggtatctgttctatacacagcaaggagccagacgccctatcttacttgttcactttccagcttctccttagaaaaaaaaatacaagtttttaacccaattctatgagtctagtactgtgacccaaaacccaaagggcaggaactcaacagccacctctccatcctgcctgcctcccaacccacattccccttccagaaccctcactgatgagggaaaagatgatgtctccaagaggagcagcccgttcacacatcttcaagcttcatctccccagcagccatccaagtgcctgaccttcaaggctctcaataaacagtctgaatgaggaaagaaagggagggagggaaagaaggagggagggagaaaggggtaggtggatggatgtatagatgggtgagtgattgatgggtggattggtaggtgaatggatgagtggatagttgggtgggtgagtggatggctggatagatgaatgcgtggactggtgggtacatgtgtgggtgggtagttggatgggtgaatagttggataagtaggtaaattctaaccatgagaagcacagattggtatctggcaactctgtgtagagattagattccaattcctgctctgatcctgactcgggtgtgatcttgggccctttccttaatgtcttgaagccttttcccttcatctgccctgcccatctcacaaactgctgggaagaaccctggaaggacatatgtgcacgaagatgctttagaaaccctagcaagcttctcaggtgtgaccttagcattggagggaacttgaaggtcattgggctgactctcccgatggttggatcacagttcatggtaagagcctaagcttagagtccagacagacctgggtttgtgtcctggctccaccacttgtccgagtgtgactgtcctgcctgtgtactcctctgtgatgtggaggtgatgatggtggcagcttcccctcagggctatgtgaggattcagtgggatcatcgtggaaagccctgggcacatcacccagcaggggtgccacgacgaaacccaaggtctgccctccggggtcccaaaaaagaggcccagtcttgcctttccagagcagggtaccctagaggccatgggattgaaggagagctctaggatgtccagctcacgggttcacaaaaccctgaaaagtgtctgtataaatgctcattgcagggaaagatctgtggctttatacagaaagaggccatgacacataaagggttaaccacagtccatctaatccaggactctcacttaggaaactgagacctatgtcctgtccaagggcactctgtgggtcaggggacagcaaagcacagacattcaacccagcatggaggcccctccccacccaggagcaggagcctgccttggaatgccagacctgagataggattactgccacctgggaacagcatacactggtgagaggcaggggcagggagaacaccaccacaggggcagggagaacaccaggatggggaaagggaaccacagggcctactcttttaattaagcagtagaattgtaagaaaattgcaactttcttttaaaacctgtctttcaaggttgttaaaatggggttttaataacaaaactgtgggagaaagaggtggctgatgtcaaaaacatctcaacccactcccctgggggacctgcagttctctagttcgtgagtttctgctaacaaaaagcacactaaaagaggggccaaaacaaatggaaatcaagcttatcaaacacagatgacatggagttgaccaaagcatctagagctgagattccaggaagcagatctctctcctttctctgggaccatcctaggagaggttccagggccccctggcacagaggtgccaccagcgacctcaaacttcaggcgcaggtgggggcaacaggcgtagttgaggctacagggacacaggtgtcagcacagcatacgagagggccaccttgtttgttttctgacttcctcttaaaatacagtttatcgcccttgatctttagtttcaaatagtaactattcacagtaaacaatgtgacacagtaaacaacgtgtacagaaaaacaaacaggagaaaacaatttgccccttgtacttcacccagaagagccactgctaatattttgatgtatttccttctattttagttgcaaactgtaacaaccattaaataaataaatacgatgaatttgtaaagtttacagagtaataataggagtgatgattgcacaacatcgtgaatgtactaaatgccactcaattgtacactttaaaatggtgaattccacatgatgtgagtttcacatctattagcctcctgggctaggaatactgcctagacctcaggaaccacggaattcatcatctctttccttttccttaaagtttgacctcctgtgtgtgcccttcaacaaacggtttttcagcttgtcctgcttttgaacttcatacggattgaagaagaccatgtgtatttttcatggtttgcttctttctcaacactgtctctttgatattgatgttgatgaattactcatttcactgctgactagaagcccactgtgtggaggtcccatcactcagctgtccactctgctgccactgacacatgggcagttttgcccaggagcagggcatcagaaacacccaattggagtccagtgtgacagtttgtccagggcctgtcattgtacaacacatcatttcactttgtttttcaaacatagtgaattctttcctaattaaagaagaaaagagtataaagagaaagtttccagtgcagcctggagatctgtactggttgtatctggaattccagactcagccttgcatttcacatagcagatagatgatgatgatggagaaggagaagaagaaggaggaggaggaggaaagaaggaagaagaagaagaagaggaggaggaagaagaagacgaagggaagaagaagaaggatgaggaggaggaggaatagacagactgacaaagattctctactgttgtcacttaacaacatatccatgcaggtgtggataaacctgggtgcgcatcacactgggaacaagcagctccaacaacactgaggcagcctcttcccaagtcagctggacaattaggctgctttgctcaggtcgttcactgttctgagcaggacacagccaaagcccctcgcccccacctctgtgcaaggatccagtgactgacttggggttgaccctctctgcaaagatcaaaggtcatgcctgtctaaggccttggacgcatgtcccagactgacttccagaaaagagagcctgaactgccctgctgagtgcccaaagaggcccccctgcatccacgaaaggtacccatgagggtgtggaaggagaggcatccacaggaactgggctcccacctgccccacctgaccccagctctacactgagaataggggagatagaggggcccccagggcctcctccaaactccccagagcatccactgtgaggtgacctgaaccaggccccaagctccctcctcagggaggcctcagactcctccacctccgcagcctccaccgtggctgctctgtgtctctctctggcagcaccaaccacccccactgctactgacaccaccattggagaaggctcagggctatgagttcagcctctggctgctctggagatctagggaggcaggagggctgcaagtgggggctgggagagctattccaggtcaggggtctgtgggctggagtctgtgaggtgtgcacatgtggggctgagggatggctggagaggccctgttggtggccactgtctccaccttcagagcccaggaaggagatttggcccctcctgcatcagataatccctagctccttagttcccaagtcttcagtccccagcctggctctcctggggtggctgcccttgctgtgggaggctggggggatcttcagcccagcacctccagcagcagggcctggtgcccccagctctgcactggcccaggtctcagatcctgggctgtcagcccctcatgggtcccaggtgcccagcccagctgccccaggaggcaggggggtctgggggacaccaaaagagtcttagagaatggacctcaccactcagccacacagaaaaactgaggcccagaggggacaaaggacttgtcatgggtccagctgtgagcctggctgccagtcttaaggcccagtgctcccccacaggatgctgtcacacacacttggccctgatgaggtcccctcttagctgggatccagccccatgaccagcaccccgaggctgcaaagggtgctgggctccagcaccccaagactccacattgaccccaagactccacattgaccactctgagcagaggagcccttgggtctttggggaggttagagagctggcacccccaccccagtctacccggccccggggttcctctctggatagggggccccagtgcagttcacacaggccctgcacgtgttccttcctcagggcatgcgtggctgaagcttgctcaacactaaacatcccagcccagtttattgaatgtgagggatacgcagggtctgagcagagcagccatcccctcctgcctcccctccttccagcgctagagccagagtgactccactgtcctgtgcccacccccagaccaaggagcctcaggaccactcttggggcagggagctcgaggctataggaagattgccccagagcaggatggctgagtgttcaggagtccagccatgtggtaaccgtgcactgcagtgtcacctgaacagggatgtcaccacgtgaaggcatcccagctgcatccttggctgacatatcctaactgtgcctgtacaaggggctccacacacacacacatccacacacacacacacacacacagtcacacttacatacccattcatgctcacacatttatccacacacattcatactcattcacacacacacacgcattcacacactcacacccactcacatgcactggccagagccagagtcgatagcgccctctagtggccactgttgtcccttctctagaaggtctctgtcttatcagtcacaacccccaggagtcttcatccggaaatcccaggatgcacaagtctggcaagatcattatctcctttcacagagagggatgtgacctggccaaggtccctcatcaggaaagtggtacagccctcccctccacccaccaccaatggtccgggtactcagattccgaataactccagctcctgaggccctgtcagagcccagaggctgggccctctcccaagggaggggctggagcagaggatctgggggcccttgtacacccacctgtcacatacacagggtgcacggtcccccgggagggaagaagacaccttgggggagaggaatttccaggccagagagtcccagaaacggctctcctctgtgccaggtgggacggggtataggaggggagggcctgcctgggctttaggaaaacacagaaatgccaagaacattgacacacagcagtaacaaatgctagcctgctgtcaactatcacaggcttttactgagaggaaaatacaactgatcaggttagattcccctccgtttccctcccccttttccctgagagaaacccagtgctgctcactccacatgcagccattcaacagctctggatgtggctttatgcccaggggacccagtggtggcctcgggggccaagccctggaaccaagtgccattgggtgacataggcctggaacaaacaccacgtgatgctgtcatttgtgatgtgatgagttctttacgaaaaagacagggtcaaacgggagactgtgacaactgctggtttagctggatggtcaggaagggacacccctgagtcaatgaggggaccggccagttgtggaggtgcctggggaggagcgctcctggcggcagaaacagcaagtgcgaaggccttggggtgagactctgctgacgaattgcagaaacagcaaggaggccatgtggccagatccaagaagagaggaggggtgagggagggaaggggtagagggagctgggttgcaggcgggggtgggggttccttggggccttacagaccatgctgagcagtttgcatttgttctcagttttcaaatgcacctgaacaacatcatgtggaacctgtcacgctccttctaacttgctacatgtatatctctagtactaggagatgcaactagataaataagacagagctccatggttcaacatacaaatagacgctggtcccggcccatccccagtggatggacatctgggctgtctgggttattcattcacaaacacaggccagtgagcccctgcatgtccccgtgcatacatcatgcctcccaaggacacacactcaccctgtaactagagggacacacgtctatatttgggtttactatgaactgagttctccccagagcagccagactaatgcacagcccagcagggccaccatctcatgccccacaaccacaccctgccttggaactgtggacgattgggatgttcctatccccagagagcacagacatctggcaccaaatgagaaccaggtaaagcccaagggcgaggcccagcccgccgggcgtcactcgaaggtcaccagaccctgccaccctgatgcccattctgctcctgcctcgttgaccttggcctccctgagcctcagtttccccatggttttattcagaggttgcagtcctggtccctactcttttgagtctgcacagactggggcccttcccagcactgctagcatgggggcagagacccttggtggccgaggagggtgaagtgggccaccggagccgggatgggattgcaggacaagagggggccaccgggttgggtagtgcgacccccggaaagcacagggagctgtgcccctccacaggattcccgccctcagagcccctcccctctgtgccccagagcagaagctgagcctgggctgtgtccatggtagaggaaatgctccctccattgggaacagcgtggccggcttctgggcttggggaaggagagggagaattctgggcgggcgatagaggggcccaggttccctctggtcatgaccttgaagttgcccaggtgaccaggaaggaggagggtgctcctctctgtcaagaagatctgagcttctcttccctagaatcagctactcttctatccccctaaaaatgtacaggaattttgcacgttgaatgaatggatagtttactaaccagtttgggaagaattgacacctttcaatccatgaatatcctctgtctttcccattagtatactttaataattctcaagaaagttgtacaattttccccataaacagcttggacatctctgtagatgaacccctagtttactgatatacatttgttgtgagtttttgcagggagcgggtcgggggaggtgtttgtttcggttttgtttagagacagggtctggctctgtcacccaggctggagtgcagcggcacagttttggctcactgctgcctcaaattcctgagatcaagtgatcctcccacctcagcctcctgagtagctgggactacaggcatgcaccaccatgcctggctaatttttaatttgaaattgttttggtagagacagaatcttgctatgttttccaggctggtctcaaactcctgggctcaaacaatccacccgcctcagcctgccaaagtgctgggattacaggtgtgagccactgtgcccagtccaactgatatttttaatgtgattgtaaattgtatccctctttaatattattttccattcatctgctgatgtacaaaaatatattaaataataggcttatatatttgaaatcagatctggtaaatttgctacactttctcatagttctaaaagtgtatctgtgcagtctgtaggatttgctgcacatttaaacatgtcatctgtgaatggtgacaattttgttgccatcttctcaattcctacacctttcatttttttctttcaccttactctccctgctggtattcagtacaatgcggcatccttgtcttgtcacaaaggatgtttatatacagttcactattaaacacgatgcctgctgtaggttccttgcaggagtctctcaccagattaaggaagttattttacatttctcgtatggtaagtagtttctgaaaatcattcttcagattttattcaatgttttttctgcatcttttattgtgatttttttctcctttaatattgcaatttgtcattcttctaatgtcaaaccgattttgcatccttggaatgcatggaccagacttgtccattatgtactagccagcactatatgtggcactactgtgattaaggcatcgtttattcttcagaattgttttattctctggaggatcttgtgtaaggttggaatttcctaccagtgaatctctctgagccagttttggggttgtttttgtttgttttgagacagagtctcgctctttggcccaggctggagtgcagtagcgccatctcagctcactgcaacctccacctcctgggctcaagtgattctcctgcctcagcctctggagtagctgggattacaggctcgtgcaaccacactcagccaatttttgtatttttagtagagaagaggtttcattgtattggccaggctggtcacaaacccctgacctcaagtaatccacccacctcagcctcccaaagtgctggaattacaggcatgagccaccgcaccctgcctaacccagttttgtttgtgggaatatttgtcactatgtattcaatacccttagaagaactgagattttctacttcttcttgagtcaaatatatgtgtttgattagatttttctaagaatactctcatttcatctcaaagtactggcataatgttgttaaaattgactctattacccattttaggtattccacatctataaaacaaccccccgcccccagccctgtttacactcgatatgggtgatttgtgccttctttcttctgtttttattttgttttgttttgttttgatatagagtctcgctctgtcacgtaggctgaagtgcagtggtgcagtggtgcaatcttggctcactgcaacctctgcctccctggttcaagtgattctcctgcctcagcctcccgagtagctgggattacaggcgagtgccaccacacctggcttattttttgtatttttagtagagacagggtttcgccatgttggtcacgctggtcttgaactcctgacctcaagtgatccgcccacctcagcctcccaaagtgctggaattacagacatgagccgccgcacccacccagtcctttcttctgttcttgataaattcaccgaatcagtttcaatttctgtaatattgtaaaggaactaactgccactttcttgctgcatcatcccactgaatatatgatctacttctttaatacttgttcttccctttcttatttccttcaacttttcaagattattttactgcatttttctgagatctatgcatagctcattctttttcagcttattttctataaaatttctatacatattttaaggtaatcaatttccctctatgtactacattagctgtatctcacaaggttttcatgtaatgatttcattattgcttagttcaaaatgtgacctaatttccaatttgagaatctctctaaatcactgggaacatatttcctcatttccaagcatatgaggatgttctagttatatttttgtgactgatttctagtattttgcttacagaacatatgtggaatgttttggtcctttgaaatttgtttaggcttgttttacaggcccacgtatggtccatgtcttagtccatttgggctgttataacaaaatcccataaaatgggtggctcataaacaacagaaatttatttttcatagttctggaggctgagaagtctcagatcaaggcaccagcaggttcagtgtctggtgaggacctgtttcttagttcacagagggtgccttcttgctgtgtccttataagatggaagggaccaggcagctctctgaggcttcttttataagggcactaatcccattcataaggcccctggcctcatgacctagttgcctcccaatggccccacttccctaacaccatcacattaggtttcaacatatgaattctgggaacacaagaattcagaccacagtagtcaatttctgcccgtggtccttttctttttttttcttttcttgtttttttgagacggagtctcactctgttgcccaggctagaatgcagtggcactatctcagctcactgcaagctccgcctcccaggttcaagcgattctcctgcctcagcctcctgagtagctaagattacaggcatgtgccaccatgcctggctgattttttttgtatttttagtagagatagggtttctccatgttggtcaggctggtctcgaactcccaacctcaggtgatccatctgcctcggcctccaaaagtgctgagattgcaggcatgagtcaccgcgcctggccagtccttttctgcttgaagagaatatacatcccataactctggatgcgatgttccatagataagtccattagctcaagtcgattaagtcttctaatcttctgatatcttcttcaagttatttcaggtaatgcttcttggccataaagttttaaaatttgatgtcaacataactataccaatcttccttggagtggaaatttcatggtatctttttagccattctctatcttagcccaccattctggaaataggagctcttctctaaaaggctttcttcatgcatcatttctgaaacgtgcccttatattatgcaagagttgtgtctgttctccttgcatttccaacagtttagtcacatctctgtgatgggatttcttggccttttctgcacagtatctgaggcaggggcagcacagccgggcgcccctcccccatgcttccagagcacacatgtaacatctgttatagaccatgtcagagagccatcctgcaggtcccagaaacatgactcaaatggcctcagacaaagagggagttattgccttgcataactggaaatccagacgtggggcactcagagccgcctgaacccggatgcccagccctgtttctctgggattctctccaccctgtcttcatctccgcattggctggcttccctcatggaggcaaacagctccggcagagcagggcctcaccccatacatgaagccatccaaaggaggaggaggtcgagaccagaatcccaggagatgcagagaggcctattcctgatgaccaagaccagggctgaggcctactggccttcctcagggcaaccaggggcagggtggtgcaggcctcgggcctaggacaggcagatgatcacccccacccccatcctgccaggccagggacaatggagattcctgagcaagcacagctcaagaaccaaccaaaaattccagcaagaagaacacacttggcagaactctggggagatgcagcaggaaccaggtccaaggcctctggtgtaagggtctccccacctgagcatggggtgaggagtccatgctggggacagcacagcatcaggaagttggggctgtgggcagacctgtcctggctctgtctgtttcttggttcacagagggtgccttcttgctgtgtccttataagatggaagggaccaggcagctctctgaggcttcttttataagggcactaatcccattcataaggcccctggcctgacagccaggtccctgctctgtctcctgcctggagtcctgaggacttcccttgtgtccactctcagcctgattttcccacctccttgccaagcatgggcatcccctctgcccctgccctggccctgctgcagctgttacagagggaggagaccatgggatttgggtcataccttggtccaatttcaggtccaatcatttccaccagggatatttggaaagatatgtaacacctttcggggtaatggctacttcaagttcatatgtaccatgttttgttgatttgaggattaaatgaacatgtaggtgaatggcctgtcatgttactgggtacaggatatgggctcagcactggtcaccccttcccttccttttggttcagagacagagcctgtcccctagtccttaagcactgggggctgacctcacatacactgcagatcacccagagatacacaggccagcatccacattaggctgagcccagagggatggagtcacaatcacacaggggaaaaggctgaagaaaagggagggttgggccagatgtgggtggggtggctcacacctgtaatcccaccactttgggaggatgaggagcgagaattacttgaggccaggagtttcagaccagccctggcaacaaagtgagacccacttctctattaaaacaatttttttttaaaaaaatcagccatgcacttgtagtctcagctgcttgggaggctaaggcaggaggatcagctgaacccaagagttcaaagctgcagtgagctatgatcacacccaatgcactccagcctgggcaagagaaaagagagaaaaaagaaaacaagaaagagagcgagagaggaaaggagggagggagggaggaaggtaaagatagagagaaagatagagagagagaaagagagagagagagccagatagattgagagagagagagagttggctttggggcctgaagaaggcaggatacccattacaggacccaatcagagttcctccaccaaagtcacatgattgagcctttttaacaaccagaactcacgggacaatcactatggccacagatgtgcagcctgtgaaagatgagtggctgcaagtcacaccaccagccatgaacacaaagcctggtgggcctttatggctggaggcaagatgtgcctcagtggagtgggccacgtggacgcatctcccaagtcacacacaaggtggccagtgctgaatgggaacagacaatgagaagtctctgcagcaagcctaagctccagtgcaggtgtctcttccacttggaccttataatctggcacattcagtgaaatccagtatctgtggagagactgggggtgccacacggagcatctggcaagcagcagaagaatcaccgtgcagacctctaggacgtgggagcaagtctgcaccctcttctgcaggtgactctgcttcctctgagaaacagcttccgctcaccactgggccttggtggaaactaaatgcctacccataggacaccaggcaagcacccagcctgagcttcccaccatgacctgggtgccctgacccatgcagccaaagcagcaatcaatcaccagaggaaactgcctataagagcccaggctcagtcaggcccagaagggacaagcaagtgtcatgagcaggtggctcagatccctcaacacctgctcctcagactccatccagcctaaggcttcctgggctgttcctcaggaccaactgactgaggaagaaaacacatgagcttgattacagctgggtatgcacaatgtgctgctgatccctgaaggtgaccagctgcagcactactgcaccactcgagctgccctgaatgacacagggaaggttggcttgcccaggggctggagactgatgggggtatttcgctggcaacttggtctggattgagagatggcaaataacacagatgatggtgactcatgaggagttgctagaggtttggctggttggtcagggactcagaaggatcaatgatcagatttgaaaattaatgacaaggaagggtgggaagaggcatagggatgggcccctcattatggacactatgagcagacaccagcattgcatatgaatgctgaccacatggcacatgaacactctctgcagaagaggcctcgataatcaggtggacaaaatgacacattccatagatgtcagtcaacctcattccccagccatcccagtatttgcccagtgggcttgtggacagaggggacagtcatggtggcacacgtagaggctgtgcattacctcatgagcatggctgctatggcttggatgtggtttttcccctccaaaatgcatgttgaaatttagtccccgttgtggcaacgttgggaggtgggacttcatgggagatatttgggtcatgggagcagatccattgtgaatagattaatgcctttcctgggagtgagttattggtctcacaggaatggcttacttccctcgagagcaagttgttaaataagagagtctggcttccttagtttctctctcttgcttcctctccctccatatggtcactttgcctgctccccttccatcttctgccatcagctgaaaaagcctgaggtcctgaccagatgtagctgcccaaccttggaccttccagccaccagaatcataagccaaataaatggcttttatttataaattacccagccttggttattttgttataataacactaaatggcctaaggcagaaaatctccctcttcctaaggttgacctggctaccactgacaaaagtggccaatctgtcaagggcagagaccaacaccaagacccttatatatcattaatgtcgggggccagccagcctcctgctggcagattaattccattgatctcttctaccatggaaggggcacaaattctggatatggatttgccatccctgcttgtaatgcttcttccagcatcaccaaccctggactcctgagatccctggccaccatcgtgtcattccccacagtgctgtgtctaatcagggaactgattccactgcaaaggaaatgcagcatggaattaactgctcttactacatacccatgcccaggcacggccagactaaaagtggagtgacttactgaagactcagttgtggcacgacttgagagatggcaccctgaaatatggaggtcctatcttaagggtacagtctatgctttgactcaagaccatcaagtgacagtgttttaacggtgcctgggatatttttaaatcaggtatggtaagacatgcagacaaggaaatgactggtataaagaaaagatttgttatactcacagatctcaagaaaagggaacaaaccacgccacacagggccacacagagaagcagcagcattggtcaggaggcagaggggagggggagaaaacaggcaagaacctctgttgtggtttccactgggaaggaacaggggaggcaaggtaagcaggtttaggattggctagtttgaataattttggtgggctctggagcacaggaacaactagatacctacttgtctggtacctggtcttggagtgatgagggcaggtggatagcagcccagcctgtgagagcccaggaaagaaagtgcttcagggccgggcgcggtggctcacacctgtaatcccagcactttgggaggccaaggcgggtggatcacaaggtcaggagatcgagaccaccctgactaacatggtgaaaccctgtctctactaaaaatacaaaaaattagctgggcatgatggcgggtgcctgtagtcccagctactcaggaggctgagacaggagaatggcatgaacccaggaggcagagcttgcagtgagccaaggtcgtgccactgcactctagcctgggtgacagagcgagactctgtctcaaaaaaaaaaaaaaaaaagtgcttcagggtatgggttctggattggttggtttgcacaagaaaggctcactgtttgccatctctaagaattagctaaccctgcaaggggcagtgccccagggtcagcaaggccccagatgtcagatcatcagaaaacagaaaataaaagagcatggttaatacacacagtctccccaggagccacagtacatgggtctgagaatagatggatagaagtgagagtggcttcttccacaaataatcctcctaatacgctcaaataaggtttgcttgctatccgaacatttgagctctgctgctttgaagatcttagttcccaagaatataatgcctctcccaggggacaccacaatggctccattgagttggaactaacagtcagaaacgggggcaactttactggaaggactgattggtgctaacgaggggaaattgggctgctgtgtcacatagtgggggcaagaaggacttcacctagaaccccgagtactcatcatcttagtacttctgcctactcagacccttcaagaatgaaggtttagatcttcccaccagataaagatctgtaaccagctgaggttctagctgtggaacagggaaatatcaaatgggtagtggacaaaagaagtcacagatagcatctgtggctcataactagggtttaccaggtttagtaaacgaaaatacagacgtccagtgagatagtaacttcagataaacaacaaatagtattactaaaagtactatttgtatgtcctatgcaatattggggacatatttatgcttaaaaatgcattcactgtttggacatcctatattttatctggtaattctattcatgaccaagtaaaaaagcacatttttttactttgcttgtcatgtgtggtatatgtatgtatttggagttattaaccatttatcttttcttattatgagttgttagcagagtattcagtgaaattgtgactaaagatgaagataaactaatatagttagctgtggatgcagtggctcttgggagcctgcatctcgcttggaggagagggtgagaatttcgttcatataaaggataactgcttcttattagacggaaacagagttgttttttggttcctcagaagttcaaatgtgtgtagaaagataaatacggaagctaagtaggaaagcgggtgaactctgccagttatcagcggaatgttctagctgcaaattgcccctttctcgcaagctctaggaagccggctggtaaacagcgccctcctttgcccgccgctgcaatgttaggctttgccaaaagagagcacctgggggaagctgcgaggccaccgcggcgagaaggtgctttcctgtttccctgctgtcctttctttttattccgcacagaagccatatatatatatatatatatatatatatatatatatatatagtgtacatttatatattaggcttttaggccatatatatatgtgtgtgtatatatgtatatgtatcgctacatatatatactatatatacatatatactatatatactttctacacactataaatagatagtgtggcacatctatatattacacatttaggctctttatagatatgtaccaccacatatatagtgatacatttatatatatatatatatatcgactaaacagcatttaggctgtttccagctttttgctaccacaagtaatgcaggaattagcaaataagatcttccagataatacccagaggcaggactgctggatcaggaggaatgcacattttcagttttactgccctctaatgtggctgatgaatttacaccctactagcaatgtgtgggttctgtttctctaactctttaccacacttgatatcagcagacttttccatttgcaccacgcagctcttactacaaccctcctttacagctctcaactaacccaggcaggcagcatgcgtgggccagacaccagggcagtcctccactgcagttagatattgagtctccctcctgtgactgggcagacgaaaaggacttgttcactcttgttttctctaacacagcgcttcacacacagagttcttttccagttatgtgactaattcaataaactgcctgagccttagtttcccaatccttgtcattaaatggtcactgtgcccactggtgtgctgggaaaagtttaacaactaacagagtagcaagggcggtgggagtcctaatttgtagcatttgcccatttccatggtataaataatcccaccatggctgatttcaagctaccaaggtgccccactgaacacagagttgggaagagatgctcttaaatcatcagctctcctgagctggtgcaagccagttgcgggacaccactgggctttttgcaaccctgtttcttaattctcagttctgggcaggctgtagtcgcctccccgtgcttctgtacaagtagacagcgacatctggtggcaaagtcaagcaaatcccagaccatgtagagaagggcctagagtatgggaaaacaagaaacacccctcttctcccaccagcacccccacgaaaggttcctgtcctcttcctcaaccaaccctgggacccatcaactccagcaaaaactcaatgcctggggagttcctacatgggcagcctgcaggtctcccttcctgtggcagctggggtagagtggcatggctcctggtgttggaataagcagtgacctcgtacagcagtcattcccactgcctgcctgcagaccccttgccttacccctggttgagaattatcagaagcgtccctcaacccaaagcagtcaccacagcactcctagaacaagagttactcagctagtgtgaccagagcactggttcaccatgagcgcttcctcctggaatttggacaaccatctcagggcctttctttggtcaatttccttctgattctgtgtgtaagacttgtgtgcagaatctcagtggcctaaatatctcagcctatggtaggataggcggggaagtgagggtggcccctgcaatagcaaagccattacacttagcctttggccactaaaaccccctatggcagcaacaggctgctgaccaccgaacgttcacctccttttccatagtgtattccttttcttgagacagggtctccctgtatcacccaggctagagagcagcagtgcatccatagctccctgcaatctcagactcctgggctcaagtgatccggatcctaagcttgggtctccctatagtgagtcgtattaatttcgataagccacctcgaggcgaattagcccgcctaatgagcgggctttttttggccgtttcggccgaattctctagagatcttccatacctaccagttctccgcctgcagggggggggggggggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgaggctttttggcctctgtcgtttcctttctctgtttttgtccgtggaatgaacaatggaagtcctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttaccgggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgaggctttttggcctctgtcgtttcctttctctgtttttgtccgtggaatgaacaatggaagtcccccccccccccccccccccccccccctgcagcaatggcaacaacgttgcccggatcgatcggtcgcgcgaattgatccgaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgtatcgatacgtaagtaatcttgagatcgggcgttcgatcgccccgggagatttttttgttttttatgtcttccattcacttcccagacttgcaagttgaaatatttctttcaagggaattgatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatccccccccccctttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatccgcgtatcgatacgtaagtaatcttgagatcgggcgttcgatcgccccgggagatttttttgttttttatgtcttccattcacttcccagacttgcaagttgaaatatttctttcaagggaattgatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatccccccccccctttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatccgcgtatcgatacgtaagtaatcttgagatcgggcgttcgatcgccccgggagatttttttgttttttatgtcttccattcacttcccagacttgcaagttgaaatatttctttcaagggaattgatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatccccccccccctttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagatcttatgtatgaaattcttaaaaaaggacacctgtaagcgttgatttctatgtatgaagtccacatttgatgtaatcataacaaagcctaaaaaataggtatatcattttataattatttgctgtacaagtatatcaataaacttatatattacttgttttctagataagcttcgtaaccgacagtttctaacttttgtgctttgacaagaacttcttcttcttgctttaataaaaactgttccattttcgttgtataacttgaatcataagcgccaagcagtctgacagccaacagcgcagcgttcgtactattattaatagcgacggtagctactggaacacctctaggcatttgcacaattgaatgtaaagaatctactccatctagacaagaaccttttacgggcacaccgatgacaggaagtggtgtcattgcagccaccatacctggcaagtgagcagccccaccagctccagcgataattgttttaattccacgcttgcttgcggaaatagcatatgctgacatcctatgtggagttctatgagcagagactattgtcacttcaaatggaacgccaaaatcttttaaaaccgcacatgcggcagacattaccggcaagtcagagtctgatcccatgatgattccaaccaatggtttgaccattgcttccaagtccaacttttgagcgacagagattttgattggaatatcagttctacctgtaatgtagttcagcctttgttcacattccgccatactggaggcaataatatttatgtgacctacttttctgttaggtctagactcttttccatataagtacactgaggaacctggagtcgccaatgctctttcgcaagtttctagctctttatcttttgtatgtttgtctccaagaacatttagcataatggcgttcgttgtaatggtggagaaagatgtgaaattctttggcattggcaaatccaatattgatctcaaatgagcttcaaattgagaagtgacgcaagcatcaatggtataatgtccagagttgtgaggccttggggactgtgtgccgaacatgctccttcactattttaacatgtggaattaattctaaatcctctttatatgatctgccgatagatagttctaagtcattgaggttcatcaacaattggattttctgtttactcgacttcaggtaaatgaaatgagatgatacttgcttatctcatagttaactctaagaggtgatacttatttactgtaaaactgtgacgataaaaccggaaggaagaataagaaaactcgaactgatctataatgcctattttctgtaaagagtttaagctatgaaagcctcggcattttggccgctcctaggtagtgctttttttccaaggacaaaacagtttctttttcttgagcaggttttatgtttcggtaatcataaacaataaataaattatttcatttatgtttaaaaataaaaaataaaaaagtattttaaatttttaaaaaagttgattataagcatgtgaccttttgcaagcaattaaattttgcaatttgtgattttaggcaaaagttacaatttctggctcgtgtaatatatgtatgctaaagtgaacttttacaaagtcgatatggacttagtcaaaagaaattttcttaaaaatatatagcactagccaatttagcacttctttatgagatatattatagactttattaagccagatttgtgtattatatgtatttacccggcgaatcatggacatacattctgaaataggtaatattctctatggtgagacagcatagataacctaggatacaagttaaaagctagtactgttttgcagtaatttttttcttttttataagaatgttaccacctaaataagttataaagtcaatagttaagtttgatatttgattgtaaaataccgtaatatatttgcatgatcaaaaggctcaatgttgactagccagcatgtcaaccactatattgatcaccgatatatggacttccacaccaactagtaatatgacaataaattcaagatattcttcatgagaatggcccagattctcatgtttgacagcttatcatcgcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcaattccctttagtataaatttcactctgaaccatcttggaaggaccggtaattatttcaaatctctttttcaattgtatatgtgttatgttatgtagtatactctttcttcaacaattaaatactctcggtagccaagttggtttaaggcgcaagactttaatttatcactacctacgcggccgcggactatggcgcgccatcgttgcgatcgctatacacgcgtatcgataagcttgaagttcctattctctagaaagtataggaacttcagcttgatatcgaattcctgcagcccctttacctctatatcgtgttcgtgcgtatttcttcctctataatatgaaaagaaaggcagtagtcttgattttctattcttccaaatattacaagaatacccagaaccacaagaagcagaagaaactaactgctttatatacttaatttcccgccacaagctcatcgcccagaagtttttttcagtttttcacctgacaatctggcagctcgctgaaaaattttcacctggggttgcctgctacgtaaagtgatcacgtttatgaatggcacattatatagtggcccagacggtctgatggtagttcatgtagttaagaataaatactctgtttgtgtgatttctatgtgtacgttatatatataaatattgttgatggtggtagctgtgggttgtgttcgggggatctttattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttacccatagatccactagatgttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctt

SEQ ID NO: 8 - DNA, 172334 bp, Artificial Sequence
  Description of Artificial Sequence: Synthetic polynucleotide
  BAC6
atcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataaagatcccccgaacacaacccacagctaccaccatcaacaatatttatatatataacgtacacatagaaatcacacaaacagagtatttattcttaactacatgaactaccatcagaccgtctgggccactatataatgtgccattcataaacgtgatcactttacgtagcaggcaaccccaggtgaaaatttttcagcgagctgccagattgtcaggtgaaaaactgaaaaaaacttctgggcgatgagcttgtggcgggaaattaagtatataaagcagttagtttcttctgcttcttgtggttctgggtattcttgtaatatttggaagaatagaaaatcaagactactgcctttcttttcatattatagaggaagaaatacgcacgaacacgatatagaggtaaagggggagtctggcaacccttcttgccactcatgtcccagctctcaccatgtgacatagcctgttccccctttgccttccatcatgattgtaaagtagatcctggtgccatgcttctcacacagccttcagaactgtaagccaaatgtgcctcttttctttgtaaatcacttggcctcaggtattaatttataggaatgcaaaagagactaacacaccgtccaaagcattacacagattcaactctatttttatcaaatgaccaatataattgattacatatttagaaaaaaaatactaaaattcctatagaatcaaaaaagagtctgaatagcaaaagcaatcctaagcaaaaagaccgaagctggaagcaccacattctctgacctcaaattatactacatgaatataataagaaagacagcatgctactagtagaaaaaaatagcccagaaagaaagccaaatatctaaaaccaactgttgtttgacaaaactgacaaaaatatacactggagaaacaaccctctattcaataagtggtgccgggaaaattaggtggcttatgtggaagaatagaactagacttccatatcaccgtagacacaaattaactgaatatggattcagtgtttaaatttataaactaaaactataaaaatacttgaataaaatctaaaaagagtcctctggacattggtctaagcaaacaatatatgactaagacttcaaaagcaaatgcaataaaaacagaagtagacaaacaggatttagttgaactaaaggtcttctgcacagcaaaagaaataaccaacatggtgaccagacaatctgcaaatggaaaaaatatctggaatctattcatcttgcaaagggctaatatatagaatctacaagtaactcaaataagtcaactaaaaattacaaataacttcattaaagaatagacataaacagacatttatcaaaagaatacacagaagtggccaacacaaataagaaaatatactcagcatcaccaatcatctgataaatgtaaattagaaacaacatgatacggcatcttccaccagtcagaatggctgttattacaaataaaaacagcaggtgtttgcagacaaacataggaaaaataatgatttatatatgcttggtgagaatgtaaattagtacaacctccatgaaaaacaacatagaaatttctcaaagaactaaaattagaattaccatttcttccagtaagctgtcccagtaggcatgttcctcccaaacttttatatcagagaatgttgcctgcactcatatgtttatttcaacaccattttcaatagaaaagtcaaataatctaagtgtcaatcagtggatgattagataaaatatgatatatgtaaatcatggaatactatgcagccagtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgcagatcagcagcctaaaggctgaggacacggccgtgtatgactgtatgagagacacagtgtggaaacccacatcccgagggagtcagaaaccccgagggaggaggcagctgtgctgagctgaggcagtggtgcagcagtttctttaacttccatatgatctcattttgcatcatcttctacttttatattagctaagaacttggggtagacaggtgctcctaagagatccttaacttgcccattttgatgggttttccagaagacgtgagaagccactttgttagcaaagcatcccaaatccatgccctgttctagatacatgtgagcccatttcctggtctttgcttaactgacaagctctcatcagtgcacctgggctaatttcacatcaggtagaggaacgcgttataaaggaaagctaatgttgtaatagcaattcctgcttaaaaaccttcagcttcattgtttttgtgtaatccatcagcaaattatgttagttcaaggttctcaatgggagtttctaataaatagaaaggatgtataaagcttcccctaattaaaatgaaacaattgtgaacacaacctcggtattcagccatgtctccacccttcacacccttcgccacaaaggaattttcacctctcctggaagctgggttcattttcaaattagttatttttttcaatgtaatatctcaagattatcgtatatgactattttagcagaaagtgaattatgggaacttgaactaaacaactgaaaacaaattcacaactaattaaacaagatgccagaatgtgattggctccaggctttgtaattcagcagttcatgtacccagactggaaatttacatgtcttcttgttaccttcacagcacagtcaactcccattatgtaagaaatggtgactgcattcccaagggttatgcatagatatgaaaatagactgggtaaggtgaggagttgattgtttaaattcccctctgaagaagcagcatcaactcaacaaaccacctctcttcactctgtgactagagctatgtcacaggccacatggacctaaatccttgatggatataacatgactacataaattgggctgatcatttttatgctataaaattaatagatgacactgcactccagcctgcacaaccaagcaagtcttcatctgtaaaatctaaaaaagaaaaattaataggtactgacttcgaaatttttgataataatattttcaccacccaaatttaatcacacccacatgttacctgcatcttcactgaaaagttcccagtcacgatgagttccttcaatgctccatgtgttcaaatctggacatcaagagagtccagagaataaaacacaatgacggcagtgaaactgatatatattcagcacctcttaactcaggaggactccatacaccctggcacacagctgcttttctaaatggctcacaatgactccagctcactcacagagctcagacagaaacctcccttcagggtgggagctgggtggcagggggcactcagtacccgcagaggtgaaaatgagctttcagatggaacttccctgtcacctcaacatggaatttattgtttcatttcattacctctctttccataatggttcatttcttttggcctgttcattactgatatttttcagagcaatctcacttgaatctttactcttttgcattttgtctccttgacaatgttgggaagttttacctccagcatcataacatgatctagtgatctgacacattgtgcaaacaatacctacaaattcagaacctctttgtttttctttccacaaaatataattctttctgttctgtgtatgagcatgtcttagcaaccctgtacacacccacatagatgtctacaagcctatgaattgttctctgtaaataaaaatttatctcaaattccttcaatgttcataattctgagagtgaggaaggtccttctcaatctgttcaaacaaaatgcccagagaccatccagtaggtaaggagttcacctggctctggtgtggggtctgtctctttccctctgttgtcccacaggtcagcccagttgttcacgtcctaacaagaaagcccaggtttgtcctgattttaaaacacatcaaacttctgatgactctcctgttacccacatccatggagatagattatttattatataattcagcaaactaatgtcaaatgcccaagttgcaataccgcacatcctagggtatgttcatgcaattcaatggaggagaaaatctttcagagacagatggatctgaaatgataaatatgtgggtaaggactctgggcttgagtatcattgtccagccatgtttcacaagtgtgtcctgtcagggaaggatcagagttccttgtgctctcagagggaaggggtcacagagttcctctctggttcccaggaaaggtaatcgcactaatcttcatgatcttcatgagactatcctccagtgctgacctgttacggagtttttgtctgaagttctcactgcaatccccaatctacatattttcaatcagaagtgtttagaggccaggacacatcttcaaggtcacacattgagaagtatggagatatgtcccactaccttctcctacgatctcagacagaatcccaaatttcaaaaggacacagaaggacagctctcaggtgcttttaaaaaatgacccacttccagggacagtgagcttccctgtaaccatggtggatgttctgaactacaataaacattggatggatccagtattgtttgaagtcactgtcattattacattcagctgttgtttcaatgtgtctgaaagggtaaatgactatttagatggcctgggtgtgtggttggttttatatgaatctttaagggttgaacagtactgaccctattccaaaatctgtccttgatccaggatcacactcatctctcagaccagctccttcagcacatctctttacctggaagaagaggactctgggcttggagaggggaggccccaagaagagaactgagttctcaaagggcacagccagcattctcctcccagggtgagctcaaaagactggcgcctctctcatcccttttcactgctccgtacaaacgcaccacccccatgcaaatcctcacttaggcgcccacaggaagccaccacacatttccttaaattcaggtccaactcataagggaaatgctttctgagagtcatggatctcatgtgcaagaaaatgaagcacctgtggttcttcctcctgctggtggcggctcccagatgtgagtgtttctaggatgcagacatggagatatgggaggctgcctctgatcccagggctcactgtgggtttttctgttcacaggggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacacacagtgaggggaggtgagtgtgagcccagacaaaaacctccctgcagggaggctgagggggcgggcgcaggtgcagctcagggccagcagggggcgtgcggagctcacggaatacaaggccgggtcaggagcaggtgcagggtgagcggggcttgctcatcttctcagtcgtctccctcctcgccagcacctcagctttccgtagaggtcctctttctttattgtgtgtggttctacttcctcacatccttgtgccaggaaagaaaggagtaaggcaaattttcctgttacaattgaagtttcaccaattactaagaactttcctgcaagtacctgcacagcccattataccttatttatatatgtatatattctaatgcttctcaccatctcttgatttgtgtcatcaatttaattgtgccctttttgaaattcatatgctgaaactttaaatccaatggatctatatcggaattttaatggtataattaatgttaaatgtggtcataaatgagaccctaatgcaatagagctgttgtctttataagaagaggaagagacaccagatacctctcacttctcacatgcactcagagaagaggccacgtggagacatagtgcactagaaggtgggcctctgcaagccaggaagaagccgcaccaagaaccaaccctgccagcaccttgatcttctacattcagactgcagaattgtaagaaaatcaatatttgttgtttaagccacccactccttttgtcttcttacgaagacccagacaggctaataccacacaactctgttagctccgtctcctggagggagaagcagccccctgaagctgggcacatcgctcagattttcacatgaattaggcaaaaacagtagctctcatataaaaactgtcacgtccctgttgggacaaggtcttttaaacaagccctggggctttgtcacaaatgttgcattttatcctttattaggacttaactaattgacaatgagtaccagctggatggaaactgaccactgaccatcttctgctgtctccttattatatcacagaaaaccacagcaacattactctatgtcttcaactttctaaatttgtactgaatctattgctaaatgaggagctacatggggtctgagttttgttaccttcttcccagtcttccccaattaccaagcatagaagatactttcagtgaaatttagctgtcaatgcccccgacaccacatcatgttttaaggtccaaggactttctttggggggctattgaaaaacacttttgaatggaaaatcctaaagcatacaacagctgaaagaatggcccctgtgcacatgaaggctgaagggatggatgatagggtacgttcctccaaggtgttcctgggcatgtgatggttggatacctcatgcatacgaaaacaaggactgaactgagatagaaacaagggccatatcctataggaaaacaagaaaaaaacgggcatccctgaagagagttaattagacttggtgggtttaagatgaatttttttccaaagttttttaatgttctaagctaaatatgaatattttcaataaactgcaaattaaaaggagaatgaatttagaagtttagacagaaaaaagccatgagggtgtagaaagcaaatccacacaaaactgtcacatggcagaggccagaatggagctgatgcagctacatcattattctgcagacctagttgagaccctttggtgtttaaggcaggtccagcagtgaagaactcctttattttttgtctggcaaagttctaatctaatcttcatttctgaaaaggatttacatggtaaagattcgtcttggcaggttttatttatttttagtcccccccaacccacgtcaatttgagtaaagtcatgtgttacgtaacaatgctgcagtcaacagtagaccacatatatgtttgtggccacataatgttgtaataccatattttcactaaactttttccatgttttgatgtgtttagatagagagatacttaccatggtgtttccatttcctgcagtgttcagtgcagtaacacgctgtacaggttagttgtctgggaaccctgcgctaatccacataccctgtgtgtagtagggtattccttgtaggtttgtgaaaattcacccttgatgcttgcacaatgatgaaattgcccagggacacatttctcaaaaagaacctctgtcaataaaccacacaccattgaatacaatccctgtgccttctgaactgaaaaccttctgctgagaaatctgttccttttctttctgttttctaaagcctcttttatttccagcaatgtggttttaaactgtgtcacattttttgtcattgggtttatcttacgtaaaatttatagagcttcttcattgtggatgaatatttgcttcccttctccaaatttggaaatattttttgctattattttgaataatttatctcttctctctctctctctctctctctctctctctctctccctctctctctctctctctctctctctctctctctctctctctctctctccccctctctcccttcactaccccttttgtcttgtctttgtataactcctcaaatgcgtagttgagtgtttagtgtctttcctggcccataagtcttgaactcttttttatttctttcacttaaatttttcttctctgtctctactatttcaaatgatctttctttgagtttactgtttcttctattacttgatctagtttggtctaaaatcttgttaaaatttttggctgtattcttcaggatcaatatttttgtttagtcatcttttaaatgttttatctttattaaaattctcacattgttcttgcatgctgccactagctcattgaacatgtttctaacatttactttaaagtttctgtcaggtaatccatgttcttccttttcattgatgtcagtttatggaccttttggttgttcttctgtttggaccatgttcccctgcttcttcattttccttgactgtctttgttgttatctgttctttataacaaaagccatcatatacttcttcaaagactaggctcatagagatcaccctcaccaatcagcccagacagtaattgtgggtctctcaaaacttgataggattcaaacttctgtctgttcttagtggcccctaggttttagaggatgatagattgtgccaggactcacaggtaagggaggtagaaactatgtactcatgaccatggggtctgtgctgatctgagcttctcttgtcatcactctcaatattcaacttccccgtggatcaggctcagctgtggctgctccacgtggggctgttctcagtctgttgcctctgtgtgtgcagaagtcctctgtgaagttaactagtggagtcagacaggaaaatactacagaccaagaattctcagactgttctgcaaagcccctggattcactgaaaaaagaacaagtttggtccagcaggattcatggcaagtgttggtgagggagataacagtaattcaagtggaagttctcaatgggactcgccttcagtacaaagaagattaacagtcctcagagacactgttcagaagattctcttttaagataataaaactgagagcccaagacaagtctgtgtattactgtgagggacacagtgtggggacatctatgtgagcacagacacaaaagtccctgcagggagacaggaggggactgcatgttagttgctgctcagaaccaccagggggcattcaggacaccagtaggcactcagaaccaccaaggagagctcagaatcaccagggggcactcaggaaactggcaggtgctcagaaccaccaaggggcgctcaagatcccagcgggagctcataaccaccagggggcgctcaggacactagggggctcagaaccactagggggcgcccaggaccaccaggtctctcaagacaggagggcgcactcaggacactagggggcgctcagaaccatcagggggcaatcaggacaccagagggacttcagaaccaccagggggcgctgagaaccaccagggggtgctcaggacatgaccggccctcaggaccaccaggggatgttcagaacaccaggaagcactcaggacaccagagagcgatcagaacaccagggggcactcagatcctccagggggcactcaggacaacagggagctctcaggacaccagggtgagctcagtaaaccagtgttcgctcagaaccaccagggagcactgaggacaccaccgctcccttaggaggcagctccacatcaggtccctggatccgggcagggagggcggttccttttggatcttgccactaaccttttgggagttttcctgcttcctttgtggtttcaagaatcatttgcagattcttctcatgtacaaagctctgctttcttggattatgtaatgtttttggctttggatgctaccagaattacgttgtactgtgagaggattcattcgtggtgtgtgcaatagtgaatgaaagctccaatgttaggggtggctttgaaagctacgttaggggtggctgagggcagttagcagaaaatgatcatcactatagaaggctactcatttctttgcacatttgcataaacaattgtagtttatgccctaaaaactgcatgttttcttggccctttttcttaaatggctccactctaagtccagtaatctaattaagctgtgtttcaaagaccaccaatcaagttaattctgtttaatgcaacactttgtaaagaaaatgtacatctgttttttagagtcagctttaaattttacattactttacaaatattgatttgtcaaatttagtctcataactatcttcagtaatttaaaatcttagtcatgtcatgttaaattaagtaatcctaggtttctcacttgaattagggttactaagaattagaatagtaaaagagtataattagcttttggtgaggtttataaagaaagatgaggatttttttttttttttgcttaaaaatattctgttttccagtttacagggcttttcaactggttttaagataaccactgtttacatctaaacttttttttgtaaatgactgctgagtttctatacatattccatagctagagtttcaaagtaaaagctctagtatctttgtattagtgtgtgtatgcgtagatgtgttaatatgtgcatgtatatatatgtgtgtgtgtgtgtgtgtgtgtgtgtgtgtgtgtgtgttgtggctactaggtacaaaattggctttgaaataaatattttcaaattaagtaaatgagcccaatgcatttgaagtacatgtgacttaaataaatatttaataaataagttggctttaaaattattggtaaaaacaaattagagatattttaacaattatcagcataccttatagtttatattaattcatcaagtgattttatatttaaaatcacagctagatattatatggtgtcaaaattttttatgatgattataaaattattaacctcgttggccatatgcggtggctcacacctgtaatcccagctctttggaaggctgaggtgggtggatcacgaggtgaggagattgagaccatcctggctaacatggtgaaaccccatctctactaaaaatacaaaaagaaaaaaaaaattagctgggcatgctggcaggcgcctgtaatcccagctactctggaggctgaggcaggagaatgcttgaaccccagaggtggagcttgcagtgagctgagatcgcaccactgtactgcagcctggatgacagagcgagactccgtctcaaaaaaaaaaattataaacctcattaaaaccagaatgatctttgtaattttttgacaaatatgatgtttaatattgttgttttaataaaaaacaggtaaatagttattagaaaaacaattatttgcttaattataaggtttttactcaggcaagcacctgaaattcatgggttataacatggttaacagagaaaaaactttaaaggatgaattacaattttcataagtaatctagataagctacttaaataaaatagggaaatgtaatcaaataaaccttttaaataaacttgttctacaatttaaaaatctaaagtttaattaaataatagatattgactaaatgtttaggtcattactaattgttttaaaaaatatataagaaaatatttttcttaaaaaattattcttagaaaaataatgtaattcaaagttatttatataacatcataaaaagtaagagagttttaaagaaatttattgacatagagaagtacttttggtaagaaaggttaaaataaaaaaattttatatgagaaataatcttgcatggtaattttttatcctaaaataaaatgactaagaaagaatgacgtttagaataaaacaagatgttcaactatgccataaatggtttgtgtaagtgaaaataagatttataaaaagttaatttattaaaaaaccttcatattatcaagttgactataattgaaagggaagtatttataatagtctttatagagatctggcttttatataaaatatagtaatacactgaagactggttagaatgacaaaattgtcttaaagtgttgatttactaaataaaattataagatattttaattttttaacccccaaatttaacttttattgcatcttgccattttgattttttccctttgagaagacttgagaggctctccattttttcatcacgtcctttaacattttttttcttacagcgattagcttcttactgacttaacttctaactgttgttagcttttaactgctattattgtctgatgctaaaaacattttatctttaagttctaaataaaatgttttctttcaatataacattctacactcttggcttatctttaaatgtctacatttttctatgaaaccaaagtcttcacgtgtaatctgagtcacattcttggtatgtctaattaattcaaatgcttttttcattagagttgacctgcaggttatctacatgcattttccaatagggaaaagcaatcacactgtaaaaggttttgctttgctatttggtaactggcataaaacaaattttatattttattgaaataattcctatgttactgttattaaggtttccaacttactgagattttaagaaaatataaattaatgttattacattcatgtagctatctacattacttttaaaggccttgtgctgccacattactgacctttgactcctaggtctaaaaaggacacacagcattttgggagactaaggcaggcagatcacctgaggtcaggagtttgagaccagcctggccaacatggcgaaaccctgtctttataagaaatacaaaaattacccaggcatggtggtggatgcctgtaatcccagctacttggaagcctgaggcagggagaattgcttgaacctgggagacagagattgcagtgagccaagattgtgccactgaactccagcctgggtgatagagcaatattccatctcagaaaaaatatataaataagagaaaaaggacactaagtcctgctaaatcttaaacactgacagtaattaaagccccatctacagacctggaagaaaatgacaataaaaattcatcatactcttaagacataaggccagaaattgaaactactcaacaactccaggcccagggactattacagaagtggatttgtaagattgtaaaagctaattttgagatataatattacttgagagtttctttataagttaagcattaatattaaatgcacactaatggaagtctagcatctgggcccctgtgacagattgacaagggtttcttgaagaagtaatccactctttagcttaaaaaattattaaaatttataaaagacctatgaaaattatattttatggtaaaagtagttataatttaatagacttatttctcagaattgagagatagttttaatttttctcatgatgttcttataaggggttattgtttagaaaattaattctttcaaaaataaaagtttttgcttttttaagaaatcactgagttttcacttggctaaataaataacttactttacaataatctgtaattccattttgtaatatcaagtgttctaaataaacctttgatatttgacctccttcacaaaataaaagtctaaattcagtcatttgacctcattattcttttttgatatttgatctcctgaagccaaaaagaaacatatttagcttctttggtacaattaaattatactggaagcaatgtcaaatttgaaatggtgtttaactttggactatatttatataaatgtggactatataattggagtatattcatataaattaaagagtacatgttctaaaatggtatgaggttcaattgactttgatatgtcagtatattttgtcagtagtacttatgattattatataaaatttttgttcatcacagaaataaccaaactttctcctcaattctgtctttaaccgtggctattctaaaacttcagccatccacaattgttttcctttgattctttatcaggtggcttataataatctatagaattttgaggggtactcttaaatacacaattgtgacaattttataaattgtgccatttatatacagagaaaaacttccaagactctcatggagacctgatgcatttatgatggttgttaatataatgtcaaacaggacaggacttaattgcatgaactgaactaacaggagcctgaaataaattttatggcttattctttaaagcatttgctaattacttacattttgtttttcagaatcaaaaaaaaaattctcttaagctattcattgtttttaacaattgagtatagtatattctagtgagaaaattcaaaaacacaatttcttcttctctacataatttctccaaaatttggaaactgtgagtattgttatatcaaaatattaattcacataggttcaatataaatctgctttcttccgtaacagggcacaattggagacaatgatcattttaccaagactttaacttgaatgacatattttcatatttactttataaaatgaatttaagctggatagctgataaaagccccttgggaaaactggcatgtaacctgttttgttcagggccctgagctgtagtaagtcaataattttactttctgacagacccaggaatcccaagttgtcttggaaaattgaaaaaagaagaagtaacccaattcatatagctgtctgaaggcacagatgaaacaatgtctgggcttgatgcttttaaagattctacccttagatttcttataaaaaatttccagcaaggtcaatttatgaattaaatagcctatgtacaaaaaatagaaaaaaagagagctaatatgttaaattactatttttgcctcatcttatacaaaaaaattaagcctaaaacttatattacaaataaatttgccctactatgattgtgtctctaataactttggggaattatagagagaaatactgtttcaaaataaacaacagtgcatctgttattagattctaaccttgtccacttgtttttcaatttatattattttctacaatttatattagtttctacaatttatattagtttctataaaaatttatatttgcagaagcctccaaaatatttttcctgatttaaaattaccagaagttaaactgtgctttcttatagctagacatcttatactctaaagaaaataaaatcaatgacatgatttggctctgtgtccccaccccaatctcatcttggattgtaataattcccacatgtcaagtggaaaaaggtgggaataattgaatcatggaggctgttttctccatgctgttctcctgttattctcacaagatctgatggttgtataaggggcctccctcttcccttggcacttctctcttgcagccatgtgaagaagcacgtgtttgctaccccttccatcatgattgtaaatttcttgtggctttctcagccacgcagaactgtaagacaattaaaccttttttctttataatttacccagcctcaggtatgtccttatagcagcatgaaaacggacaaatgtaagcaacttaattatatacaaaaactcttttatacctgcctactgtgaaaggaaaataagtcttgagaccgcaaaatcaccaagctaaatggaagagtcaaactggtgttacaggagatagaaagaaattattttggtagatagttaggatgacagaatttctgccgaaaacatttcttctaacaaaaatcagcttggcaattacttattttctattcacacagagttcaaagaaatcacttctaacaaaaagcagcctgaaagatcaggctgtaaaacatataagcaactctgccacagagagggtgtttctgggtgtaatcaccaaacttcacatacatacactgggccctagtaaaaacagtgggccttaatgagcacattcctttccttttctgggggcactataacatcagaaagctggaaacttgcacaagtttaggatgcctgcacttgcaaggaggtacctgggacctagcatggaaaatcctcttcccctttttagcactctgggagtggagccccagccttgggattcccaggtgtttcccttcagtgatcaggactgaacacacacaactcatcatgcagtttgtgctgagctgggttttccttgttggtattttaaaaggtgattcatggagaactacagatgttgagtgtgagtggacatgagtgagcaaaacagtgggtttgtgtggcagtttctgaccttggtgtctctgtgtttgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatacacagaggggaagtcattgtgcgcccagacacaaacctccctgcaggaacgctggggggaaatcagcggcagggggcgctcaggagccactgatcagagtcagtcccggaggcaggtgcagatggaggctgatttcctgtcaggatgtgggacttcatcttcttccaacagtttctctaatgaacctccctaattttagaattctgtggttcctaatgtcatctctacatattttcaaaagatcattttaatatgaggacataacctctcatgtaccaaatgcacattgatgcttacaaagatgaaaagttctcaaccattgtcaccaggatcgcagtcctgaggaagctcacgggtgtctgatgagtctcctccattcaggcccaggacagaaacctcagggagactcctggactagaacggcagggattctgatcacagccaatagagagcctgggccagggtcagtgtcctgtagaagctcacagggttcacatctgacccttctcctgaccctaaagccaatccgcatcagcactgatctggtgctccttttgctcccaatacatgttctttctttggagtgtttgttctcccttttttatttgcttttctttcttcctgaaaaagaaacacatggtctctatgctctacactccagggctcaaggcattttcttagaactcaggcaaggctcaggcttggctactccagcccacgtgggagaggctgatgggatttccttctctccccatattctcagggccctcctctgtgttgtgtgtagactcatctgggaatgcaattggccgttaatagtgaaggggataaactcatttgatcaaaatgggatgtggatgtggaattaaccctgttctatgcacactgtcagagtcatcttcttcagaagtagtgttagaaagagcttgtgaactttatcagaatcaaaatggatccacttgtgttaaaaccctaatgaatgaagctggggaaggccatgaaggagggttctaacacacatattcctgataagaagaactatcataaatagaccctgcacagccacaaccttttacacagaggccaccacagccttaaaagctttatttctccaagtaaatctgccccgcaactgcctattcaaccttacaccgctatctcaaaatagctgctgtcaccctcctcatttttccttaattctcttttttattattttttaaattatactttaagttctagggtacatgtgcacaaagtgcaggtttgttacatatgtatacatgtgccatgttggtttgctgcccccattaactcatcatttacattaggtatttctcctaatgctgtccatcccccttcccccaaccccactacaggccccggtgtgtgatgtttcccaccctgtgtccacatgttctccttaattctttatcttccttttcctacctgaatgtacccatacatattttaattgaaacgcacatcctagaaaaaatattattatactttagagtctctgtctgttattcaggttgacatgacaagctacagacggacatgccacttttctgtgagacatagaggatgacagtttttggagatgtctaggaatatccaatgtccataagatcagccatcaataagtgcagactggaggtcccagagagaggcgaagctgctgaatcatcgtggaatttcattttctccagttctgctctgatggaatcaggcccacccattttatcaatgacaatctacctaacctagagtcagctgatgacagtattaatatcatctattaagtaaagtcataactatatatatagtgagagagggagagagagagagacggagtctcgctctgtcacccagggtggagtgcaatgtcgtgatcttggctcactgcaacctctgtctccggagttcgagcagttctcctgtctcagcctcctcccagtatctgggaatacaggcacacaccaccatgtccggccaatttttgtatttttagtagagatggtgtttcaccacattggtcaggctggtctcaaactactgacctcaggtgacccacctgccttagcctcccaaagtgctgggattacaggggcaggccaccaagtccagctaatttttgtatttttagtagagaccaggtttcacgatattggtcaggctggtctcaaactcctgatctcagcctcccaaagtgctgggattaaagatgtgagctactgtgcccggccaacaccacctatattaatgttggattgaataactacaaagtctaccctaaccaagtgtaccatcaaacttaccattacccagaggaaagaatctttaacatgagatctatattcttaaatgttttaaggtgtaaaactgaccacagtacaatcacccaattatgattttgctaatgagttgtagaaactgcatgtatattttggatattaacactttttcagatgcacaccttataattatattctctcattctgtaggttgcaattttttccacactttgcggcatctttttgttgtgatgtagttctgcttgttcaattctgcttttattatctgtgactttaatttgaaatatagaaaatcatccttttttatatactttaaattttagagtacatgtgcacaacatgcaggtttgttacatatgtatacatgtgccatgttggtgtgctgcacccagtaacttgtcatttaacactaggtatatctcctaatgctatccctctcccctccccccaacccacaacaggccccggtgtgtgatgttccacttactgtgtccatgtgttctcattgttcaattcccacctatgagtgagaacatgcggtgtttggttttttgtccttgtgatagacttctgagaatgatgatttccagcttcatccatgtccctacaaagggcatgatctcatcattttttatggctgcatagtattccatggtgtatatgtgccacattttcctaatccagtctatcattgttggacatttgggttggttccaagtctttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgccttccacaatagttgaactagtttacagtcccaccaacagtgtaaaactgttcctatttctccacatcctctccagcacctgttgtttcctgactttttaatgattgccattctaactggtgtgagatggtatctcattgttgttttgatttgcatttctctgatgaccagtgatgatgagcattttttcacgtgtcttttggctgcataaatgtcttcttttgagaagtgcctgttcatatccttcgcccactttttgatggggttgtttgcttttttcttgtaaatttgtttgagttcattgtagattctggacattagccctttgtcagatgagtagattgcaaaaattttgtcctattctgtaggttgcctgttcactctgatggtagtttcttttgctgtgcagaagctctttggttcaacatactcaaatcaataaacaaaatccagcatataaacagaaccaatgacaaaaatcatatgattatctcaatagatgcagaaaaggcctttgacaaaattcaacaaccttcatgctaaaaactctcaaaaaattaggtattgatgggacgtatcttaaaataataagagctatctatgacaaacccacagccaatatcatactgaatggacaaaaactggaagcattccctttgaaaactggcacaagaaagggttgccctctctcaccactcctattcaacatagtgttggaagttctggccagggcaatgagacagtagaaggaaataaagggtattcaattaggaaaagaagaagtcatattgtccctgtttgcagatgacatgattttatatctagaaaaccccattgtctcagcccaaaatctccttaagctgataggcaacttcagcatagtctcaggatacaaaatcaatgtgcaaaaatcacaagcattcttacacaccaatcacagacaaacagccaaatcatgagtgaactcccattcacaagtgcttcaaagagaataaaatacctaggaatccaacttacaagggatgtgaaggacctcttcaaggagaactacaaaccactgctcaatgaaataaaagaggataaaaacaaatggaagaatattccatgctcatgggtaggaagaatcaatatcgtgaaaatggccatactgcccaaggtaatttatagattcaatgccatccccatcaagctaccaatgactttcttcacagaattggaaaaacctactttaaagttcatatggaatcaaaaagagcccgtattgccaagtcaatcctaagccaaaagaacaaagctggaggcatcacgctacctgatttcaaactataccacaacgctacagtaaccaaaacagcatggtaccggtaccaaaacagagatatagaccaatgaaacagaacagagccctcagaaataatgccgcctatctacaaccatatgatctttgacaaacctgacaaaaacaataaatggggaaaggattccctatttaataaatggtgctgggaaaactggctagccatatgtagaaagctgaaactggatcccttccttacaccttatacaaaaattaattcaagatggattaaagacttacgtgttagacctaaaaccataaaaaccctagaagaaaacctaggcaataccattcaggacataggcatgggcaaggacttcatgtctaaaacacgaaaatcaagggcaacaaaagcccaaattgacaaatgcgatctaatatgaaattcttaatgagttctatagttataagtacattatttctccttattaaaactaatcttttttgctgaatgggtggaagatggtggcttccctccaaaagaaaacatagttggttctgtaaagagttcacccatttcttccactataggcctgccctggcataatacaagctcccaacttaagaacttatgattttccatccatgggagaagccatcttttccatctattataaaaacagaagacacttcattaatatcactcccaaaataggctatgtcatatccagtgaggtaggatggctgacagtggtgagaatccaagtaattggtcaagcactgctatgtgtgaagaaacaccacagcatactctacactgtcactcatgatatggaattgttgcctcctcagcaatgtaactgagcccttaatatgtggctgggatgacaaagcaatgccagcctgcagagtggaacctgttcttccttctgggattagccaaaggccggtggcactcatggctgaccctactttccttacaactggacgaagcgaagcaactggatatgaacttctatcccaggatgtaactgtccaaagtgccttctctttatgtcaactggaaaagtgtgaaagacagacactattctcataaacggatatcctagttattccacccactagccagctcttccccccaggtggcagtcatagatttagaattgcaagtagaggccctggctaagcataccaccagtccctttaacaacacctaccataccatcatcattcttactgaagaaacctcacagatttgacaagtgacactatgaagctatatgaccctaggtattgcaactacagccaaaggtaacacttgtgtattaatgaaccctgaatgttgcatatatatacaagattagtcccacaatataactcaagctatgcaagcattagatacccatatttctgctagagatggatgccctctctcaggaccctgcgacagcatggtttagttgacttcctaacacatggaagactttcatatatagtagagctggtatactcttcattgctatcttcagttgctgtggattttattggtaccttgcactttaagtgagaatgtaatactgaccttctcaaaaactcctaggtccttgcaccataatgctccaacaaacacctactgtaattccggagactccagaatatttccaactccagtttaatggattcccttccaatatatacaagctatgccctttctaagaagtagccagattgactatgacacacgttttccatagaaacaaaatggaatttgacagtggggaatgatatacaggcagcttaatttcaaaatgcattttaaacttattttttgaggttttaatattattttcatactccttgaaacctgaaatttcacacttacattctaattgagacttaataacaaataaccagaacacatgaattgcctgtaatctctataccttgtattgtaagccacatttcaagtgtaaccttacttgtcagcacagtatgtttaccataggcataattgcttgtcctgactgtccagaaggcagggtggtattaagtatgcggcctctggagctgggaagtctggctttgtatactgtctctgccactgctaactgaaggacaatgggccagttacttcctgtaccccagttttgtcatatgtaaagtagggttgttgtaagaatgaaattagttaatatttagtacctaacaactagtaggcattacgtggtagctattcgtattgctatcgtcagagaacacacaggagtccattgttatttttaccctccccctccaaacaaaatgtgtaagacactagacatggtagctctgtaacggggttcgtcatgtattaaactgtgtacccaaatgatatgtcaaagtcctgacaaccagcacttcagaacacgtccttatttggaaatatggtagctggagatgttattagtgaagatgaggtcttacttgagcagggcaggccctcaatgtgggaagatgggtgtctttctaagtacaaggaaatttggacacagagacagagacatacagtgtgccatatgacagcagaggcaaagatcagagtggtgcagcagtaaaccaatgcatgtccaggattaccagtcacctccacaagtgaggaaagggcaaggaagaagtctcctgagtctcagagggagtgcagcccagctcacacttgattttggacttctagtctctagaactgtgagacaatacagtcctgtcatttttaagccacccagtttgtagtatttcattttggcagccctacgatattcatacagagttcttcacccaaaaggaagcactctttctcacaaacagtcaaagtcctggatgacggacaacctggagattgcaaacctccaaggaatcaaaggaggttctataaagtctaggagccccatctttcaaaggctgctcctcaagtccacacacacactttggaaggagaatcctgctcttggacatgggatccttagtgagccaactgccaataatccaacatcatcatgaattaaagatctctgacatttcctcgtcaccaacgggaattctgtcaagtagtaagtaaaacccttcttcaggaatctccacaccaaacagttctgcatggcttgggacgcctcaggaaacttataatcatggcagaagaaaaaggggaagcaaggcagtcatacatggtggcagaagagagaggttaaacttttcagtctctcttgggtgtaaagatacaatcttgaggcaaacagcagaatcaattttcttatgccttgaaattctccctttcaccataaatattcccttcacattaatctaactttatgtttgcatcgaactatgtgcctttttggaagttccggaagctaatttgagacagatagacaaagtcgggagaccctgatgcagaattccagaggtgacttcaatgttgctagttaacaacccaggcattgcccagatgatgccagcccaagatccaggtggactgggatgccagagagctgccagaacaagacgcacagacctggttctcagcccaaatcttgcatgcctttcttaccaactttcccttttttaaacccctgcctttccttcaaaattgaagtggttgcttgggatgggaatgcgttcacttcccctttaccattatggttaatacaataatttttgtaccagatctctctcttgttaattggatcctgcaggtggcagattccggaccagagtgacgttagaaactgaatgcacatactgggtggttcacagacacagtgttctgtgaagtttatgggtggattcctggggaagcctgcaagcctgttagtgattagcagaaccgcatccagctactgggatctgcacgccaggtgccgtgagcccctcaccatgttccctggtcccagctgcccgcggatggttcagccttgacaacgggctcggtgttctgggtggtgggagagcaagggggccccttgggcagcgtgctacagggctgtgaatccaggggcccacccggtgttccctgtggagtcactgagggaatgaggggcttctcagggcacagagctgtaacgcctttgtgcagtggtggctgaatacagtgacactgggcgcgtggtgagaagcggggcaaggtcagttcactggaccctccgccctgagcctcagatgagtcgggggtccccagacaggcccggcctctgccctgcggcggacactggagcctttgctgtggccgccaccgaggagccttgacctcaaaggagggggaacctctctacccacctcggaaacctgaagggagcggcggtctctcccagacaggatctcgccggcctccgcgtctccaggcccaaccctgtaccacataaaggaagtccgcgctgagctaccgggacacagcgccgttgggtgggcgggcgcggcgcggcgggaagcaccggggcagctgccacagagatgcgcggggactgtcgggaagtgggcggtccgggaggcgcggggctgatgggacgtgggcggtccggggacgcgcgggggatggcgggacgtcggcgatcccgagatgccagggggcagctgggacgtgggcggtctggagaggcgcgggggcagctgagatgcaggtggtccgggacgcgcgggggctggcgggttgtgggaggtccagggatgcgagggggcagctgggacgtgggagttccggggacgcgtggggtcgccaggaagcggggtctaggacttagatccgccttctcttcaggccatgcagccccgaagctccgaatcctgggatgactcctgtccatgttggaagggaccctgccagtcctggcaaggttcaacggccttagggcaagaaatgttagtagagtcctggaagacgatgtggggaacgggtagcggccaccggatggtgatcgttcttctacaagaccttgacatggatggggagaaacagagaagaaccttccaagtttgtcccactggacatgcccaccacactttaccagccctttctagaaggcctgtgcgtaacacatgaaaaagctgctctcgacctttccctgaccttttaaaagaaaacatttgctgcatctaatccgcctagatgtaaggaggttcccaaatgtatgacagagtcagacaattacatgtcttgtaagttaccatgtgcttgtcttttgttttccgttttttttcgtttttttgttttttgtttttgagacggagtctcactctgtcgcccaggctggagtgcagtggcaggatcttggctcactgcaacctctgcttcctgagtttcaacaattgtgctgcctcagcctcccgagtagcttggattacaagtgtgcaccaccacgcctggctaatttttgtagtttttagtagagatggggttttgccacgttggccaggctggtcttgaactcctgacctcaggtgagccacccaccttggcctctcaaagtgctgggattacaggtgtgagccaccgtgcctggccgtaagttaccgtgtgctttttaaacaaatcatagcaaaggggtgtcttctggaaatgacattttgaaatggagttactagaccacccctggaagggacacagtaaccacacgtccacgttcgttcagtgggtgagaggacatggaggggagacctgggcaggaagggaagagggttccatgccaggctgctcatatttaaaagacattttcattgtagggacatggatgaaattggaaaccatcattctcagtaaactatcgcaagaacaaaaaaccaaacaccgcatattctcactcataggtgggaattgaacaatgagatgacatggacacaggaaggggaatatcacactctggggactgtggtggggtggggggaggggggagggatagcattgggagatatacctaatgctagacgatgcgttagtgggtgcagcacaccagcatggcacatgtatacatatgtaactaacctgcacaatgtgcacatgtaccctaaaacttaaagtataattaaaaaaaaaaaagaaaaataaaagacattttcatatcgttgtcattgttttcttgtgtgcattttattcctcgctattgtatacatcattggaaattctaagtattcttttgaaatatctagtctttctagatgttctgaagtgcctgatgtatgttaaaattacaggtggtaaaataataaattttgtaaatgtctttttgttaaaattcatatgcagtgttttattttattttgatgttggtggggggtggggaggatggccaaatccctgcttgatcaacacacattgcgtttgtgctctggttcaggggaggagagaggaggagaaagtgcagacttccaggcctctgtgcgcaccgggaggagagattaatgatcatctcttctgtctgtgtgtttgttttatttatctatggatatcctgtgtataaaggatgaacaagtcctatttataacatctaatcttttcaggtgttaagttgccagcgtatgacggaagtagcattattaaacgaatgcagcttgtacatattgtgttaaaattcataaaaagccagtcttctgaaaagaacccttgggccctccctccgcagcctccggcgccagctgcaggaagacctggccaggggaaggcgggcggcagaagctgctgctggctgtggggaaggcggtggagcccaggcctccacaggctccccacaggctccccacaggctcgcgcggctctggttgctgggctccgcacgggccgcgtgggggcgcctgctgggagcgaggaggcgccatcctggctcgcctgctccaggaggacgctctgggcctgcgcagatgcagttctccaggatgggcgcgggcgctgggggcggcgctccttgggctgctgcgcctccactgagccgcctgggtgtgaggacctcgcgccggcgcctccgggaaggacgcggagccgccgcggccgatcccagggctgcagctgctgcccgacgcccgcgggaaggcccttccgccaccgcccgggggttcgaacttggagcagctgctgccagctgaggcgccagcggcgtcgggagctcctcagagtcagtgttttgtgctggattcggcatgtcctctgaaaactcgggaatttgtcactgaaatggtgacaggaggtgagaagtttttttagacgttgccttcgctggcctggcgcggggctcaggcctggaatcccagcactttgggaggctgaggcgggcggatcgcttgagctccggaggtggagaagctgccttcgtggtaactgtggtcttaagttcagctgagaacgataaatggcttttccttgaattggctgcttttgtgatttctctcaggctcatcttttgtcagttaaaaatccagtggtaggtgtagcttagagacgggaaatttttggttttgttttggctacacgtaagtgttggaaattattttcttttacgttccagtgtgagcaaatccagaaggatgtcagattaaacaccgaatttaacaaattcagccgggcacggtggctcacgcctgtaatcccagcactttgagaggccgaggcgggtggatgatgaggtcaggagtttgagaacagcctgaccaacatagtgaaactccgtctctactaaaaatacaaaaattagccgggcgtggttgtgcgcgcctgtaatcccagctactcaggaggctgaggcaggagaatcgccgagattgcgccactgcactcagcctgggcgacagagcgagacttcgtctcaaaaaaacaaaaaaaaatcaatcattggaatactgttgttcattacaattaatgaacgtttgatagacgcataaacgaactaaattcacaagtacatataagtaaaataagccaaaaaaaaaaaactacatcccgtatgatgacacttttatacattctacagaatagaaactaaagtgatatgaaggttgggagttgaatggagaaaaggtgagcgaaaagagggaggacggaggagttgcaagagaacaagagaaaatgttgagggtaattgatctgttttctatcttaataatggttatggttacatcaataatttctaaattgtacattttgtgtgttaattataattttatattattcaagctattacaaataaatacctgtataaatttcttagggacggtttaagggagatggataaatcacataaaaagtcagatatttctgaatgtacaatgaataacccttagctctatctttattttttggtaattctaaaatgcagcagatttttttaatgtttttattacaagaagggtttcttcaaaccacaccaggtgtgtgtaactctgggctaaagttggttaagggagcagtgggatccggtggagaggagcacaggcctcgatcctggagcccattcttgtcacatgtgagctcctggacacatctcatagctccctcatgcttctgcgtttacattctcatctgtaaatggaggaccaatgggcatctgcctctaacaatgtattttcatgtgttaagatgatgtatgttaagtgtttactatagcacaatcttttaataagaaattacatttttttccaaatactatcattgtcttcaagccccaccacccaccagaaaacttaatatgctctgtgccctgccctgtcctcagacatccagcccaagagacttttatatagtaggagatatgcaaatagttccctccctctgctgatgatgaaaaccagcccagccgtgaccgtgcagctctgggagacgagctcaagtgccaggattcccaagtgttttcacttggtgatcagaacttaacacagaggaatcaccatgttgtttgggctgagctgggctttcctttttactattttaagaggtgatacatgaagaactacagatattgttcgtgagtggatattagagaaacagtggatatgtgtggcagtttctgaccaggatgtctctgtgtttgcaggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggctgtgtgagagacatggtgaggggaaatcagtatgagcccagccagaaacctccctgcaggaaccctggggtggggggaaatcagctgcagggggcactcaggacccactgatcagaatcaaccccagaaggaggtgcacatggagattaggggctggattccttccaggatgtgggacttcaacttcttctgacagtttccccagggaaccgctctaagtttagaattctgtgtcatctctatgtatttaaaaaagatcattttaatgtgaggaactaactattctcacatgcacaaaatgcagattcacactcacagagatgaaaagtcctcaactgtggtcactaggatcagagtcctgaggaatctcaggcgttcctggtgagtcttctccaatcagacccaggacagacacctcagtgagattccatgactagaacaggctttatggattttaaaaaaaatagactgagccagggtcagtgtcatgtagaacctcacaggtttcacatctgacccttctcctgacactaaagtgtgcaaatcagcatcaatactgatctggtgctgcttttgctcccaatctgtgttctttcttgagttgtccctttttcatttgcttttcctgctccctgaaaaaagaaagatgttgtctctgtggtctaaattccagggctcaagcccttttcttggagctcaggtgggtctcaggttgtggctcctgcagccacgctggggaggctgatgggactttcttctctcccattgctcagggccctccactatattgtgtggagactcatctcagaatagatgtggccagtgggagctgaaggggacaagcttgtttggtcaaaatgagatacaaatatggaattcaccctgtgctgtacaaactgtcacagagtcactttctgaaacaatagtgttagaaagaacttgagaaagttgtcagaatcaaaattgggtcacttgtgttaaaactctgctgaatgaagctgggaaaggccgtgacggaatgttctcatgctcatatccctgataccaagaactatcgtaaatagactcttaaaaccacaatcttgcacaaaggtgcccacaaccttaaaagaattacttctctgagtaatcttcccagcagctctctgtgtaagattggactgatgccacccttgttattgattcttctatcccggagaagttgtctcaaaacagcttatgtaaccctcctcatttttctttaaacctttatctttctttacctgcctgagtgaacccatgcatgttcccattgcaatgtccatcttcaaataattatcattttactttagagtctctttttgtctgttattcagatttgacaagctgcagatggacacatcacgtttctgtaagacttaggggatgacagttttgaggcatggctggggaagtacaatgtccataagattgaccctcaataagtgcaggctgtaagtctcagagctgaagctgctgaatcaccatagaatttcatctttagttctgctctgatggaatcaggcccacctgtgtaatgaatgacactctacctaacctagagtcaactgatgacaggttaaatatctagacagcaaatttgcaacaccacttagattagtgtttgaataactacaaagtatagccgagccaagtatatcgtaaagcagactattatacatggagaatctttaacatgacatctacaattcttaattttttttacgtataaaactgatggttttacaatcaggctgtcatgattttgctaatgagttgtagaagttacatgtatgttttaaatattaacagttttttcagatgcctggtttgcaactatattctcccattctgtagatttggaattttttccatgctttgcaaaatctttatattttgatgtagttccagtccttcaattctgcttttgttgtctgtgcttttaatcttaaatttaggaaatcattgctaaccttttggtgggagagaattttacaattgcaggctatacatttaactgtttaacccatctagagttgattttttgtgtttattctaacctaatattcttaactatttgcaagtgaaaacccagtttgtttaacaccctctttaggggagagtatgatttagccgttgtgtagaaaatgttataaatcactttgccttcatattggttctcaacttgaaaatgagtttgccatcaatacgtgggtttatttctgagctctctatatgtatttatgccagtaccatcctgttttgattatgtttgtaattaattttgaagtctgagagtaaaatgcctccaagtttattcttgcccttttgcagatattagacaaaatattttaacatttcaccatgaagtatgataacagctatggcttttcataatgaattttattgtgtttaggttattttcttgtatttctattttgggtagagtttttatggtgaaaccttgaatttttttaatgttattttctgtctgagaagttaatgggaccttcttcgtatttaatttggcataccaaatgtattgatttgaggattttgaatcatctgtgcatctcaaaaataaatttgagttggtcatggtgtatgatccttctaaagtcctgtggaacttagttgactattatttggtgtgtggagggggctcatttatgtctactaggaatattggtctgtagtttacttttttgtgaccttgtctattactgaaaatacggtaatttgggccttatagaaagactggaaggttggcatctcaccaatttttgaaaaagttagagaatggttggcattacttctttaaatgttgagagtcctttttttacttaacatgtgacctatcatggagaatatttagtctttgcttcggaagcatacatattacactgctcttggttggaaggttctgtagatgtctattaggtcaatttgttcaatagtgttgttcaagtccactgtcttcttaagaattctcttaatgatgttctatccatcattgaaagtgaggtgctaaagtcttctcctaatttttattattttctatttatctctccatatctcttaaggtttgcttaatgcagttatatttatttttgtacaaatatgtaaaaaataaatgaaataataattgctaagtaattttaatggcaaaatcacataataagaaattatattttcccaaatgctgtcattgacactaagctcctccaggaatctcacatctgctctggacacggctctcctggtgtcctaccccagagcttgctatagaggaggagacatgcaaatagggccctcactgtcctgatgaaaaccagccttgcctgcgtctacgggagaagagccccagtccagaagtaccaggggtttccatttggtggtcaggtctctgaacacagaggactcactatggagtttgggctgagctgggttttccttgttgctaatgtaaaaggtgactcatggagaactagagatattgagtgtgagtggacacaagtgagagaaacagtggatatgtgtggcaggttctgaccagggtgtctgtgtgtgtttgcaggtgtccagtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactgtggtggcattgtgtgcatcccttgtttaggtacatgcagagatgctgctttggtgtgttcaggggctcctgttttggggacaccaattttggagtttgcagtatccttgagtccagtacgttcatggtggcattgggtctggggtgtgcagtggcaatgagtccaggatacatgcagctgatgccgtatcttgtgaggacaagaacaactacaaaacgatcctattaataaataggcaaatgacttgaatacacatttttcaaaaaatacatacaaatgacatatagatatataaaatgttaaatatgagtaataatttttaaaattcaaatgtaatctacaataaattatcaccccatacctgttagaatagctatttttaaagaagatgaaagataaccagtattggggcagaagtggagtaaagggagcctatatatattgttactgaaaatgtcaattagtacagacattatggagaatactatggaggttcctcaaaaaataaaaatagaactaccatagtttccaacaagcccactactggctatgtatccacaggaagtgcaatcagtatgtcaaagagacatctgtgcccccacgttcattgcaggaatatttatgatagtaatgatgtgggaacatcctaaattaccataaatggatgaattactaaagaaaatgtagtatgtacccaatggagtaatgttcatcctaaaataagaagggaatcctgcatttgcaacagcaggcatgactctagaggaccatatgtgaagttccacaggcaggcgcagaagacgagtaattcgcgatttcactgtagtttgtttaaatggtagactcacagaagtagagtggagtgttggttaccaggggctggaggggtggactggaaaaggcgagattttggtcaaagggtgaaatgttccagttagacagaaggagaaagttacagtgttctaatgcacaagatggaaaatatggctaataatgcattatatatttcaaaatggctaaaaatgcaaatgttaaaaattttctcactaagaaatgatacagcctgggcgcggtggctcacacctgtaatcccggcactttgggaggctgaggcgggcgaatcacaaggtttggagttcaagaccagcctggccagatggcaaaaccccgtctccactaaaaacacaaaaaatagccaggtgtggtggcacgcggttgtaatgccagctactcgggaggctgatgcaggagaattgcttgaacccgggagacagaggttgcagtgagctgagatcatgccactgcactccagcctgggtgacagtgagactccaactcaaaaaaaaaaaaaaagaatgaaatgatagctgtgtgaggtgatggatatgtcaaatagcttgattaacaattccataatatatacatgtatcatagcatgtgtgaggtgacctgtatgaaggtgaagtgacctgggggctgtgtaagattacctgggggtatgtgtgaggtgaacacggcacatatgaggtgaccagagacacatgtgaggggacatgggagatatgtcgggtaagccagggggatttgtgaggtgacacagagcaagtgtgaggtgacgtggatgcatgtaaggtgatttggggcacatgtgaggtgacgtgggggatatgtgtgagctgacctcgggtgagtgtgaggtgatccaggatggatgtgaggtgacctgggggtgtgtgtgaggtgacttgggcacatgtcaggtgacatcggggattggtggtgatgtgggtgtgtgtgaggtgacctaaggaggtatgaggtcacctggggcatctgtggggacctggaaatgtgtgaggtgggtacaggtgaagtcacctagggcacatgtgaggtgacctgtggaatgtgtatggtgacctgggaccgtttgaggtgacatggggaatgcgtgaggtgacctggggcatgtgtgaggtgacaaagggcatgtgtgcagtgacctgggtgcatgtgaggtgacctggtgcatgtgttaggttacctgggggatgtgtgaggtgaacaggggcaggtgtgaagtgcctgaggaatgtgtgaggtgaactggtgcatgtatgtggtgacctgggggatttacgaggtgacctgcgggatgtgtgaggtgaccttgggtgagcgtgaggtgacctgacgtatgtatgaggtgaccagggtgtgtctgaggtgatgtggggtatatgtgcggtgacctggtggatgtgtgaggtgacctgcaggatgtgtaaggtgacactggggatgtgtgaggtgactcagggcacatgtgaggtgaaattggggatgcgtgaggtgattcagggcatatgtgaggtgaccttggggatgtgtgaggtcaccttgggtgagtgtgtggtcatctgggatatttcccaacttcgtaaggaaagcctgcaacaacacatggcattagaagcttcacactctagcaccattaatgcgtacatcctcaaggaactctaaatgttttgaggttagcttaaatgccatggagcggcaccttccccaggcacactcatatatgcatcctgggtctccctgccaagctatatctcctcaaatttacagtttatgtttgctctgtgacatcaactctgatatgttcaagtgtgtttttttttctttatttgtagttgttcaggcttgttgtttcactctcattactctgggctcagtcctctcctcaggtgtcccacttcagagctcgctgtgaaataggagacatgcaaatagggccccccctttcctgataaaaagcagcccagtcctgaccctgcagccctgggagagaagcaccagccctgggattctcaggtgtttccactttgtcatcagcaacaaacaaattaccatggaatttgggctgagctgggtttttcttgctgctattttaaaaggtgattcatgaagaactaaggatattgagtgagtggacatgagtgagagaaacagtggatttgtgtggcagtttctgaccagggtgtctctgtgtttgcaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaacactgtgagaggtcggaagtgtgagcccagacacaaacctcctgcaggaacgttgggggaaatcagctgcagggggcgctcaggacccactcatcagagtcaaccccagagcaggtgcacatggaggctggggtttgtttcctgtcaggatttgggacttcctctgcttctgacagtttctctagggaaactctttaattttagatttctgtgcccaccaatgtcatctctacatttttttaatcattgtatatgaggactcgttctcacatgcacaatatgtatattgccacctatgggaatgaaaggtcctcaaccatggtcaccagcatcagagtcgtgaggaagctcaggggtgcctggtgagtcttctccagtcagactcaggacagtaacctcaaggggattcccttgtgagaactcacacattttcatgagaacagcaccaggagtcagttctaaaccattcatgaaagacccactccatgacccagtcacctcccaccaggtcaccccttcacaactggggattataatacaacatgagatttggggcaggacacaaatccaaaccatatcagatacacattgtgaaatacgcatggtggtcaggtaatttgtatttctatcacctcacagcgctaccattttattattttttttaatttactgcatgagtgagtgtctgatgagaacacctaagatctaccctttcagcaacaatcatttttacaatacagtattaactataggaccattgctgtacgttagatctccagaactcatccaacctgcacaactgaaactctgtacaatttaacacacatcacccaatttccctcacctcccaggtcctgggacccactattctactctctgctttcaagagcttgaatattttagatcccacatgtaaatgagatcatgcagcatttgtctttctgcatctggcttattcaactcagcatcatgtcctccaggcccatccgtgttgttgcaaatgtcagaatttccctcttttcaaagccaaacaaaatacagatgtatgtatacacattttctttatacattcatccatttacagtcattaaattattttacaaatctacactattattaataatcttgcaatgaacatgtctttggcaaagtaattttatttcctttgcatatataacaagaagtgggatcaccagattatatgatagctttatttttaacttatcaagtaaccaatcctaccacaggatatttccctttcccccacattcttgccaacatttgtcatctgttacatttctgataatagccatattaactagtgtgagttgatattgcattgtgcttctcatttgaattcctctgataattaggaatgttgagaactttttcgttttctgtttgccatgcatgtatcttctgaaaaaaattatccaggtttttgcccttttttatcagttcatttgttatttgctgttgaggtgtatgggttatttatacatttggacagaacttcttgtcagatccataattgcacatagtttttcctgtgctttgttattaaattcaaagaaatcagttccgaattaatggcaggaattttttttgctccatgtcatttatgagtttatggcttcaggtattatgtccatttttagttgattttttttttttttgggagacggagtcttgctctgtagcccaggctggagtgcagtggcgcgatctcggctcactgcaagctccgcctcccgagttcacgccattctcctgcctcagcctccgagtagctgggactacaggcgctggccaccgcgcctagctaatttttttttgtatttttagtagagacggggtttcactgtggtctccatctcctgacctcgtgatccgcccgcctcggcctcccaaagtgctgggattacaggcgtgagccaccgcgcgcggcctattagttgatttttttatatggagttagagaaggcctaattttatttcttttgcatatgaatgccagttttacaccattattgaaaagactgtcctttctctactgtgtgctcttggcacacaaaatcaggagagacataatgacaaaaaaaatatgagatcaatagtcctgatgaacatagacctgaaagtcctcaacaaaataccatcaaattgaatccagaagcactttaaaatgtgatacatcatggtcaggtgggctttacccctgggatgcaaggctcgttcaatatccacagtaactctgattcacaatgtaaacagaataaaagcaaaaagcatatgattatgtcaatagatgctgagaaagcttccgataggatctaacatctactcatgataaaaaccctcaacagactagacatcaaagaaacatacttcagaataagagccatctacaacaaacccacagttaacatcatactaaatgagccaattaaaacacttatctttataaatgacccagtctcgggtgtttctttacagtgcgagaatggactaagacagcatccaaataggaaaggaagtcaatccgtccatcttcactgatgatataattctatatctagaaaatcctaaaaactctgccaaaataattctagaataaacaactttagtaaagtgtcaggatacaaaatcaatggacaaaaattaccagcatttctataagccaaccacatccgagctgagagtataatcaagaacacaatcctattcgacttacagtatccacaaagaaaatgaaatgcccgggaatacagataacaaagtgaaagatccctacaaggagaactatgaaacacagcatacataaatcataaatgatacaaataaatgggaaaacatttcatgctcatggattggaagaatcaatattgtaaacattgtcataatgcccaaaggaattcagattcaatgctatttacataaaactatcatcatcattcttcacagaatcagaaaaaaatctattctaaaatttatatggaaccaaaaaagaccctgaatatccaaagcaatcctaaggaaaaagaataatgccagaggcatcatgatactgaccttaaactacaccataacgtcttgctaacaaaaacagcctgtactggtacgaaagcagacctgcaggaaaaaaaatagatcaaaatagaagacagaaataaagttgcacacctgcaaccctttgatctttgacaaagctgacaaaaacaagcaatggaaaaaaaaaactctgtgttcagtaaatggttctgggataactggattctggcaggtatgcaaaatgcaagagtgaaggagcctgtgcagcttctacctagatttcagatgtgtagagagccctgcatgcccaggaagaagcctgctgcaggagtggatccaccacagaaagcctctactagagcagtgccaaagatggggaaagatggagttggagcccccattcagagtccccactagggcacttcatagtaaagttgtgggaatgtggccacaaccctcaagaccccagaatggtagagctacgggcagcttgcaccctcagcctagaaaagcttccagcacttgactctcacttgtgaaggcagccccgtggtctgtgcctagcaaacctatagggattggctgcctgaggttttggggacccaatccttgttccagtgtgccctggttgaagtacataaagtcaagagagattattttgtagcgttaggatttaatatctgcagtgctgggttttatatgtgtgtggggcctgttggttgttcctttggccaatttatccctttgggattggaattatttacccaatgcctgcatcatcattgcaccttggaagtaaacaacttttattttttaaatttgcaagctcacagctggagggacattgccttaagactcagatgagactttgaaaatttgagttggacgttgatgaagttaagattttgggcactattgaaaaaaggtgattatattttgcaatgtaagaagaatatgagaactttgggtccgagagtgcaatgatataatttaggggttttcccctccaaatatcatggtgaaatgtgacccacaatgttggaggtggggccaactgggtggtttgggtcatggggaaagatttttcaggactggcttggcatccaccccatggtaattagtgaattcttgctgtattagctactgtgagatctgattgttcaaaagagtcttgcaatcctgctaccctctcatgtaacccctcctcacaatatgacacagccttctccccctttgccttccaccatgactgtaagcttcctgaggccctcacaagaagcagatgctggtgccatgcttctcacacaacctgcagatctgtaagccaaataagcctcttgtctttgtaaatcacttggcctcaggtattaatttatagcagtgtaaaatagactaatacactgcccaaagcaatatacagagtccatgcaatttctatcaagtaactaattaattatgtatttttaaaaatcctaaaatttatatagaaccgaaaaacactctgaatagcaaaagcagtcctaaccaaaacgaacaaagctggaagtaccacattccctgacttcaaattacacagcacaaagataataagaaaggcagcatggtagtggtagaaaaaaaatcaagagcccagatatatagccaaatatctacaaccaacagttctttgacaaaactgacaaaaatatacactggagaaacaaccctctattcaataagtagtgctgggagaattagatagccttatgtagaagaataaaatgagacttctgtatcatcatagacacaaattaactgtgaatatggattcaatgtttataaactcataaaaatacttgaaaaaatctaaaaataatcctctggacattggcctaagcaaataaaatatgactaagacttcaaaagcaaatgcaatgaaaacaaaattagacaaacaggattaattgaaccaaagatcatctacacatcaaaagaaagaaccaatatggtgaacagacaacctgtgaatggtaaaaaaaaaaaatgtgcagtctattcatcaaatatatagaatctacaagtaactcaaataagtcaactagaaataacaacttcataaaagagtgagcaaaaacgagatatttctcaaaagaagacatacaagtgttcaacagaaataaaacatgctcagcatcacaaatcatctgataaatgtaaattacagacaacatgatatagcatcttccaccagtcagaatggctattaaaaataaaacagatgtttgcagagaagcataggaaaaataatgctttttatatgcttgatgagaatacaaattggtacaacctctatgaaaaacaatacagaaatttctcaaagaactaaaattagaattaccatttgacccagtaacccctcctggtgggtatgtttctcccaaaaggaaacttctatataagaaaaagtcacctgcattcctatttttattgcaacactattttcaatagaaaagtcaagtaatctctctaagtgtcaatcagtggatgattaaataaaatatgatagatgtaaatcatggaatactatgcagccataaaaaatgaaattgtgtctttcacagcaacatgaatagagttgaaggacatttcctaaataaaataactcaaattctcttttataattggaaagcaaacaatgggtacacatgtacatagagaaaaacaatagacactgggtactgcaaaagaaggcaaggtgagaggaaagtgagggttaaaaaatcagctattggctccaatgttcactatggggtaacagttacatcagaagcacaaacctcacctttatgaaatatattcatgttacaactctgcacatgtgcaccctgattctatgaaaataaaaacagaaaacatgaacagaattgttagactgctagctagattgaccaacaaacaagaaaaatgcaaaagtagcaattctttgttttgtaaccctttctcattttctggtaccataagaaattgtagactatcgtcctatattcttttctgaagtgctaccattagccatttctcaaagaaattctggttccttttttcttttattttctttcattttttttagacagagtctgcaacgtccacctcccaagttcaagcgattctcctgtctcagcctcccaagtagctgggattacagacgtgcaacaccacacctggctaatttttgtatttttagtagagatgaggttttgctatattggccaggctggtcttgaactcctgacctcaaatgatctgcccacctcagtctcctaaagtgttggaattatgggtgtgagccactgcacccagccgctggttccttttacagaagaatagtattaaaaactcatatcttgattcttgatgtactttttgttaatttcttgtagaacatctcaagtaatcaatacaggaagtatttgttgtgtattaacccatatatatatatacccacatctaaacggtttttatttatgttcctatattatgctaaacttgcaaatccactgagataccctaagttaataccacatgaatgattttcaccttccttctatgcctttccctaacctagcactccaaccgtggggaaccccctcccaccacacaccatccattccctttgtagtccatttccaggattcctgtagagtggaacccgattgtgtaagttgtgctcttttgtggaacatcatcaagtggagtccagtgctgacgtgcagtttcttttttctttaatcttatggactacactatttctgaacctacttagtacctcttttgatttcatacattagtataatggcataagatattttctatatagtctgcattccatcctggaattcctaatcacctatttttttaaaatttcttgtggattaagattgtattagtcagtgtcccctagagggacagaacaagtaagatacacatacacacacacacacacacggagtttattaaggagtattaactcacactatcacaaggtccacaataagccatttgcaagctgaggagcaaacaagccagtccaagtcccaaagctgaagaacttggaatccgatgtttgagatgaggaagcatccagcaggggagaaagatgtaggctggaaggcgaagccagtctaatcttttcatgttcttctgtttactttttattctggccacacttgcagctgattagattgtgccacccagattaagggtgtatctgcctttttcagcccactggctcaaaggttaatctccttcggcgacaccgacacagacacacccgggatcaatactctgcatccttcagtgagatcaagttggcactcagtatttagcattacaagtccaccctttgtcaacttgaacccatacacatctcctgagattatacataatcttcaaataaagacaagaataaagtcataattatgcctaataatacaattattcttcttacaactggaaacacaccaatccccaatccaaatggtactacatatgctccactccctcaaggacacagccaggatcatctgatgacttggtgtctagatggcttcagcacttttaattttacctccaatgttagactccactttatcaatgcagatgtagcagaatattttaagacattgatatgctgaaaaattcaacagttcataaaagttgccttcccaccacagccagtggttactactgaataaggacctgccatcctctagggagaagctataatggatggggtgcactgttggtggttatggaaatcgatccatcgtggcaaatggcagcatctttctttgataacattatattctattgtgcatatataccacattgtctttattcatttgtctatctactgacagattttttccatatgtttgctgttattaatagtgtttcaataaacataggatgcagatatcttcacaaggtggtaatttcatctcctttggatatactcccagaaacaggattcctggtcatacaatatttctggctttaattcatttaggagcctttatactgctttccataattgtgaaaatgtagaatggtatagccattatgaaaaacagtttcagttttgaggtatgatctgtaaacaaataatgtttgttatggctctcaatgagagtttctactaaatatgatggaaggtcaggaaggtctctcaccttaaagcagggatggattatgcctcttatttcctaaaagcaaaagattggaagcatgcatgatggaggtggttggcaggtttcaggatgatctcataagaggagaatctgttggataaaactgttgggttttcagtcatagacacacctacactcaatatgaaatgatgaaatcaagtgaggatctagaatgtgttcgcttgaagcaacagcatattctcaaaggcacctattgctccatcacaagggtgatgaacttttgaaaccagtaaagtgtgagagcacagtaagtgataaagttatcacatttacatgaagtttgtttaatgtgccaagggctcgcacagattaatcataaataaacacaatgtattttagcatacatagatgtctagagaagaatcttcttagagaaacttcttcaggttacagaaatctgtgtaagttgtagatctaatggagaagtgtctatgaatactggtctgtttttgaagtatggaaagatgatctcttttggagtaggcttgcgattgtgttgatttcttaattgtttcttgagttgtaacaaaagaaccaaaaaaatgactaaccggagtttcatggctgtgttgataaaaatttttcataagctttctgtcaattatttgagaccagatttcctgatttttttctccaatagatacatgttcacaagatctcaggaaaccacctctcaggtgctttagtttaaaagactagcttcctagaaaaagaagattctgtctaaccatgacaagttggtttcatctgcaaaccatcaagtttgagacctcattgtcaagaatcataaaaattttaactccaatgtactgaaaatcataaatctcgaatttaatgttgataggcattgacaaaatggttcattcttggatgcgtcctatgttgctggctcaacatatcagttaattgagaatcctcacttagctccctctgtttgtagcactgagttgattgtcaatcttcagagtcatccgttgaaggagagtcctgaggttcatgggattcttgtagacactcaggggaacaaaagaaagaaacagaattgagggctgccagccatttccacatcactaggaataattaccatctaagtataaaggtctgcatcattcagaacaccctgcatgacaggctgatgcaaaaaatccaaccctacagaggctccacagcaacctttacagttctttccgggaagaaataatctccaagttaagtgagtcagtaaagctgctctgagctacagtaaaaattggattgggcccgatttgtctgagttcagtgtaattattatactcagctgctgccccaatatagactgaggatggataatttaaatgagcctggctatgtggtttgttatatatctgaactaaataaacataaagggcctgtctggactagcgtgagggtgagagatcctgggagccccagccccccatactcttatctcccttcctccaggaacctctaggttctcagggtgagaatccacaagatccattcatggctctattaccaggagaccaaaatctctgaccttgttcatacagacaaacaggcgaaggacatttttagatccttatctatgtggcgaaaggcaatctatccccattacaagccttaccagcaaccttcctttgtcatgaaaatgggtaaaattagccaataggattacatttaagaaaattttcctgtgatgttccagccagaaaacagcaaaaatcagcttcacacctggagacttcttgcatcggtcacagcccagagaaagaagatcaccatagcattaaaatgcaactgtaagaacatgtaatgcttccatgttccacgcattacgtctcaccagtttagtcaatatggattaaatatgagagtgtggcaattcgcaaactctatctgaggaggaaaatcggataaaaaatgttatgaaaaataaagcaatttgaagcctctgacttcagcaacttcaccactaatgaaatgatgtaaccctcattggcctcaaatttagttttcacggggcatctgcagggttccaaagtgagaccaggtgaattcaatgtgcatgcacttcccaagtgtccacttgtattctgtttctttacttctgtttacagaaagtagacacatattcagtcttagtaccagtgtagggagcgctttccatgagatggataccagaaaaaaatggcaaacatgggatccgttaatataaaaattagccacgatgtatatatatatatgtgtgtgtgtgtgtgtgtgtgtgtgtacacacgcgcgcgcatgtgtgagttgaatagcagagttggagtgggtttctatccacatgtacctgcacctgcaggtattctcaggtgccataatcaactgtaggaccctaaaggaaataagagtctcccctcaacccctgaagagtgtttgggttcaccgtgtgtccaatgattctgtgcctcttgagctccaggaaagggctccctggtgatgcatgagatcttttcttggagtctctctgcagagttcactgggtttcctaaaggcaattcactatttcaaaagatggtgtgaggagcatgtggtgtccctaaaggagaattctgagccagggcacaaccactttatactgagctggatacactggtaggaatatactctgtcagctcagatagaaacctccctgcatggttggggctgggctgcagggggcgctccggatacacccagcacaggctcccgccccagagcaggtgcacaggaggctggggagaggttcctcccagggcctgggacttcctttaaaaatatctaaaataagtatttcacaaagactgctgaagtttgtataaatatctattcaattgtgagcatttatcaaactggatgttgtaatgagaaccacttttacaatggggatttcaaactctgctggaggtcaggaagagatcctttcttataaataaatgcaatttttggataaacacagtcattccctaaataacgcattcacatattatggtctagaaatgatgcaagttgaccctgagacagtcaaatgtggtttcaaagtgaggtgctgtccttgaggagcttgttctccagtgggggaagctctgtcaacacagagttcagggatgtgtaggggacacatggcctctaacaggattacggcttgaaccctcagcttctacagttgtgtcacccatgtgtctgtttctcatactgggtcaggaattgggctattaaatagcatccttcatgaatatgcaattaactgaggtgactatagtatctccgttccctgagagcctcacccaacaaccacacccctcctctggagaagcccctagatcacagctcctcaccatggactggacctgaaggatcctcttcttgatggcagcagcaacaggtaaggggctccccagtctcagggctgaggaagaaaccaggccagtcatgtgagacttcacccactcttgtgtccactccacaggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgcgaagtacacagtgtggaaacccacatcccgagagtttcagaaagcctgaggaaggaggcagctgtgctgagctgaggcagtggtacagcagttttctgaacttccatagtatctcattttgcattgagttccgctttaatattagccaagaatatgggatagacgggtgctcctaagagatccttaacttgcccattttgatgggttttcccaaagacgtgagaagccacttttttcgcaaagcatcccaaagccatgccctgctccagaaacacgtgtatccatttcctggtctttgattaactgacaaactctcatcagcgcacctgggctaatttcacatcaggtagaaatatgtgctttaaagcaaggctaacgttgtaatagcaattcctgcttaataaccttcagcattgttgttgtgtgctccatcaactaattacgttagttcaaggttctcaatgggagtttctaataaatataagggatgtatagaagttcccctaattaaaacaattgtgaagacaacctcagtgttcaaccatatttcaacccttcaccacaaaggaactttcatctctcctggaagttgggttcattttcaaattagtttttttattttaatatctcaagattattgtatgtgactattttagcagaaagtgaattatgggaacttgaactaaccaactgaaaatacattcagaactaattaaacaagatgccagaatgtgattggctccaggcattttaaattcaacaggttatgtaaccaggctttaaatttgcacatcttcgtgttaccttcatgacacagtcaactcccattatgtaagaaatggtgagtgcattcccaagggtcttgcacagttataaaaatagacttgatgaggtgaggagttgtttaaattcccctctgaagaagcagcatcaacccaacaaaccactctcttccctctgtgactagagctctgtcacaggccacatggacctaaatccttgatggagattacaggactacgtaaattggactgatcgtttttatgctgttaaattaataggtgagtctgcactccagcctgggcaacagaataatcttgtctgtaaaatacaaaagaaagataaattaatagatactgactttgacatttcggataataatattttcataaaccgaatttaattatacccacattgttacctacaccttcactgaaaagttcctagttatgttgagttccatcaacactccacatgttcaaatctggacatccaagagagtctagagaataaaacgcaatgagggcagtgaaacttgcgtatattcagcacctcttaactcaggaggactcaatacaccctggaacactctgcttttctgaatggctcacaatgactccagctcactctccaacctcctcaaacatctggcctctgtttgccctaagttcacgctctgctcttagtctatgttctgaagtctttgtagaggtgaaaatgagctgtcagatggatcttccttctcactgcaacatggaatttgctatttcacttaatgaccactctttccacaatggttgatttcttttggcctgttcattactggtgattttcaagggaatctcagttgaatctttactgttttgcattttgtctccatgacaatgttgggaagtttttcttctagcagcataacatgatctagtgacctgacacatttgcagcaaacaatacctacaaattcagaagctctttggttttctttccacgaaatataattcttgctcttctgtgtatgagcacatcctagcatccctgtacacacccacgtagatgtctacacgccgatgaaatattccctgtaaataaaaaaagtatctcagtttctctcaatgttcataattctcctgagggtgaggaaggtacttctgggtctgctcaaacaaatggcccagagaccacctggtaggtaggtaaggagctcacctcgctctggatattgagtctgtctctttccctctgtcgtctcatagaaggccagcccacttgttcagctcctaagaagagagcccaggtttatccagattatacaacacaaccagcttctgatgactctcctgttacaacatccatggagatattttgtgtattatataattcaccaaactaatgtgaaatgcccaagttgcaatactgcacaccctagggtatgttcttgcaattcagcggaggagaaattctttcagagacagatggatctgaattggtaaatatgtgggtacgaattctgggcttgagtgtcattgtccagccatgtttcacaggtgtgacctgtcagggaagaaccagagttccttgttctctcagagggtagagctcacagaggtcctctctggttcccaggaaaggtaatttcactaatcttggtgatgagactatcctccagtgctgatgtactatagagttttcatctgaagctgtcactgctatccccaatgtacatcttttcacacagaaatgtttagaggtcaggccatattctcagggttacacattgagaaggatggagatatattctactaccttctcctgagatctcacacacaatctcaaatttcaaaaggtctcagaagggcagctctcaggtactatttaaaaataacccacttcctgggacaggtagcatccttctaaccatgatggatgttctgaactacagtacacattgcatggatccaggtttgtctcaattcactgtgattattacactcagcagctgtttcaatatgtctgaaggggtaaatgacaatttaggtgacctgggtgtatggttggtgttatatgaatctttaaatgtagaacagtattaactgtattccaaaatctgtctttgatccatgatcacacttgtctcccagaccagctccttcagcacatttcctacctggaagaagaggactctgggtttggtgaggggaggccacaggaagagaactgagttctcagagggcacagccagcatacacctcccagggtgagcccaaaagactggggcctccctcatccctttttacctatccatacaaaggcaccacccacatgcaaatcctcacttaggcacccacaggaaatgactacacatttccttaaattcagggtccagctcacatgggaagtgctttctgagagtcatggacctcctgcacaagaacatgaaacacctgtggttcttcctcctcctggtggcagctcccagatgtgagtgtctcaggaatgcggatatgaagatatgagatgctgcctctgatcccagggctcactgtgggtttctctgttcacaggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcacagtgaggggaggtgagtgtgagcccagacaaaaacctccctgcaggtaggcagagggggcgggcgcaggtactgctcaagaccagcaggtggcgcgcggcgcccacagatcccgaggccgggtccggagcaggtgcaaggagggcggggcttcctcaacagctcagtggtctgtctcctcgccagcacctcagatgtccccaggactctctttctttattatctgtggttctgcttcctcacatccttgtggcagggaagaaaggaggaagacaatttttctgtttactgttgaggtttcaccaattactagaaactttcctacaagttcctgcatgactcattttgccatatatggattctcaccatctcttgatttgtttcatcaatcgaattgtgccctatttgaaattaacttactgaaaccttaaatccaatggatctatactggaattttaatgatgtaattgaggttaaatgtggtcaaagtgtgagaccctaatgcaataaaccgttgtctttataagaagaggaagagacaccagagacctctcacttttcacgtgcacacagagaagaggccatgtggagacgtagtgcactagaaggtggccctgtgcaagccaggaagaagccatactaagaaccaattttgccagctccttgatcttcgacattcagactgtagaattgtaagaaaatcaatatttgttgtttaagccacccaatcctgttgtcttcttacgaagacccaaactgactaataccacctaactctgttagctctgtctcctggagggagaagcagccccctgaggctgggcactgcatctctcagatttccacgtgaagtaggcaaaaatagtagttctcatataaaaatgtgtcatggctctgttggccatttttgagcatggtctctgaaaccagccctggtgtgtgtgtgtaacaaatgtcccttatcttttatttggacataacaaatagacgataggtaccagctggatggagattggccactgatcatcttctgttctccttagtatgtcacagaaaaccacaccaacatcaccagcatcactgtttttcttctaccacctcaaacggactacagaaatgatccctgcagtatggtctatttcttcggctttcgaaatttgcactgaatctcttcctaaatggggagctacatggggtctgagttttgttcctttcttcccagtcttccccaagtaccaaggacagaatagacttaaaatttggccatcaatgcccccaaacaccacatcactttctaaaatccacatcctgcatccatccttctctggacacccctcatcaggctacccaggaatggccagaatctggtatcagcttatgggctgaggccacgagttatacacatgtgtgatttcagtcacacacactctacttcaggaccacacctgtgttctgaggagctcaggcacctgctgatctcagtaattctctaataaatcacacacctcttattaataaaggtccagatggccccatcagctgcagagcagtggagtaaagctcatgggtgggtccatcaggcagaagtcagacaatggaagggatggctggtcacttccattttcactgatgttcgcaatgaattttaatggaataaaacaatattaactacaaagagacagaaaagaagactggctcgtcaagatatttaaggacaaggaactttatttggggggaaagtgaaagacacttctaaatggaaatccctaaagcacatacagcagctgacagagtggccactgtgcacatgagggctgaggagatggatggtagagtccattcctgcaacatgtctctgggtgtgtgatggttagactcctcatgcatatgaatataagagctggactcatggagaaaaaaagggccatatcccataggaaaggaagaaaaaaaaacagatgggcacccctggagagagctcattagatttggtgtgtttaagatgaaaatttcttccaaaaattgtaatgttctaagctaaatatgaatctcttcaataaactgagaataggagaatggagctaggacttgagagaggaaacaaatcttgagagagcagaaagcaaatccacaaaaactgtcacatgacagaggtcagaatggagctgatgtagctacttcactattctgcagacttattgaccatgtggagaaggggcttgaacaaatggagacgttctccaaccttctgaatcagcctccttcttatgcatgagtagaaatcatagttctgggggtgaccttcccaattttcctgtccatacctcttcccccaggggtagagtgtcttcccaaccacaatggtttctcaccagtgttctcagcttctcctccattgtacttaccctgcagattaagaatttcttctagatggagttctttgggaattttctgttttctttagtttctgttgactccaccacacccccataggatacaggttttattggatttcccctggaaatagtgggggtggatccaggcgttcaacagtcctcgctgttcttcccttcctgtcagcaccacaggacagcagataagggagttgactgtggatttttcaaattcctgggaaaagcctgcaaggactagtagattcacactctaataccattagcacatgtatccaaaaagaaacctcactaaatatttccaggttagcctgttcctctctcagtgccatccagtggcacctgccctgggttcacgaacatgtgggccccagtcctctctgctggcatctctctcctcacatttcagtcttctcgttagctctgtgaaagcagctcagatatgttaaaaggttttcttcttcatttattcagtttttcaggtttactgttaaggaggtcagaataagatcatagtttcctcatttttcacatttgcacgctgagtagccactttctatataaaagccagaaactaagggaacaaatcaaatatccatatccactacaggtgaacgttaaaaaatttgacatatgattatggactaaagtacaatgcagaattagaatcaaggcatcctcattctcataaaagcatgtctacattctcaaataactctgctgagtgaaagtagctgaagaattaagagtgcacttcataaacttctaattgtataaactgcagaaggtacaactattctaaagtaacagagcagatttgaaatttgggagaaatgggtgttgaaagtaattgggtggtgagatgaaattacagagaagtgacagaaagatttaggggttaacttaattgtacacaacctgattaaagtttgcacacatacgttaccattttccaaatggtgcagtgtagatttgaattaattattaattgtacttaaagcagtaacaaagaaacaaatgaatatgttggttgaggaggagcaaaaaatagatgggtatgaacactcaaaacatctcagactcttgaaagtacacatgcttgaacactggttttctctgtatactttaggtaaagagcagaatacattaaaagaaaacagagatgtcctggcgggggtggaatcctgcaaacctcactaggcgtgtcccacactgccctggagttgtctcaggggagcagtctcctctagtggtcagagacacaggcatggataatggggctaatactgtccagctgtgtgaccttgaacacattgtataaacactgttccatatgtaatttatcttccttaaaatgtaacattgacacttgcattaaatgtattctacaaatatgtcaaaaagaagatgacgactgctaaatgattatcaaggcacaatcatataatataatgatattttcctgagtgataagatgactaccaatctcccccagggcactttgtttgctctgagccctgcgcctcctcaggattcccatcccagagcttgctatacagtaggagacatgcaaataggtttctccctctgctgatgaaaaccagcccagtcctgaccccacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgtatgtgaggcaccaggtaagaggacatcagtgtgaacacagacacagtttcctgcaatgacaagggaggaggctgggctaaaaggggcactcaggacccactgaaaacgggcagctctagggcaggtacagatggttatcatgggctgctttccttcagggtctgtggcctcctctgcatctaccagttcccctcggagcctctggacatttatgtttctgtggccacccctgacatctctggattagaaaagtttattataggaagaggaaacattctcatttgtcccaaagcagatgtaagtaatggaagcaaaaaatgcacaggaggccaggcggggctgtagatactgtcaccccagaatgtcaatctcaccactagtactggagagggaagggagtttgatggaccttccctaacaaccctgtggtccaagataagtccaggaagaccattggtgcctcccagagcacagttgtccatcagggatgtccaatgcgtcccagcagcagccatgcctcagtgtctccactgtgcacagccactgtctgggaggagctcccaggatgggtgtctttggcacacaccaggtggcgggtgttagagtgcagtgcagcagctggctgcctgttctattgggctccctgatgctggagagatgggaggtgcattcgcagggccagcaccctgtttgtgaatttttatataaaaaccctgattttacttcatttttgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctggcacaatcagagcctgcagagacccccaggtgcagcttcagtgaagtcagacatttctccatgtgggcgacctccagtgcctgtgactgctgctcaggcctaattgttggttaagtattacgacaccctttaggtgatcacatctcaagcctattctgaaaatcaccatgaacagagatagttcaatggccattctcctgacataagtttctctttattacttggttccaagtatggagaaaaatgtgaccctatatttgtctgaatccaacatcagcatccacggcattacgctaggagactcactaattgagcacaagtgagctcgttattctcatagaaatgtaagtatttggaaatttcagcgtgttctccagaacctgtggctgccaacaactgtatttctcggtgcactcttggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaaagggtgcttggtacagcagggggctcaggattattgtggggattcagaaagagcaggttcaaggctcaacctcagggcatgtgcagctggtgtgaaaaggggctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctatgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtgggagtttcaaaccctatcaacccccctataaactgtcattaagaaagtttatcaaactccaccagtcatgtgatattagttcgttttcacagtggtataaagaactacctgagacgaggagtttacaaagaaaagaggtttagttgactcacagttctgcatggctggggaggccacaggaaacttataatcatggtggaaggtgaaggcgaagcacggcacatcacacagggcagcaggagagagagggggaagtgacacatagttttaaactatcagctcttgtgagaactcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcgcaggaaaatctaaaatggcttgaaagaagaggaaaggagactggctcagggtttttataatggtttagtggtggtggcacagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagcgacaacttattctaggtagcaagaataaaaataatgaaaaagaaataagggttcagtatgggtggacaagacccagatctacagaaatgagatgactttagaaatataaggaaataataatgagaaaaagaaggaggggatggggaattagggtcctggcctaatgtcttgggtagaagcttctcacaatcaaggactatcagcttattctgcaggtcttgggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgagctccggactcacgtaatcttcctgtattagcctcctgaatatctagaattagaggggaacgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattcttcagttgtaaaacatgaagccaataattaactgcctgactgttttgtgcagtgagttagttaaaagtttctgataagattccttccaatatgattcaagagcagtattttctgctgatgttcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagtttacattttattaaaattgataatttttatgtagcgatgccattttttaaacattcccagaaggttgtgagtgggattgactctgtcttctgtgaacaatgacagtgccctccatggttagataatattttaaactagattgagctagagtggtttctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacctagcactttgggaggccgaggtgggtggacccctcgaggttgggagtttgagaccagcctggtcagtatggtgaaacctcatctctactaaaaatacaaaaattcgccgggcatggtggtgtacactcgtaatcccagctacttgagaggctgaggtgagaggattgcttgaaccctggaggcgggggttgcagtgagccgagattgtgccactgcacttcagcctgggcgacacagcgagactccgtctcaaacaaaacgacacaaaaaattccaaagttgtgcaccctctaaaagcatatgtacttaattctcatttttaatttattaaacatctctaataagttcaatgtttcctgccttctgagttgatttcctaacacatagaagaatatatcctaaatgaaagtttgtgttcttaatacaaattactagttaataacctttacttttattattgaggtattatacatcaatgttaatcaatcctctcaatgggactcttacctaaagaatatataaaatattttcctgatcatgacatataatagatgtgaacacattcttagcattcagccatgtctcttgtctattaatattataaaccacatgctaactttgattttattggtaattgttctaatttcttttttttcccacttctctggttgttttttttttaactttaagttttagggtacatgtgcacaatgtgcaggttagttacatatgtatacatgtgccatgttggtgtgctgcacccattaactcgtcatttaacattaggtatatctcctaaagctatccctcccccctccccccaccccacaacaggccccagtgtgtgatgttccccttcctgtgtccatgtgttctcattgttcaattcccacctaggagtgagaacatgtgttgtttggttttttgtccttgcgatagtttgctgagaatgatggtttccagcttcatccatgtccctacaaaggacatgaactcatcattttttatggctgcataggattccatgatgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagggataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcggcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatttccaagccagcctgttccgatcttaaatgccatccagtggcatctgccccaggtacactaatacatgggtcctgcttctctctgcagcctcctctctcctcagatttcaggttttgtttattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaattaagagtaaattttacatgatacatttgtagaaattttagaagatgccactattataaattaacatggagaagatttaaatgtttctgagaatatgctattgggagtaatggggatgtgagttaaatttcagaggaataagagaaagatttagggattaattttttcaaaccttgattgaagtgctgagtaaatggttgcaaacataggtctacatttttcaaatcattcaccataaatttgaattatttattaattacactcgaataaagcaataaagaaactgatgagataatatttgactgaattgcatcaataaatagatcgatattaacacaaggaatataactgatttccaaaaacatacacatgaaccatggttcactctgcgtatttagataaattacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagacacagtgaggggaggtcattgtgcgcccagacacaaacctccctgcaggaacgctggggggaaatcagctgcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgattcttctccaatcagacccaggacagggacctccgtgagattccctgactggaacagtctttatggatcctggtcacagacaatagagaggctgaaccagggtcagcgtcatgtagaacgtcacagatttcacgtctgatccttctcctgacacgaaagtatgcaaatcagtatcagcaccgatctggtgcttcttttgttcctaatccatttactttcttttttcgtcgtttttctcctttttccatttgtttttcctgctttttgcaaaaggaagatgttttccctgtgagatgcaggggatgacaattttgggagatggctggaacatccaatatcctcagggccgaccatcagtaagtgcaggctagaagtctcagaaagagctgaagctgcttaatcaccgtggagttttaccttctccagttctgctctgatggaatcagggccaagcaggttatcaatgataatctacctaacatagagtcaactgattccagtttcaataacgtctgttaaaaattcacaccaccacctggattactgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccattttgacatgaaaactttttcagatatatggcatattatccaattctgtaagttgtagttattttgttgctttgcagaatctttttcataatctattcccacttgttcaattctgcttttttttgtaggtgatttgaatgtaaaatcctgaaaaagattgctaattttttgagtgttgagagttttacaattagaggtattacagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagcttgtcatcaatatgtgggtttatatctaagctctatataggtatttaagccaaaactttctatgtttttaataaatgttgaggcctggaagtgaaatgcctaaagctttcttcttgccttgttacagatattgtaccaaaatattctaaccttttactattgagtgtaataatagctgtggcctttcttaacggcttttattatgttcaagttgttttcttgtcttcctactttgttcatagttttaataatgaaactgatttttttcaaagtctttttctgtgtctgatgaaatgttactgagatattttttctttagttttttaatgtgtaccaaactgattgatttgagaatgttgaatcaagtatgcatctcaggaagaaatttgagttggtcatggtgtatgtcttctaaaacactttggagcttagtttactattgttggggattaattcatgtctactaatgatattggtctgtagtttcctttattgtggtgcctttgtctattactggtaatactatcatggtagtctcatagaaagagtttagaaggtgtatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttacctttcctatttatttttaagtttgtttttagacatatgcaatacattttgaggtgaaacctggtggaattttttccaataaattagtaaaaataaatcatttaattgactattttattcaggttgatttgtttaatatttgctaaaggccagttctttaagctatgacacataataaatcccaaatggcagtacctcattgtttacttagcttttgtacttatatttttcagaggaagaaccactactgtaaattgtaaatagccaatacataattgtattgtatgcaaatctgtgactgtttacagtgtcatctctgagaaacataaagtttatttactatatatatataaagagtttggaaggtggactccaccaatttttgaaagagttacagaagggctgctattacttctttaaatgttaaggttcattttatgatgtaacagataacctatcatggagaatgttcaatgtgttcttgagaaggatgtgtattacgtgactcttggttggaaggttctgtaaatatcattcagataaatttgttcaatagtgttgttcaagttcagaggcacattgagaattttctttctggatttgctaaacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaagtcctcctggagtctgacgtctgctctgggcactgccttcttctcaggcgtcccacactggagcttgctatagaggaggaggcatgaaaacagggccctccctctcctggtgaaatcaagcccagacctgaccctgcagctctgggagaacagccacagccctgggattcccaggggtttccatttggtaatcaggactgaacacagagaactcactatggggtgtgaattaagctgaatttttcttgttggtattttaaaaggtgactcctagggaactagagtgagtgagagtgagtggatatgagtgagagaaacagtggatatgtttgccagtttctgaccaggatgtgtgtgtattttcaggtgttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacataaggtcccaagtgaggaaatatcggtgtgagtccagacacaacatttcctgcaaaaagaagaaaggagtctgggccgaaggggacactcagcactcacaaaacaggtgcagccccaaggcaggtgcagatggagggagggtaagggctgctttccttcagggtctgtggtttcctctgcttctaatatttcccctctgaacctctgtatatttatgttttgtgcccaccatgaggtccctggattagaaaactaatttaaaagaggaaatattctcatatgtcccaaaaacagatgtaagttttggaggcataaaaatgcataggagccgcgtgagtctgtagacactgccaccccacaatgccagacccaaaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcagtatctccactgtgcacagccatcgtctgggaggagctcccaggatgggtgtctttggcacacacaggtgatgggtgttagagtgcagtgcagcagctggctgcctggtctattgggctcctggatattggagggattggaggtgcattctcaaggccagcacgctgtttgttaatttttgtataaaaaccatgtgatttaattcattttctcagatgacatagataattaataacacaatctgcaaacaattgtaattttcaactttaccccaagttcattgtttcttaattctgtgcaggatccagacatggtattgcccttctcatgagaaattgttcgacctaaactgaaaccagttgtttctcatatactttggttctccccacatgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtgggctcagaattaggacagtcttcaggttatcacagatcaatcatattctaaaaatcatcattatcacacaccgtggtaataattcaatgttcatttttctaaacagcagtttctcttttttatttggttgcaagtttgaggaaaggagcatgtgataatactttttaatctaacctcaaaatctactgaattgttctaggagactcacaaattggacaagagtgagctccttgtgctcataaaaaatgcatgtatttgggaatttcaccgtgttgtccagaaactgttaacatcaacaactgtgttttccagtgcacttctggcttgagacatcctcacagaccctctccctcacctgcactgtctctggattccccatcataaccagtgtgtcctgctagaattgtatctgcttgcccctagaagatggacaggagtggatcaggttcatgggttgtaaagggagcaaaaattacatcccacttctcaagagtccatatccagatccaagaaacagttcttacagctgagctctgtgcccagtgaacacacaactacacattttgaagcaaaagacgcaatgaagggccttcattgtgagcctagacacaaacctccctgcaggggtgaataggagcagcagggggcattcggggcagtatgggggcttagcatgattgttgggggtcaagatgagcaggatcaaggctcatcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatgtatacccaaatggaggtgcatccagttgtcctctccatcttatgtggaccttgtccatcaagggctaagttcctgtatttacttgattacctcatacattatggtcaaaacaggtagggtctcattttggcatggtctctcctcctcccttctctctgtcgcacaaaaacacatgaactgacacacacagagcttcccaacttcaattatctgatgtattgaagcaaattgattagtgtgcagcttttctgctttgcctgctattcatgttatgtaaaaataagaaccgtgtgtttctcagcttgttacttctctaagctaagtagcatctttgtttattatacccagagaccaaaagcgattcagctgttattcagcagcttaactggtaaacaaattgtggaaaattcatttactggaataatacccactgttacaatgaagtactgctggatacactcagtaccatgcttaaaataacaagtacctgaataagtaaaataagtcaaacaaataaaagtgcatacatatgattccacttctataatttctataaagtaaaaatgaacttaaagttacataaaaagatctgtagttgactggggacatggtacaagaagagaaggtatagaaaggagaaacgacaggagagcaaaaggaaatttctaggataattttttctctgttagtaaaagtgaggattatgtcactatttgtaaaattgtccactttatgtaaaggttcttatttgctaatttcacctcattaaaatattgcaaattttaaaatatctaatttggtagaaaaggtagtagagagagatgaataaaatacataaaattcagagagtcctgaatacacacatgaatggaccctgggtctcactgtacttttagggagacactagaatacaaaaacataatgacaggatttcagtacatgaaaggagcttctcagaccccaggaggcctgtccaactgcgtctgggagttaactcagggagcaggcatgtcctttggaaggagcaatgacaccaagctcccagcatccattgtagccgacaccatgccaatgccaagagatctcgactaaaattttctgtggatgttgagtgtgattatgccacacactcacaccaagtgagtatggaaaggatagttacctgcatccttaaggtgtctgctgagagcagggcaggtctctcattaaggtccaaagtggcttgatagagcagggaaggagactggctctgggttgttatcatggcttggtggggagcggggcagagcatcctacttgcaggaagggttttgtggggtttcaaggtcaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcacagtttaacttcctctatttgagtagctttacaattgtgtagagttcttaattaattaattttttttttggagacggagtctcactctgttgtgcaggttggactgcagtggtgtgatcataacatagctcacggtgatttcaaattcctggctcatagaatcctcccacctcaacctcctgactagcaagtagctaggtttccagggcccttcatctacacttggccggttcttttcattctttttttttttttttaggtggagtttccctcttcttgcccagactggagtgcaatggtgccatctcagctcactgcaatctccccctcccaggttcaggtgattctcctacctcagcctccagagtagctgggatcacaggcatgtgacaccatgccccgctaatcttgtatttttatcagagatgacatttctccatattggtcaggctggtctcaaactccctacctcaggtgatctttccacctcagcctcccaaagtgctgggattacaggcgtgaggcaccgcaactggcctcttcatttttattcatatgttccttcagcagccactatgtcttcccactgatttcttcagtttctgccttttccttttgaataaggcattattcctaagggaagtcgggaggtgggcctggacagggacttggtgcattcctctctcccgtcccagttcttattggtttctccagtggctgtagaacagcagttttgatggctttacctctgcagataatttctcttgcaatgtagtgctgatggggaggtgtgtctggatgcacttcacctatagttgctgttttgctttcccagacagcaccatcccaaggggtagagggtggagcattttgtgatgtatccccagtactgaagaaaaaggcttcaatagcaggaggaattcctcaactgtatacactctgagaatttaaacaataacttctctatcatactcaaattgaaaccatccaatgaatatgtctactttaatcgtgtgctaacttaaatggcatttggcagcctctgtgccagaaaagattatcatctgctcctgtttatttccctgcaagtccttatctctcttcagatttcagatatattgtttgtcctataacatcaaaaatttgatgtatatgtgctaatttgcagatcagtaagtttagtagctgttgtaagaataataacatatttttatggggtgcttacatctccaagctgagaagcacctctatgtgtaatactaagaaactagaaatgatacaaatatcaagaagatacatagataaaaagtaatggcatgctaatttactgtaataacatccatcatgagaatcaatacattgttgatgctcaacatgtttgcatcataagtagttatgtgcgagaagccacacaaatagaacacatactatataattcctgtataattcttgaaactcaaaactaaagcattaaatatgaaggactgactcagaatatggtggggaagaaaatatttgggaaggaggaattgtagaggaacacaaggaaacttttaagtgtaatttgtttgttcattatttggatggcttttggggatgcaaaggtgagcacgagtggaataacattttgttttgtttgtttgtttgtttttctgaagagatgtggtccttctctgtgacccaggctggagtgtagtggtgggatcatagttcaatgtagcctctaacttctggtctccaacaatactcctgcatctgccatctaagtagctggaactaccgttgtgtgccaggaggtttggcttggcttgagtacttattaaaccacacactttttgcaatatttaatgtatagtaataatgtctcaataagactattacaaatcaatgaatgaataatttgttcagtacagattcatggaaaaatagacactaacatgatgagtgtctgacatttatgaaaatacagctgcatgaaatgtgcttctctttacattcattaggtaaacacaatagtgcatacacatcacaccgtgctttcattacaggaagaaagttctgaaaatgtcactggggtgaaccacacggtgctgggcttggttcagggagcagtcaggcccagtgttgtgaccttcaaccacagaatccttaaaaaaaaaaaaaaaaaaaaaaagaggctgcctcaaagtccgcatcagttcccggactcgctatgtttctggatcgtatcagtgcatccggatctccctggtggctttagtgattccttgcttgccatgctgaggtctcgctgtagattatgttgggttttctaagaccgttttgctattgtaagatccactccctgggacagagcgattccctctaaacctgatagaggttctgaactaaaaataacattaagtgaatcctggtgtgtctgaactcaagtgattgttacattaagctgctgttccaatctgtttcctcacctgggaaaagaggagccaggacatagtgagttgaggccccaggaagataactgaattctcagagggcacagccagcatcctcctcccagggagagtctaaaagactggggcctccctcatcccttttcacctgtccatacagaggcaccacccacatgcaaatctcacttaggcacccacagaaaaccaccacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgatcccagggctcactgtgtgtctctctgttcacaggggtcctgtcccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagacacaatgaggggaggtgagtgtgagcccagacacaaacctccctgcagggaggcggagggggcgggcgcaggtgctgctcaggaccagcagggggcgcgcggggcccacagagcatgaggccgggtcaggagcaggtgcagggagggcggggcttcctcatcagctcagtgctctccctcctcgccagcacctcagctgtccccaggcctcctctttctttattatctgtggttctgcttcctcacatccttgtggtaggaaaggaaggaggaaggcaaattttcctcttacagtcaaagtgtcactaattactaggaactttcctacaagttcctgaatgtcccatttttccttcttaattaaaaaaaatatatattctaatacttctcaccatctcttgatttgtgtcatcagttgaattgtgctgtctttgaaattcaaatgctgaaaccttaaatccaattgatctatattggaattttaaggatggaattaaggttaaatgtgatcataagtctgagattctaatgcaatagatctgttgtctttataagaagtggaagagtcaccagagacctctcacttttcccgtgcacgcagagaagaggccatgtggagacatagtggactagaaggtgcaagccaagaagaagccgcaccaagaaccaaccctgccagcacctggaccttggacattcagacttcagaatggtgagaaaatcaatgtttgttgtttaagccacccactcctgttgtcttcttatgaagacccagacagactaataccacataactctgttagctcctggagggagaagcagctccctgaggctgggcacatctctcagatatccatatgaagtaggcagaaatagtagttctcatataaaaatgtgtcatggccctgttggccatttttttttgacggagtctcgctctgtggccaggctggagtgcagtggtgcaatctcagctgactacaaaccccgtctcctgggttcaggcaattctccttcctcaacctcctgagcagctgggactacaggtgtccaccaccatgccagcctattttttttttgtatttttagcagagacagggtttcactgtgttagggtggtctcaaatctcctcactgcatgatctgcctgcctcggtttcccaaagtgttgggattacaagtgtgagccaccgcacctggcccctgttggccattcttggggcaatgtctctgaaaccagccctggtgcctgtaccacaaaattttcttttatctttcatgtggatataacaaatggacaatgaggaccagctgcatggagactgaccactgaacatcttctgctgtctcctaagtaagtcacaggaaaacacaccaacatcaccaacataactgttttccttcaacttcctcgaacgaactatagaaatgatcccttaaagtatagtctattccttcaactttctcaatttgcactgaatcccttcctaaattaggagctacatagggtctgagttttgttccctttctcccagtcttccccaagtatcaaggacagaatagatttaaattaaatttggccgtccatgcccccaacaccacatcggtttctaacatccttgtcatgtacccatccttctgtgggcaccccacatcaggttggccaggaatggccagaaggtgtcatcaccttatgggctgaggctacaagttatacacacgtgtgatttcagtcacacacactctactgcaggacacacctgtgttctgaggaactcaggcgcctgctgatctcaggtcttctctaataaattacacacctcttatgaatgaaggtccagatggccccatcagctgcagagcagtggattaaagctcatgggtgggtcagtcaggcagaagtcagacaatgggataatagaagtcagacaatagtcactgaggttcccaatgtattttaatggaataaaacaatattagcaacaaaggggcagtaaagaagactggctcttgaaggtatttaaggaccaggaactttatttggggggaaagtgagagacacttttacatggaaagccctaaagcacatacagcagctgacagagtggccactgtgcacatgagggctgaggagacggatgataggttacgttgctccaagatgtccctgggtgtgtgatggttggactcctcatgcatatgaaaataagagctggactcagggagaaacaagggccataccccatagaaaaggaagaaaaaaagcagatgggcacccctggagagagctcattagatttggtaggtttgagatgaaaattacttccaaaggttttaatgttctaagctaaatatgaatctcttcaataaagtgagaattaaaagaagaatggagctaggagttgagagaggaaacaaattatgagagagcagaaagcaaatccacccaaactgtcacatgacagaggccagaatggagctgatgcagctacttcactattctgcagacctagttgaccatgtggagaaggggttcgaacaaacggggatgttctccaaccttccaaaacaacctccttcttatgcatatgcagtaatcatgattctcagggtggccttcccaagtttcctgttcttacctcttcccccaggggtagagtgtcttttccaacccacagtggtttctctgccatgtcctcagcttctcctccattgtacttaacctgaagattaaggatttcatctggatggagtttcctgggaatcctctgttttctttggtttctgatgaccacatcacaggccataggacacaggttttagtggatttcccctggagacagtggaggtgaatccaggcgttccacagtccttaccgttcttctcttcctgtcagcaccgcaggacagcagataagggagctgactgtggatttttcagatccccgggaaaaagcctgcaaggactaatagtttcacatctaacaccattagcacatgcatccaaaattaaaaaaaaaatcctcactaaatatttccaggttagcctgttcctctctcaataccataccgtggcacctgccctgggttcggtaacatgtgggccccagtcctctctgtaggcgtctgcctcctcagatttcagtcctcttttttgctccgtgaaagcaactcagatatgttaaaaggttttcttcttcatttattcataatttttcaggtttgttgttaatgaggaaagagtaagatcatggtttcctcatttttcacattcccatactgagtaactgctctctctctatgaaagccagaaattaagagaacaactcaagtatccatatccattacaagtgaatgttagacaatttgatgtatgattatgaactaaagtacaacacaggattagaatccaggcatcctcattctcataaaatcatggctgcattcacaaataactgtgctgagtgaaagtagctaacaaattaacagtgcacttcataaacttctatttgtataaactgcagaaggtacagctattctaaagcaacagagaagattacatattggtgggaactgggttttgaaagtaatggggtggtgagatgaaattacagagaagtgacacaaagatttaggtgtgaattgtacacaaattaattgaagctctgattaaagggttgcacacatgttaccattttccaaattatgcagtatatatttgaattaattattaattgtatttaaataaagcagtaacaaagaaacaaatgaatacatttattgaggtggagccaaaactaaatgggaatgaacactcgaaacatctctgactcttgaaaatacacaagcgtgaacactggttctctctatgtatttcaggtcaatagcagaatacactaaaagaaaacagagatgtcctggcaggggtggaatcctgcagacctcactaggcatgtctcacactgccctggagttgtctcaggggagcagtctcctctagtggtcagaggcacaggccgagataatggggctaactctgtccagctgtgtgaccttgaatgcattgtataaacactctgttctctgtgtgatttatcttccttaaaatgtgacattgacacttgcattaaatgtattctacaaatatgtcaaaaagatgatgactgctaaatgattatcaaggcacaatcatataatataatgatattttcctgagtgataagatgactaccaatctcccccagggcactttgtctgctctgagccctgcacctcctcaggattcccatcccagagcttgctatacagtaggagacatgcaaataggtttctccctctgctgatgaaaaccagcccagtcctgaccgcacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgtatgtgaggcaccaggtaagaagacatcagtgtgaacacagacacagtttcctgcaatgataagggaggaggctgggctaaaaggggcactcaggacccactgaaaacgggcagctctagggcaggtacagatggttatcatgggctgctttccttcggggtctgtggcttcctctgcatctaccagttcccctcggagcctctggacatttatgtttctgtggccacccctgacatctctggattagaaaagtttattataggaagaggaaacattttcatttgtcccaaagcagatgtaagtaatggaagcaaaaaatgcacaggaggccaggtggggctgtagatactgtcaccccagaatgtcaatctcaccactagtactggagaggcatgggagtttgatggagcttccctaacaactctgtcttccaagataagtccagcaagaccattggtgcctcccagagcacagttgtccatcagggatgtccaatgcttcccagcagcagccatgcctcagtgtctccactgtgcacagccactgtctgggaggagctcccaggatgggtgtctttggcacacaccaggtggcgggtgttaagagtgcagtgcagcagctggctgcctggtctattgggcctgatgctggagagatgggaggtgcattcttggggccagcatgctgtttgtgaatttttatataaaaactctgattttacttcattttcgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctgcacaactcagagcctgcagagacccccaggtgcagcttcagtgagtcagacatttctccatgtgggcgacctccagtgcctgtgactgctgctcaggcctaattgttggttaagcattaggacactctttaggtgatcacatctcaagcctattctgaaaatcaccatgatcagagatagttcaatggccattctcctaacataagtttctctttattacttggttccaagtatggagaaaaatgtgaccctatatttgtctgaatccaacatcagcatcaactgcattatgctaggagactcactaattgagcacaagtgagctcgttattctcatagaaatgtaagtatttggaaatttcagtgtgttctccagaacctgtggctgccaacaactgtatttctcggtgcactcttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaactatgtgaggaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaatgggtgcttggtacagcggggggctcaggattattgtggcgattcagaaagagcaggtccaaggctcaacctcagggcatgtgcagctggtgtgaaaaggagctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctgtgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtggttgtttcaaaccctatcaacccccctacaaactgtcattaagaaagtttatcaaactccaccagtcatgtgatattagttcgttttcacagtggtataaagaactacctgagacgaggagtttacaaagaaaagaggtttagttgactcacagtgctgcatggctagggaggccacaggaaacttataatcatggtggaaggtgaaggcgaagcacggcacatcacacagcgcagcaggagagagagggggaagtgacacatacttttaaactatcagctcttgtgagaagtcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcacaggaaaatctaaaatggcttgaaagaagaggaaaggagactggctcagggtttttataatggtttagtggtggcggcagagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagtgacaacttattctaggtagcaagaataaaaataatgaaaaagaaataagggttcagtatcgatggacaagacccagatctacagaaatgagatgactttagaaatataaggaaataataatgagagaaagaaggaggggatggggaattagggtcctggccgaatgtcttgggtagaagcttctcacaatcaaggactatcagcttattctgcaggtcttaggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgacctccagactcacgtaatcttcctgtatcagcctcctgagtatctagaattagaggggaatgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattctttacttgtaaaacatgaagccaataattaactgcctgactgttttgtgcagtgagttagttaaaagtttctgataagattccttccaatatgattcaagagcagtattttctgccgatattcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagttcacattttattaaaattgataatttttatgtagggatgccattttttaaacattcccagaaggttgtgagtgggattgactctgtcttctgtgaacaatgacagtgccctccatggttagataatattttaaactagattgagctagaatggttgctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacccagcactttgggaggccgaggtgggtggacccctcgaggttgggagtttgagaccagcctggtcagtatggtgaaacctcatttctactaaaaatacaaaaattcgccgggcatggtggtgtacactcgtaatcccagctacttgagaggctgaagtgagaggattgcttgaaccctggaggcgggggtcgcagtgagccgagattgtgccactgcacttcagcctgggcgacacagcgagactccgtctcaaacaaaacgacacaaaaaattccaaagttgtgcaccctctaaaagcatacgtacttaattctcatttttaatttattaaacatctctaataagttcaatgtttcctgccttctgagttgatttcctaacacatagaagaatatatcctaaatgaaagtttgtgttcttaatagaaattactagttaataacctttacttttattattgaggtattatacatcaatgttaatcctctcaatgggactcttacctaaagaatatataaaatattttcctgatcatgacataaagtagatgtgaacacattcttagcattcagccatgtctcttgtctattaatattataaaccacatgctaactttgattttattggtaattgttctaatttctttttttttcccacttctctggttgtttttttttttaactttaagttttagggtacatgtgcacaatgtgcaggttagttagatatgtatacatgtgccatgttggtgtgctgcacccattaactcgtcatttaatattaggtatatctcctaatgctatccctcccccctcccctcaccccacaacaggccccggtgtgtgatgttccccttcctgtgtccatgtgttctcattgttcaattcccacctaggactgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagtgataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcagcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatgtccaagtcagcctgttccgatcttaaatgccatccagtggcatctgccccaggtacactaatacatgggtcctgcttctctctgcagccgcctctctcctcagatttcaggttttgtgtattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaatgaagagtaaattttatatgatacatttgtagaaattttagaagatgccactattataaattaacatggagaagatttaaatgtttctgagaatatgctattgggagtaatggggatgtgagttaaatttcagaggaataagagaaagatttagggattaatttattcaaaccttgattgaagtgctgagtaaatggttgcaaacataggtctacatttttcaaatcattcaccataaatttgaattatttattaattacactcgaataaagcaataaagaaactgatgagataatatttgactgaattgcagcaataaatagatcgatattaacacaaggaatataactgacttccaaaaacatacacatgaaccgtggttcactctgcgtatttaggtaaataacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagacacagtgaggggaagtcattgtgcgcccagacacaaacctccctgcaggaacgctggcgggaaatcagcggcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgagtcttctccaatcagacccaggacagggacctccgtgagattccctgactggaacagtctttatggatcctggtcacagacaatagagaggctgaaccagggtcagcgtcatgtagaacctcacagatttcacgtctgatccttctcctgacacgaaagtatgcaaatcagtatcagcaccgatctggtgcttcttttgttcctaatccatttactttattttttcgtcgtttttctcctttttccatttgtttttcctgctttttgcaaaaggaagatgttttccctgtgagatgcaggggatgacaattttgggagatggctggaacatccaatatcctcagggccggccatcagtaagtgcaggctggaagtctcagaaagagctgaagctgcttaatcaccgtggagttttaccttctccagttctgctctgatggaatcagggccaagcaggttatcaatgataatctacctaacatagagtcaaccgattccagtttcaataacgtctgttaaaaattcacaccaccacctggattagtgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccatttggacattaaaactttttgagatatatggcatattatccaattctgtaagttgtagttacttggttgctttgcagaatctttttcataatctattcccacttgttcaattctgctttttttttgtaggtgatttgaatgtaaaatccagaaaaagattgctaattttttgagggttgagagttttacaattacaggtattaaagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagctcgtcatcaatatgtgggtttatatctaagctctgtataggtatttatgccaaaactttctatgtttttaacaaatgttaaggcctggaagtgaaatgcctaaagctttcttcttgccttgttacagatattggaccaaaatattctaaccttttactattgagtgtaataatagctgtggcctttcttaacggcttttattatgttcaagttgttttcttgtcttcctactttgttcatagtttttataatgaaactgatttttttcaaagtctttttctgtgtctgatgaaatgttactgaggtattttttctttagttttttaatgtggtgtaccaaattggttgatttgagaatgttgaatcaagtatgcatctcaggaagaaatttgagttggtcatggtgtatgtcttctaaaacactttggagcttagtttactattgttggggattaattcatgtctactaatgatattggtctgtagttttcttttattgtggtgcctttgtctattactggtaatactatcatggtagcctcatagaaagagtttagaagatatatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttaccttttccttttaatttttaagtttgtttttagacatatgcaatacattttgaggtgaaacctggtggaattttttctaataaattagaaaaaaataaatcatttaattgactattttattcaggttgatttgtttaatatttgctaaaggccagttctttaagctatgacacataataaatcccaaatggcagtacctcattgtttacttagcttttgtacttatatttctcagaggaagaaccactactgtaaattgtaaatagccaatacataattgtattgtatgcaaatctgtgactgtttacagtgtcatctctgagaaacataaagtttatttactatatatatataaagagtttggaaggtggactcctcaccaatttttgaaagagttacagaagggctggcattacttctttaaatgttaaggttcattttatgatgtgacatataacccatcatggagaatgttcaatgtgttcttgagaaggatgtgtattacgtgactcttggttggaaggttctgtaaatatcattcagataaatttgttcaatagtgttgttcaagttcagaggcacattaggaattttctttccggatttgctatacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaactcctcctggagtctgacgtctgctttgggcactgccttcttctcaggcatcccacactggagcttgctatagaggaggagggagggcccctctcctggtgaaaacaagcccagacctgaccctgcagctctgggagaagagccacagccctgggattcccaggggtttccatttggtaatcaggactgaacacagagaactcactatggggtgtgaattaagctgaatttttcttgttggtattttaaaaggtaactcatagggaactagagtgagtgagagtgagtggatatgagtgagagaaacagtggatatgtttgccagtttctgaccaggatttgtttgtattttcaggtgttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgtacataaggttccaagtgaggaaacatcggtgtgagtccagacacaaaatttcctgcaaaaagaagaaaggagtctgggccaaaggggacactcagcactcacaaaacaggtgcagccccaaggcaggtgcagatggagggagggtaagggctgctttccttcaggatctgtggtttcctctgcttctaatatttcccctctgagcctctgtacatttatattttgtgcccaccatgaggtcgctggattagaaaactaatttgaaagaggaaatattctcatatgtcctaaaaacagatgtaagtattggaggcataaaaatgcataggagccgggtgtgtctgtagacactgccacccccaatgccagacccacaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcaatctctccactgtgcacagccattgtctgggaggagctcccaggatgggtgtctttggcacacacagttgatgggtgttagagtgcagtgcagcagctggctgcctggtctattgggctcctggatattggagggatttgaggtgcattctcagggccagcacgctttgtcaatttttatatgaaaaccatgtgatttaattcattttctcagatgacatagataattaataacacaatctgcaaacaattataattttcaactttaccccaagttcattgtttctgaattctgtgcaggatccagacatggtactgcccttctcatgagaaactgttcgatctaaactgaaaccagttgtttctcgtatactttggttctccccatgtgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtggctcggaattaggacagtcttcaggttatcacaggtcaatcatattctaaaaatcatcgttatcacacaccatggtaacaattcaaggttcatttttctaacggcagtttctcttttttatttggttgcaagtttgaggaaaggaacatgtgataatactttttaacctaacctcgaaatctactgaattgttctaggagactcacaaattggacaaagtgagctctttattctcataaaaatgtgtggttttgggaatttcactgtgttgcccagaacctgttaacatcaacaactatgtttctcagcacacttctggcttgagacgtccttgcagaccctctccctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagcaaaagacgcaatgaagggccttcattgtgagcctagacacaaccctccctgcaggggtgaataggagcagcagggggcattcggggcagtatgggggcttaggatgattgttaggggtcaggatgagcaggatcaaggcttcgcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatatgtacccatatggaggtgcatccagttgtcttctccatcttatgtggaccttgtccatcaagcactaagtccctgtatttacttgagtacctcacacattatggtcaaaacaggtagggtctccttttggcatggtctctcctcctgccttctctcttctgtcacacaaaaacacgtgaactgacacacacacagagcttcccaactttaattatgtgatgtattgaagcaaattgattagtgtgcagcttttctgctttgcctgctattcatgttatgtaaaaataagaaccatgtttttctcagcttgtcacttctctaagctaagtagcatctttgtttattatacccagagaccaaaagcgatccaactgttattcagcagcttaactggtaaacaaattgtggaaaattcacttactggaatcatacccactgctacaatcaagtaatgctggatacacccaacaccatgcttaaaatagcaagtacttgaataagtaaaataagtcagacaaataaaagtgcatacatacgattccacttctataatttctataaagtaaaaatgaacttaaagttacataaaaagatctgtagttgactggggacatggtacaagaagagaaggtatagaaaggagaaactacaggagaacaaaaggaaatttctaggataattgatttttttctctgttagtaaaagtgaggattatgtcaatatttgtaaaattgtacactttatgtaaagattcttatttgctaatttcacctcattaaaatattgcaattttttaaatgtctagtttggtagaaaaggtagtagagagagatgaataaaatacataaaaatcagagagtcctgaatacacacatgaatggaccctgggtctcactgtactttgagggagacactagaatacaaaaacataatgacaggatttcagtacatgaaaggagcttctcagaccccaggaggcatgtccaactgcgtctgggagttaactcagggagcaggcatgtcctttggaaggagccgtgacaccaagctcccagcatccattgtagccgacaccatgccaatgccaagagatctcaactaaaattttctgtggatgttgagtctgattatgccacacactcacaccaagtgagtatggaaaggatagttacctgcatccttaaggtgtctgctgagagcagggcaggtctctcattaaggtccaaagtggcttgatagggcagggaaggagactggctcagggttgttatcatggtttggtggggagcggggcagagcatcctacttgcaggaagggttttgtggggtttcaaggccaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcgcagtttaacttcctctatttgagtagctttacaattgtgtaaaattcttaattaattaatttttttttgagacggagtctcactctcttgtgcaggttggactgcagtggtgtgatcataacatagctcacggtgattttaaattcctggctcatagaatcctcccacctcaacctcctgactagcaagtagctaggtttccagggcccttcatctacacttggccggttctttacattctttttttttttttttttaggtggagtttccctcttcttgcccagaccggagtgcaatggcgccatctcagctcactgcaatctccccctcccaggttcaggtgattctcctacctcagcctccagagtagctgggatcacaggcatgtgacaccatgccccgctaattttgtatttttagtagagatgacgtttctccatgttggtcaggctggtctcaaactccctacctcaggtgatccttccacctcagcctcccaaagtgctggaattacaggcgtgaggcaccacacctggcctcttcgtttttattcatatattccttcagcagccactatgtcttcccactgatttcttcagtttctgccttttccttttgaataaggctgttactcctgagggaagatgggaggtgggcctggacagggacttggtgcattcctctctcccctcccagttcttattggtttctccagtgtctgtagaacagtggttttgatggctttacctctgcagataatttctcttgcaatgtagtggtgatggggaggtgtgtctggatgcatttcagctgtagttgctgttttgctttcccagacagcaccatcccaaggggtagaggctggagcattttgtgatgtatccccagtactgaagaaaaaggcttcaatagcaggaggaattcctcaactgcatacactctgagaatttaaacaataacttctctatcacactcaaattgaaaccacccaatgaatatgtctactttaatcgtgtgctaacttaaatgacatttggcagcctctgtcccagaaaagattatcatctgctcctgtttatttccctgcaagtctttatgtctgttcagatttcagatatattgtttgtcctataacatcaaaaatttgatgtatatatgctaatttgcagatcagtaagtttagtatttgttataagaatagtaacatatttttatggggtgcttacatctccaagctgagaagcacctctgtgtaatactaagcaactagaaatggtacaaataccaagaagacacatagataaacagtaatggcatgctaatttatggtaataacatccatcattagaatcaatacattgttgatgctcaacatgtgtgcatcataagtagttatgtgcgagaagccacacaaataaaacacatactatgtaattcctgtataataaattcttgaaactcaaaactaaggtattaaatgtgaaggactgactcagaatatggtggaggaagaaaataattgggaaggaggaattgtagaggaacacaaggaaacttttaagtgtaatttgtttattcattatttggatggcttttggggatgcacaggtgagcacgagtggaataacattttgttttgtttgtttgtttgtttttttctgaagagatgtggtcctactctgcgacccaggctggagtgtagtggtgggatcatagttcaatgtagcctccaacttctggtctccaacaatactcctgcatctgccatctaagtagctggaactaccgttgtttgccagcaggcttggcttgagtacttattaaaccgcacactttttgcaatatttaatgtatagtaataatgtctcaataagactattacaaatcaatgaatgaataatttgttctgtacagatttatggaaaaatagacactaacatgatgaatgactgacatttatgaaaatacagctgcatgaaatgtgcttctctttacattcattaggtaaacacaatagtgcatacacatcacaccgtgctttcattacaggaagaaacatctgaaaatgtcactggggtgaaccatattgtgctgggcttggttcaggaagcagtcaggcccagtgttgtgaccttcaaccacagaatcctaaaaaataataaaagaggctcccccaaagtccccatcagttcctggactcgccatgtgtctgggccgtatcagtgcatccggagctccctggtggctttagggattccttgcttgccatgctgaggtctcgctgtagattatgttgggttttctgaggccgttttgctatttaagacccactccctggcacagagcgattccctctaaacctgatagaggttctgaactacaaataacgttaagtgaatcctggtgtgtctgaactcacatgattgttacattaagctgctgttgcaatctgtttcctcacctgggaaaagaggagccaggacatagtgagttgaggccccaggaagataactgaattctcagagggcacaaccagcatcctccttccagggagagcctaaaagactggggcctccctcatcccttttcacctctccatacagaggcaccacccacatgcaaatctcacttaggcacccaagggaaaccatcacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgagcccagggctcactgtgggtctctctgttcacaggggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaacacagtgaggggaggtgagtgtgagcccagacacaaacctccctgcagggaggcggaggagccggcgcaggtgctgctcaggacgagcagggggcgcgcggggcccacagagcaggaggccgggtcaggagcaggtgcagggagggcggggcttcctcatcagctcagtggtctccctcctccccagcacctcagctgtccccaggactcctctttctttattatctgtggttctacttcctcacatccttgctgcaggttttaacagtcactggcacccttttttcaacaaattcccacaaggcccattttaccttcttgacaagcaaaatattctaaggcttctcactatcccttgattggcgtcatctactgcatcgtgtctttctcttaaattcatgtgatgaaaccccaatcccagtggctctgtattggacagagggattttaagagggcaaataagttaactgtggccataaatgtgggaccctaatccagtaggactcttgtccttatgagaagtggaagacatcagaggcctctctctccacatgcacacagaggagagtccatgtggggatgcgctgcatgagaaggtggccctttgcaagcctggaagaggcctctcaaaaaacttaccctttctgcacccagatcttggacgtcaagactccagaacaataagaaaattaatatttgttatttgaaatagcctagtctgtggtatcttctcatggaaagccaagtagattcagagattcaattgtgttagctccgtctcctgcatggagtagcagcccaccgaggctggacacatctctcaaattattttcataaagaaaaatagatccaagatgaaaaccccaccacatttctgctgagccattcacttagcagcagtctctgagatcagccctgggggtatgttctaggtcgtgtatctcactttccactatgagaatccatgtagataatgagaaccagccagatggagtcctgatccctgcccaccttctgcttccccccaagtgacacacggtcacagaaaaccactccagcatcaccctgtgtcttgtactctctaaaatcccactaaagctgaccctaaactaggagctatttggggctggactcattctgttcttagtcttccataaggtccaggtgccgagtagagcctcagtaaagagtgagcttcaattcccctaacccacatcattcccttacatccttgtcatgcacctgtcctctgcaggcacccagggcaggttacacaggaattgcctgaagctggtctcaggtgccctgctgagaccactggttatgcacacgtatgatttcaggtcatgcaggctcttctgcaggacagacctgtgtcctgtagagcacagacacttggtgacccagggcctcctctaataactcatacatctcatgtcagtgtatatccaggtggcccctcagtgcagcacactagggtgattaccctcacaggtggctttttcaggcggtgaacagaaaatggggtgggcacgctggtcattcccatcatcggtgatatccaagtgaattttaaataaatgaaacaaaactaacaacaaaggggaaggatatgtacctgtatctgggaggtagactgggtcccagaactgtactgggagtgggtgtgaaaggcccttttgtgtgggaagccctccagcatgagtgaaagctgaaggaatgatcactgtaggtggaggctgatggagaagctggcagggtacatttcctgaagctgttcccgggtgcgtgatggttcaatggcccatgtacatgaagaggagggctggactcatgtaggatcaaggaaactaccccatggcaatggaagaaaagaaaatggagatggacacccctggaggcagcttattagctttggtggaggaacgatgggaatttattccaatgaccccagcattttcagctaaatatgagttgcattaacagacagaattatgaagggaagggagaaggagtttatagagggaaaaagcagaacagaaaaaaagaactatgcaagtctatcaaatggcagatgacagagtggagctgatgcagctacttcattcttcccggaacctaccagagaccttggcattcctgtaaggcaggtctagtggtgatgcacttgtccactttttgctttttggagaaacgtttgaaacatcctacattactgaagaaaagctttaattagtgtaatatttttacttgacagttttattggttttgttttattttcagcaacttgaatagaatcatgcacatcatgatatttgggtgaacaacaggccacatacacgataatgatctcattaaattataatactgtattttcactgcatttcttccatacttagatatgttcatatatatacatacctaccatggtgattcaactgcccacagtattcactacacttacatgatgtacagatttgttatctaggagcactatgctatcccacacagcctgggtgtagcagggtatttcacgtaggttcacgtaaacacactctatgatcctcgcatgatgacaaattgcctaaggacacattgctcagatgtatccctactgttaagctacacatcattgtatctcatctctctccatttttggtctctgataaaattctcgtgttgtttttgcattcttctctgagctcattgaacacatttataaggtttcctttgaattttctgccaggtaatcaatatacctccttttaatttgtgtcagtttctagtgctttgctttgttacagaatttggactgctttttttctctttcattattattatcactttgtacattctctgttgctttctgctcattagaaggaaaagccatggtaaccactcttcacagaatatgctcagggcaaatgccatcacctgttagcccagtccatgatagtggtgtctcttaaaatttcatactggtccaaactttttgttgttgttgttagtggcactcagacctatagaggattttaagttttcccctactctaaattaggtggcatcaaaattcatcctgcaggcagtctctgataaagtggagaaattggacaaagttttagcatgtatatggttcataaaaataatatgagtttaaggttttctcagccagttgctacatattgatattttataatcatttctttgaatgtctctggagtttatcttttgaaaatttagatcagaatatataccaggtttgaggcttcttgtctggcttaacgatctcctataggtcagcgtgtgaaaaggcacagagtctatctgaagaggagaactcagggaagccccaaaacaacagaggagacaaaactgaggactttgaggaatctaaagcttctgggacctgcagcctccagacatgctcagcaccctcttgttatccacggactaatttctttctcttttctgagtggtattttctagggttcccgtcctccactttgacactttggtatgtccatgtgtgtccattgtgtttcagccagggacacagaaccaggaaaacatcatggcttttctagagggagctgacctgggtaatcaacagttggagtagaaagtgcctttgtccatgtgtcacaggcctaagggccatgggcaggaggtcaggaagagaggatgaccagacggctggggaaaccaggatgaacaaagccactctccttcctggtgagaaggggcatgtggaagcctggtgtccctgtagggctgaaccacactcacctgcccactgctacctgccagcgaggtgacccacagagcagcagcagctcctgagtcactcacagaggctgcctcctcctccaaaccctccagtgtatgtgcttccataagtgtgagccccagcagatcccaaagttttcaatgggttcatctagctagtgtctgtcctcagccccatccccaggctcctgccctggttggtgtccacagtgtcccagcagcggtgacagtgacagccagggcctgcactttccagagcagcaagtttggaagaatcaagtcccagaaccagcctggatttggggcaaacacacaaatttcactctgaggggaagtgctggaaagtagccttgagtcttcctcagctcacctgtggctgatcctctgcatcccatcagcgatacatgagccctccccaaccccagcgtggagctgtttcaatcgcagcaggatgggaatgtgtcttctttctggggactttttaagcacagctcttatgttcctgagatttgaggtttataaaggtgtgtcagtcacccacagagtggacctgcacaagtaagacaaggacaggatccccaggagaggcacctcatatgagacgggacaggcaggtcccatcacagacactggtcctcagaaaccctgaccagctactcaccttcccaggtcacctgtgtctgatcagttcctgtgtttgctcctgaaaagatccccatcaagggtccccaggtcctgcccccttccttgatgtgcctctgggagtggggctggctgggctgtgggtctgctgtgactttccccacaggtcagcggctcagtgcaggctgcgccaactcggtggggctgggctgtggccgaccctcccagggggagcctggatgcttctcgggggcatctgcaggatcccaggttctgggagaacagggaagccacagtgtgtgcagggccccatctccaggtgtaaagtgtttgctgtcactctgttgacaagggcatatccccaggcctaggggcactgtgggtgcacaaccaatgtggtagacacagagagtaaggcacatttccctcccattactgtggggaatctaggcactgtgtgtgtgtgtgtgtgtgtgtgtgtgtgtgtgtattaggagttttgcagtgggctctgagccccgtgattttgtaggtttagaaattatctgatgagatgttcatccacaggaaccgacaagagattaggtgttctcccaaagcccctgggagctcctggactcattgtgagtgtggactgatccattgcttccagagctccacagaaggggctccctggtggtttcatagaatccttgcttggggtctttctgcagagttcactggctttcctacggccagtttagtattgtaagagatggtgtcagcagcacatggtatcacatgtcactaaatgagcattctgagccaggacacagcatcttcatactggggggagggaaatgctttgggagcccagacaggagcctctctgcagtgcaagggctgggctgcagggggcgctcaaggcccacccatcacaggctccacccccagagcaggtgcaccggaggctggggagggattcctctcaagatctgtgtcattcttctaaaaaaaatctaaaatgagtatttgacaaagactgctgaacattctataaatatcctattcaattgtgagcatttatcaaatttgatgttgtaatgagaaccacttttatactagatatttctaaccctgctagatatcttaatagtatgcagctggaggttaagcaagcttttcttttatataaataagtgcaactttggagaaacacactcatcccccgaataagacattcatgtattaaagcctagaaatactttaaattacctctgagccattcaagtgtgtgttcacagtgaagtcctgttctagggaaaattgttctccagggggagaagctttgtcaacatagagcttagggatgtatcaggaggcacatgacctctaaggggattatagcttgaacccttagcatcctcctgttggtaatacatgtgtcactctccaatctttctcatgcagtatcaggtatgaaataggatcgctcatgaatatgcaaataactgaggtaaatatagatatctttgtgccttgagagcatcatccaacaaccacaactctcctcagaagaagcccctagaccacagcacctcaacatgtactggacctggaggatcctcttcttggtggcagcagcaacaggtaagggacctcccagtcaccgggctgagagagaaaccaggccagtcaagtgagacttcacgcactcctgtctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacgtgcaagaggcacagtgtggaaacccacatcctgagagaaccagaaatcctgagggaggaggcagctgtgctgagctgaggcagtgacagggacaacgtggctgcaccctttgttgacatagggttatacacatacatatatatgcacccaacactggagcacccaggtatatcaagcaaatacaattagagataaacagagagatagacccaataccataatagctggagactttaacaccccactttcagcattggacagatcttccagacagaaaattaacaatgaaatcttagactaaatctgcatgacagaccaagtggacataatggatattgatggaacacttcatccaatggctgcagagtacacaatcttttcctaagcatatggatcattctcagggatagaccacatagtagaccagaaaatttgtcatttttaattaaaaagatatcatgtaccttctctgatagtaatgaaagaaaactaaaataataagaggaattttgaaaacacatggaaattaaacagtatcctccttaattaaacaatgtgcttccaaactgaactatatgctctaaaatgggttaataaagaaacaaacaagaaaattttacaatttattgaaagaaatgataatgaaaacagcgtatgaacacctatgaaatacagtgaacatagtactaagaggaaagttcacagctataagcacctatgttaaaaaagtagacaattataacataaacatcttaggaatatctctcaaaaaaaactagaaaagcaagagcaaatcaaatccaaacatagtaaaataaaaaagttaagatcagaacgttaataaataaaattgaaataaataaaacaataccaaagatcgatcaaatgaaaagttgttttttaaaaagataaaagacatctataaacctttaaccagaccaagaaaaaaaacaaagaagaccaaagtaaataaaatcagaaagaaaactggaaatattacaaccaatagtgcagaaaatcaaaggatcattagaggctactaggagcaactaaatgccaataaatcgaaatatctggaagaaaaggataaatttagagacacatacaacctaccaagattgagccaggaagaaattgaacagatcagtaacaagtagtgagagtgaagccataataaaaggtctcccagcaaagaaaaaacccgggacttgatgacttcatcactcaattatgacaaacatttaaagaagagataatacctaatctcactcaaaatattccaaaaatagataaaaagtagataaggaagggaagaattcttccaaacttactgtacaaggccaatgttacccttatatgaaaaccagataaagccataccaaaaaaaaaagaaaactacagttcaatatcactaatgaatatggatgcaaaactcctcaaggaattcttagcaaaccaaattcaataacatatcaaaagagcattcatcatgaccaagtgtggcttatcccagagatgcaaggatggttcaacctatgcaaatcaatcaatgtgacacatcgtatcaacagaatgaagggcagaagacgtaagatcaggccttaccttgttctcctcactcaaagtctaccattagttctttggtcctcttgaccagtcctgctgtacttggtctcccgtgattctgttcccaggtcctgaaacactgggcttctgcacacctggagtctctctctttgaacatggagaccctgtatcctcagagagggatgatgcctcattgtggctcccatgccccatgcaaacaattcttccaacacagtcatgatttttcctgttggaaattgaaaggggatgtgggaattgatgtgtgtgtgtgtgtgtgtgtcctcaggcctgttgggcctgttgagaacacagcagggctctatgtacaacaggaaagcaatgttttctctataccatctattttcttataaagtgttcataggtaatcaaaaggaaatgaatcacagtttataagatgttgtggactggactgatgttgtcactcaaggctactatgggggctccaggaaaagaaacctagaaaaggataagactgtgagcaaagaagcaaaacctgggaagcagcagggagagggtgagcaggggtgactcaactggggagggataacaccacttaccacagagggtgaaaactccgtgctcagcaaagaggagaacttactcagcatttcccctaatcctccctccagaagcgcgactgccaggaaagttcacaatgtatcatctccagctgggaacccaaaagaaacaggagattttagggcataggtcctgggcacaaggtgtttccctggttcctaccccttccctctctgtccagcaaaactgcttgtttctatcacttgccttcctgtccttggggtaagaatggatgctttgacactcagcagagggatgctctttcagaggaggaatgagtttgtgttatctgatgtctgagcaggacactcacctctgggaagaggctccaagacagaaggtcgccgtggttcctgccccttatatgtgaggggctcttgacacatgcacacttttcctcaaactctgtttataccccagcaacaatgctgggtgttgtcagcctctctcctccccagatactgctctatcatcagcttgagcacagtttccccatgaaaggcattattctctctctcaagaagatcaactttttacatgtcttcgatggatgacagtttttctgtgtgagaatctagaaataagaaatggggtaatggggacaagtgagctctctgtgtgactcactaggaagtccactgttattccaggtgtcctgtcccaggtgcagctgcaggagtcaggtccaggacccatgaggccctcagacacttccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgtgaaagactcagtgaggaggtgtccttatgagccctgacacaaacctgtcagggcacttaggacctccaggaagactcaagaccaccaaggggactcacgaccactggggaagggcaggttgcagtaagcacagggccagccccagagcaggtgcaggtggagatgagaggctggtttactgccagggtctggggctgcttctccatttagatgtttccttcagagaccctcccttatttcatgatgctctgcttagctgtaagtctctgaaatatcacagttttgttgtaccaggaggaaaccttctctcaggtgctaaatgtagaacaatctctctgccagtggttgccagggtcacagccctgtggaagctgaagggtacccagtgagtcttctccagtcacattcaggacaggaaccttagtggggttccctgaggagaacagtctttaggaattctaacctcagccaagagaggctgggccagggtcagtgtcaggtagaacctcacaggatttacgtctgacccttctcctgacactaaagcatgcaaatcagtatcagcactgatctggggccccttttgctcctagcccattctatttcttgttagttgtatttgttgttgattttccttttgctgttcctgatccctgtaaagtggagatgtggttcctgctgtaaaaattccagggctcaagccctttccctgcagctcaggtggggctcagactgtggctcctgcaaccacgtgggagaggctgatgggactatcttctctcccgttgctcagaaccctccagtgtgttgtgtggagactcacctgggaatgcaagtggccaatagttgtgaaaggtatgcgcttgtttggtcaaagtggaatgtggatgtggaatttatcctgtgttgtgcaaactaacacaggttcaccttcctcacctgtagtgttagaaagagtgtgaaagttgtaagaatcaaaacagagccacttgtgttaacaccctgacaaatggacctaggaatgaacatgaaggagggttcttaggcccatattcctgataacaaaaactatcataaatagactctgcttagccaccatcttggatagaagcccaccacaaccttattaaaaattacacttgcaagaacatcagctcagaaactggctgttcaaccttacactgatgccaccattgctattgattctacaactatatgataattatctcaaaacaacttttgtaacccacctcattttcacttcataaacctgtggattgacatgttggagttactgctgcatttgtagataatgataaataataaggccttttaacaatgtttgaagctgctattctctgatgtctcttctaaaataaagaatttccaagtggatgacaatgaaaaaattgttagaaatatttggtggtaaggcatctttaacatcctgttgaatgtttctgcatagcacatcaatcccttaaaatactttgctatatctgcatttaatgaatgagtctaatattgaggtgcaattgaaaatacctgggcctttgatgaatcagctcatagggtgataatgtctgggtccttgagaaagcagaccctgtgttgtaagttttagtagaagtaccttttgcaaagaaagttcatgtgtttctgaacattatgctacttttaacttaagaatgcaatatatgatttatttttacttcaaactgggtatatacccagtaatgggatcgctgggtcaaatggtatttctagttgtagctccttgaggaatcaccacaatgtcttccacaatggttgaactaattttcactcccaccaacagtataaaaatgttcctatttctccacatcctctctagcagctgttgtttcctgacttgttaatgatcaccattctaactggaatgagatggtatctcatcgtggttttgatttgcatttctctaatgactagtgatgctgaacattttttcatttgtctgttggctgcataaatatcttgttttgagaagtgtctgttcatatcctttgcccactttctgatggggctgtttgttttttccttgtaaatttgtttaagttctttgtagattctggatattagccctttgtcagatgggtagaatgcaaaaattttctccgattctgtaggttgactgttcactctgctgatagtttcttttgctgtgcagaagctccttagtttacttagatcccatttgtctattttagattttgttgtgattcatacttggttaatttttaattgcattgttttcttctgattagttgtaagtatacctgcatattgatcaaaaaagccgtttaacaaatcaaaaggaaacatttaacaaatacgtgacttggaagtattttctccaagtctgttgttgtcttttactcccttgtcagtgtgtattgcagaaaaatatgtatgtgtgtgtgtgtgtgtttacaaattaaagaaacaggtataatttcatttatccatagatcacgtctttggcattacatctgaaatctcatcataaaatatactaatagtgatttttttttccatgtctctaatctcaggccacaatctactcatgagtgtttaaacatcacctacttgattagaggactatcaccctaagatatttggaatatttctggaaggagatgtgttctttttcccattatttctctatttagtcatttattaatatccgtattggtttatgaatgtctatttcatactctgaagtaaatccatgctatattattcattttattgttcaaatcaccacagctttattatgtgcttggaactcatttagtttggatgctgcatccttacagcacacctcatcattttgtttttgaacactttcctgtttcctggtattacaatacattctaagcccattttctatattaactttttcatacatagaatcagacatttttctaaagattgcttctttctgatgttaaaatatagtattaaaataaaatttgtgatactgggtatatgtgttgttaatgtggtataagtacttttaggacctctcaaccaactggcctagtaaatgtgcatgtttatatgaactcatgtttaaggacacattgaaactatttatgtatcttatattctgtaactttattacattaaaaatgagaatacactggtctcctcacccaactatgttaccaccatatcgacctttctaggcttccttgactgtccataatcacccactgcaaagtgaggaaccccatcccatcatatgccattgtattacttagctgcacaatttcaggacacatgcattgcagcatcagaaatgtaaagctgtacccttcttggaaccatttttatctactagaatagagtgcttatgtgcagtttctttacactttaaacttatagaatttcctcattttcaaagttccttagatcagcaacttcgttttccactttcttcatgaagtcatttcaattacactgtataatttctttatttgaattctgtaaaagccaaaactacagtcaagtaaacatagagaggatattccaggaatttacagagtgggtatcaaataagttaaaaaggcaatgtttaagaagagtaaaactatttttagtgatatgcaatggttgagacatgacacaattaatttgtctaagctcataattttgtgatgaaaaatataaacctaaatatatacaatttaaaatgatgtttagcagtacattatccctaggatcaaatgcagactgtataaaattatctaataacttatttggtgaggatgccatgagacacatgcaacaaagaatgaactaattttccttatttgcatataagatgttgacattcactaaagatctttaatttaaaaaaaaatcaattttctatgtgacccaggttttttcttccagacaagcaaataacccacaggattattttctttccttgattgagaaagattttccccaaacttcagctcagttcaggcatatactgtccctaaatgggcatttaccctcagatgagtccacacacctgtcaacacgtggagtcttctgtcagacaaacacacctttactgatgtggattcttccctcagacaaaaacacatgtccccacatggacactttcctcagactaccatgtatgtccttacatttacgctttcctcagaaaacagacttttcctcatgtggactcttgtctcagacaagcaaatatgtctccatgtgaactcttcactcagataagtacacatatgtccacatttactgtttccctacacaggcacatatattcaatgttgaattgttttgtggcaaaatgatctcaagataatggtaattataaaccccctccctaataaagtgtagatctgtattttttttgttgtaacctaactttgccttattgtcaaaaacagtaatttgcagctctaaatgcaccagttagagacaggtgtccattttctctggaaatgtatttttattttcttactggacatatttgttgataatgttgctactatgaagatacctgaacagtatccacattaaagaataaaaaagagtaatgggcagaataaccctgtgcatccagacccagaaatcctttgaccctgccctcccgaaatgtagacacagaggatggatgagcagtgctgagcagtgtacccatgaccacaaacatgaagacatggaaatgtgtccccactcctcctcatgaaaggcagctcatgccctcttccttcaggccctggtatggagccaccccatgtctctgcccttccttagtgtccacaccatggggtctgcactgatctggattcccttctcatccccctcaatattagtgtgccttgtgaatcaggtccagctgtggctgttctcagtctgtttcctctgtattcacagaagtcctgtgtgatgtttactgatggagtcagaaggagaaaaatttaacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatattacagtgagggacacaggggagggaagatctgtctgagcccagacacaaaaatctctgcagagagacaggagggaactgcgtggtagatgctgctcagaaccaccatggggtggccaggaaacaaggggtgcttaggacctctagggagcgctcaggacgccaggggggtgctcagaaccactaggggacgctcaggacactaggtggcgctcaagacaacactactgcactcatgtcaccacggggtactcagaaccaccagggggcgctcagaaccaccagagggcgctcagaaccaccaggtggcgctcagcaccaccagggggcgctcaggacaccagggggcgctcagaaacactcggggacgctcaggacaagagggggtactcagaaccaacagggggcgctcaggaccaccaatgggtgctcagaaccacaagggggcgctcaggacataggtggtgctaaagacaacaattctgggctcaggtcaccagggggcgctcagaaccaccaggggacgctcaggacatgcaggttctcttaggaggcagctgcacatcaggagcttcagaggctgtgatttcctttcagaccctggaaattcctgacctggtcaagcaaaagtcttccccaggatgtctgatttttccttttaattccatgatttcttttacctacaaaacactaacttagaacagggatgtaatgcaacttttattgctgcgtattttctgagtaatactagcaatgatctctcgggacaattattaaaataggttatttatatattttaattattaaaaataatactattattaaaatagtaaaattttttaaatcacacttgtaatcccagcacttggggagactgaggcagacagattacttgagctcaggagttttagaacagcctggcaacatggtgagatgctttctatacataaaagaagaaatagctgagattggtgcaaccagctacttaaaaggctgaggagggaggattccttaagcctgggaggttgaggctgcagtgagctatgattgtgcctccacacaccagccttggtgacagagtgagaccctgtcttagaaaaaaaaatgcatatcctcaatacagactatttccatgaatagagttttgtgtttttgtgctgtaatagtcaaacaattgtatatgttttctaactttaactcagcatatgcatggtgttttgtttctttttctttcatctgctgtttgtggaaaataaacagcactttaaaggctctgtttctccactttgtttggcttccagtgtcctgtttttcagactgtttctccaccttcccttcttctttgaaagccatttatcttcctcagtctccatgcagaaaaagaaagtccctttactttctgtcttccaagtctggtgaatcagttcccttcttttcataatcactgaagccaaccaagtttagaagtataacagttctccttagaatacgctcatctacctgcactctctgccctcctcatccttttctaggtccctccagacatcaccctcatcccataccctcccttccttaagtaccacagagtgggctcttcacctcctgctgccctctatgtgctcagccctggggctcactagtcctttgattatgaagtccaaatccctatgtgcttgcacactctcacgccaccctctaggaagctgccattgtgagagagtcctgaaaagcatgggctgggtttagtttcataatgcatattatggtcaattagttattctatttgaacattctatttaattaatagatagagttaattaaatagagttattctatttaattctattaaactattaataaattagttattcaatttattaataacaggccaatatttaaaataaataccattgcacgtttaagtgacatatttgacaataattgcatttacatacagttttaccaaaacatgtatcgaagtgtatttgtttttttaaatattggaataggcagacatacacataggaaaacattattttgtactacaatctcaaactgcaaacacaatttaaatgccattaaataattagaataatatgaaacaaatgggcatggtgttttggtgtttaaatatacattcatttcacctgatcatacttatgtgtctttgctgggctgctgtgcatgtatgtgtatttgtatgaccatgaagctttcagatacatcattaaattacataaagtgttaccatgcacttccctcttttaggggacaaagtaaatctttcagggcaatcgcagggaaaatgtgtggttggatcttccacacagagtccctaccatgacattgccaagtagagctatggaagggggctaccaacctccagaccccagaatggtagatccacaggcagcttgcagctcgagtctggaaaagccacaggcacccagctccaacccatgagagcagccttatgggctgcattagggaagtcacaaaggtagggctgcccaaggccttgggcacccacccttgcaccaggtcacaagacatggagtcaatgattattttagagccttaagattgaaggactgtccgactaggttttggccttccataaaaatctttacccaatttttgggccattttctctttttagcataggactcctcacccaatttctgacccatcattgtactttggatgtaaataacttatttttgatttttcagtctcataggtgaaaggaacttttccttgagtctgaactttggattttgaattaatgccaaaacaagttcagattgtcagggaccactggggagggattattgtatattgcaatgtaagaaagacataaggggcagaatgatgtggtctggatgtgtgttttctccaaatcttatgttgaactgtgaaccccagtgttggaggtgaagtctgctgggaggcatggcattaggggcatatccctcatgagttacttcgtgtcatccccttggtgatgaatgagttatcagttcacatgacagctgattgaaagagcctggtaccactcccttctcttatcttcccccctattgtcatgtgacactcttgctccccttcatcttctgccttgactgtaagctttctgaggcactcagcagaaacagatgtcagcaccacacttgctgtacagcctgcacaactgtgagccatataaaacctatgtcctttataaattatccagcctcaggtatttctttacaattcaataatggacgaacagaagaagtatttaattgtgcagcaaattaggggtgtggaatcattaaaatggacttaacgcctgtagaggtaaagacacaagagtctctctctctctctctctctctctccttgaacccttctctgtctttacatacacacacacacacacacacacacacacacacacacacacacacgctccacgtgaagatgtcatgtgaccaaatagcaatatggtggctgctatgagccaacagtagaagcctcaaaataaaacctatcttgccagcatgtttatctttgaatttccagaattgaggaactgagataaaattaaggttgtgtaagttaccaagtatgattgtttttaatgtttgaactgactaaagagaatttgggatgaagaagtggggttctgatgttacaattatttcaacactgtggaaagtgccttggaattgggttatgtgtaaaaggctggatagttttgacatgcataaagaaatttatatattaagtgtcattctgatagattaaaatgagtagagtgctattggaaactggataaatggtgatctttgttataaagtgacaaaaaaaacttgtctagactatgttgtgatatttagtaaaagagaactttgagcagcaaaattgaatatttagctgagaacacttctaagtaaaatgttgaaagtgtagtttggtttctcctgggcatttataataagaaatagatgaattgaaaatgaaattataagggagaaaatatccaaaacttaaaggcttggaaaattctcaatctatctgtgttgcaaaaatcagaaagtgcgttctgaagagaacagtgagtatgaggctgtaatatcacttgataaagaatttatggtattaaaagagaataaatgcaggttttaaagaacaaggatggagatgagacaaaatggacgaatactgtcagattcttcagatttaagaggatggagctacttggttgcaaatgtgcaccattcttccagaacaaagaaaaataaaccttgaatttatttagaagtaatcatgaccactaccttggtttcaacagaccagaccatccatgcttaaaaccttgaggaaaagacctcctaccactgcctggaacttaggaactcccagtgagccttgtgtgtagggctgcatggggtctttgggatgggaccttaacccagcagttacccattggtgcctctacttaaagcattggaattaattctgctgctgcaatgagctgggaaagaagaagcttggcccagagaagattccacttgagccttaaggtctatggtaatttgttttgttatgtgttgtacttgctggggacacatcacccctcctttcttttctatttttctctttgggggagaaaatgtctattttatgcctaactcaccactgtattttgaaatcaaataacttgtccagcgctatggactgaatgtgtatgcaactccaaaattaatattgtggaaccctaatccccagtgtggtgtaattggggtgtgggccatttaaggggtgatcaggtgaaaaggttgaagccgtcataaatgagattagtgctctaataaaaagtcacgggagagcttttctctcttgcttccctgtcatgagatgatacgataaaattacggccatctgcaattcaggaaggaaacctttacatacacatgattggctgtcttgggcttcccagcattcggcactgcacagaataaatatgtcttgttaaagtcatgcactttatgacactttgttaaagcagccccaataaaataagatatctggttttactggctcagagttggagagaaatttgtttcagaaataattctacctcaaatcttactcatgtatggtttagttaatatttaaattatgttttaaacttgtttagagttgatgatgaaatgagttaagagtttggggactgttataatcaaatgaatgaactgcgaatgtgtaaatgccatgcatttgggggatggtcttttctattctgggtctttcatgcctacgtgtgaattgaaggattgcttttcttatttctgtgaagaaggccattattattttgatagataatttatctaatctgtaaataactttgggtagtatgaaaatttcaatactattaattcttccaatccataaatgtggagtatctgggatatatgtcctatttatgtgtgtccatttcattttctattaccaataatttatagttatcctctagaaatctttctcttatttggtaacatttattcctaggtatattttgcagctattgtaaaaggaaaggcttcatggatttcattctcagatgttttgctgtcaacatatagaaatgccaccaattattgtatgtagatgatgaatcttacaactttacttaatttgcttatgaattctaatagtttgtgagaaggctttagttttctttttttaatataagatctttttgtctgctcacaggaaatctgacttccacaattccaaatttgaggtcatttccttttactgttaactaaatactctggctagcatttcagtactattctgaataaaagtgataaaaatggttatttttgtcttcttccacttcttagatgaaaatttcccggtttttccatgcttcgtgtgatgaaagctgtgtttttctcatatatgcgctttattttttgagatatccttcttgtatacctaatttttgataatttctatcagaaatgaatgttgaattttattctatgattttctaaaatatcttgactacacaataacacagtaatatgcaggtcaatacatatcaactgaatttcacttaatatcatcccaacttctaatatttattttttagtattagaacatgcctgtttccatattatatttgctcacaggtattggtacatattttagctaatttgtcattattttactctaagaaataactcaaaaaatcatttttattatgaattgaaaggtaacatcggcaaaattagcccaatcttaatctttcccagactttgaaacattattgaagacaatgagaggggaaagtcagctttagttgagcttctaagaggtaagtgaggtaaaaacccagggcttattggctacgactttgaatgttactgtcttcttttccataagccacatccagaccattttctaaatctaagaaaactaattttatctcactgcttcttagtcttgtttcctgcagctgacaaccaaaactgtcagcgatagagcccagtgtaaatcaccagcctttaattattgcagaactatgattttacaacaacattgtgagttacataatgatcctactttatggccgcggtgcaaatgcttaacttccactaaatcacagagctcagaatggctagcatggaggtgtatatgtatatgtgcattgttctagaaatttccaattactgtatattattgtttgcagtaattaggtcaatctgaactgacaaaagtctccatggccttataagcacagagaccacctccacggcaggtggaaatcaaggctgggaacagtctaccagctgctcccctgggattcctccaattaccctgtttaaagcctctgctcactcatgcgctggaagagggatgtcagagatgcagtctactcttcctaaagggctgacagggcataaagacaagactgattatccatggaacattcctataggaatgcacctatgtgcagacacactaataagctgtgtgtcttgcagtgtgtaaatggctgagatgccatttacacttctttacacaatacatttttaaatgttttgttgatgtattctctatcattcaaaaaaatcatcactttccccctaaacaaagaggatttttatcagaacacttatgggaagccccttgctctcccagattcccaccctcatttctcctgaaggaagaaagaaaaccatctctattgatttccactctcatcctctaggactaaaaccagaaagctgcatgctccctgggtgagccttagagaagaccctgtctgtaggagcaggaatctcagagccttggctgagaggcatggtcctgaaatgagatggagtcccccatggagatcccacgtggacgcccacacctgagggctcactgctcctcaccacagatgcactcccctactgagtcctgagacctgagtgcaccccatagagtaggactcagatgagggaatgcaaatctccaccagctccaccctcctctgggttcaaaagctgagcacggggcctcgctcagtgactcctgtgccccaccatggacacactttgctacacactcctgctgctgaccaccccttcctgtgagtgctgtggtcagggacttcctcagaagtgaaacatcagttgtctcctttgtgggcttcatcttcttatgtcttctccacaggggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggataccacagagacacagcccaggatgcctcctgtacaagaacctagctgcatctcagtggtgctccctccctacctctgcagaacaggaaagtgtgactgagatgccatttcctgccagggcttgtgtttcctataccaaccagactcagagccctgtctgttttcctattctgtactattaaatggcatgttccctgttagtgattcacgcaagcagaggctgtatcctgtttgacaaagattgagcatgaaagattcccattacctgggccacatgcatcactgatatgtggccacttatttcttgagctcatatccttccaaggggctgaatacaaatatctataacataggccatcttaaactgcaggaagtaatgttggagaagaatgtggagataaaagagcaggatgattaattaaaatccagataccatctttttttgcagagaaaaatttacactaataaagtaattttatgaaacaacaagaaagatggaatgtgtcctcatcatggagtgtctcacttgcagtgcacaaataaatttctaaaaattttatagggaagatgtgatagatgaggctgatttccacacagggagtgattaaatacccaggtaagtataaaatccaacacttggaaaggaaaatgcctcagcttgacatcagaaacccagctcagtaagtctgaggagcaatgcggaaaagaaatgaaaaattcgacaacacttttcttatgaaatccctagctcatgtttgaacacgaaaacagaattgtccacaattttaggacagccatcgcatgacaacaaaccactacaatgataggagcatcactgagtcaacggagttcaagcagtgagcagatcagtactgaggccccaggagaaccaaggctctttggtacattttacagaacccagaaccgagccacataatctatggccaagtgatctttgacaaagttaacaaaaattaaccaacgtatacaccagggaaaggacaccccattcaataaagggtgctggggatattggatagctatatgcacgcgaatgaaactggacccccaccctcaacatgtaaataattaacacaaaatagattaaaggtttaaatgtaagtcttcaaactgtaaatgtattcaaataaaacaccaggacaactcttctggacaaaaagcaaacaatagacaaatgggacttaatgaatctaacaagtttcttcacagcaacagagtgaacagacaaagtgcagaatgatagaaaatatttgcacactgtgcatctgacagagtactaatatacagaattaacaagaaactcaaaccacaacaacaaaagaaaacaagaaccaaataaccccattaaaatgagcaaagaacatgagtagacatttttgcaaataacacataaaaatggacaatagatatataaaaatgctcagcattactaataatcagggaaatgcaaattaaaactagtgagatataccattcacaatggctgttattaaaaagtcaaaaataacagatgttggagaggatgaaatgtaaagggaactcttagacactgttgatgagaatgtggacgagtacgacctctatagagaacagtatggattcagtatgatattgactgtgcatttgtcataaacagctcttattattttgagatacattccatcaatacatagtttaatgagagtttttagtattaaggggtgttgaattttattgaaggcctttgctgcatctattgagataatcatgtgttttttttccattggttctgtttatgtgatggattatgtttattgatttgcatatgttgaaccagccttgcatcccaggtatgaagccaacttgatcatggtggatttgaaaaccggcacaagacaaggatgtcctgtctcatcactcccattcaacatagtattggaagttctggccaaggaaatcaggcaagagaaataaataaagggtattcaaatagaaaaagaggaagtcaaactgtctctgtttgcagatgacatgattatatatttagaaaaccccatcatctcagccccaaatctccttaagctgataagcaacttcagcaaagtctaaggatacaaaatcaatgtggaaaaatcacaaacattcctatataccaataatagaaaaacagagagccaaatcatgactgaactctcattcacaattgctacaaagagaataaaatacctaggaatacaacttacaaaggatgtgaaggacctcttcaagagaactgcaaaccactgcccaaggaaataagagagggcacaaacaaatggaaaaacattccatgttcatggataggaagaatcaatatcgtgaaaatggccatactgcccaaagtaatttatagattcaatgctatccacatcaagctaccattgactttcttcacagaattagaaaaaaactactttaaatttcatatggaaccaaaaaagagcccatatagcctagacaatcctaaggaaaaagaacaaagctggaggcatcacgctacctgacttcaaactatactacaaggctacagtaaccaaaacagcatggtactggtaccaaaacagagatacagaccaatggaacacaacagaggtcccagaaataatgccacacatctacacccatctgacctttgaaaaacctgacagaaacaagcaatgtggaaaatgatcccctatttaataaatggtgttgagaaaactagctagccatattcagaaaactgaaactggatcccttccttacaccttatacaaaaattaactcatgatggattaaagacttaaacatgagacctaaaaccataaaaacccaagaagaaaacctaggcaataccattcagtacataggcatgggcaaggccttaatgactaaaacaccgaaagcaatggcaacaaaagtcaaaattgacaaatgggatctaagtaaactaaagagcttctgcacagcaaaagaaactatcatcagagtgaatgggcagcctacagaatgggagaaattgtttgcaatctatccatctgacaaagggccaatatctagaatctgcaaggaacttaaacaagcttacaataaaaaaaaaacaaccccatcaaaaattggcggaaggttatgaacatacacttctcaaaagaagatatttattcagccaacaaacataaaataaagttcaacagcattggtcgttcgagaaatgcaaatcaaaaccacaaagagataccacctcacaccagttagaatggcgatgattaaaaagtcaggaaacaaaagctgctggagaggatgtaaagaaataggaacgtttttacactgtggtcggtagtgtaaattacttcaaccattgtggaagacagtgtggtgattcttcaaggatatagaactagaaatgccatttgtcccagcaatcccattatttggtatatacccaaaggattataaatcattctgctataaagacacatgcacacatatttttattgcagcactgttgacaataacaaagacttggaaccaacccaaatgcccatcaaagatagactggataaagaaaatgtggcacatatacaccatggaatactatgcagccataaaaaggatgagttcatgtgctttgcatggacatgggtgaagctggaaaccatcattctcagcaaactatcacaagaacataaaaccaaacaccgcatgttctcactcataagtgggagttgaacaatgagaacacaaggacacagggaggggaacaaacatcacacaacagagcctgtcggggagtggggggctggaggggatagcattaggagaaatacctattgtagatgatgggttggtgggtgcagcaaaccactatggcctatgtatacctatgtgacaaacctgcacattctgcacatgtatcccagaacttaaagtatagttaaaaaaaaagagagagagagagaaaggaaacagtatggagactttccaaaaaatgagaaacagtactggcctttattctaccaatcccactactgggtagctacccaaagagaaagaaatcatatttcaaaaagatacccacacttctatgtgtaccacaaatctattcccaatagcacatatgacaacctgagtgtccaccaacagatgattttataaaagaatatagcatatatgcacaatttaatactagtcagccacaataaggaatgaaactgtgtcttttgcagcaagatgcctagaactgggggacattataattagtgaactaactcacaaacagaaagccacatatcacacattattacttataagtgggaggaaaacagtgtgtacacaaggatatggagagagggattatggacattggagacttagcagaatgggagggtaggagttgggagcatgatgaaaaatcacctaatgggtacaatgtacgttacttgggtgttgggtacactaaagccaataccactgtgtaatatttccatgtaacacagttgcacccatagcccttaaatttatacaaataaagataaaaacaattacaatttaaaatataaaattattaatagttgaccaaagatcttgaaaattaaaatttaaatcatgatcaataaatgaaattaatatcagttgaacttcatttaacttaaaatccttttgtactcaagtgattttaagaaaatgaatgtcaagttttagatgaggagatttgcaaatcatatcaccacctatgtaattatagtaagaaccctcaaaactcaacagtgaataaaagaagaggcaacccatggataaaataggcaaaggtttgtgcaggcatttcattaaagaagatgtacagattacacataggcatataaacaggatctcaacaggatttttcatcacagaaattcaaatcaagaccacaataagatacccaaacaccctttttagaatggctgaaattaagaagaaagatggatcataccgatgctggtgagcataccaggtttctagagtctaaaacattgctaatgggaatgcaaaatgaaacagctacacaggaaaataattcttagtttcttgtaaaattatatatgcccttaacacattacctaaaaatccccctcctgtaatacagtaatacatggctgtgtattactgtgaaagaggcatagtgtgaaaacccacatcttgaaaccctgagggagaaggcagctatgctgtggctgaggagattacagggattatttgattaaagacttttttagaaagtgaggttaaatcagccgggcgtggtggttcacacctgcaatcccatcactttgggaggccgaggtgggtggatcacgaagtcaggaatttgagaccagtctggccaacatggttaaactccatctctactaaaagtgcaaaaaattagccgggtgtggcggtgtacacctgtaatcccagctactctgggcgctgagacaggagaatctcatgaatcggggaggctgaggttgcagtgagccgaaatcgacccactgcaccccagcttgggtgacagtgcaagactccgtctcaaaaaaacaacaacaacaacaaaaagcgaggttaagtcattgaaaaataggaaaatataaatgtgtatgcactctaattatttgggaaattttccatacaacttgtattctgtaaacaaaattcagggagtggaaaacaaatcaaattaataaaactgatataagaattcctctgaagatattagtgtgagcactaacacacacttttgaatgggtgttgtaaatattttggaacacacctcttaggtcacattttaattctacatttatgtaaattatataaaatatcgaaattttttaatgtctccattttgtgcagttataattttggtttcatgccagcaatgcatgatagattccgttcttccacatcctcgttgccatttggcactataagcattgtgtattttaaccattctaatctattggtggtgatagctcattgttgtttaaatgcacatgtctctaaaattttatatttaattattttatataattgtgatgaagtgtttgttatggtatttggctcatttttgatagcattgtttatttttgatcagttgtaagtttctttacatacccattatataagtcacttaaaaaagtacttagctggtcatgaaccccaggatgagatgcagactgtatagaaatctctagcaatgttactcagtgtgggcagggatggcatgagatacggggaataaagaataaagtaactttctccatttggatataagatgtgtccattcactagagagttttctttcagaaggttcccatgtgagccagtttccttcctgacaaggaaatcacccagaggattctcataatctcttaagtgagaaaagttttcctcaaactccagctcagtctagctcacactgtctctaaatgggcaattactttcagacatgtacacacatctgtcccaacgtggactcctccctcagacaagcacacacattgcaatgtggactctcccctcagaaaaccacacatgccccacaatgactccttcttcacataagcatatatgcctgatgctgaactgctgtgtagcaaaattagctcagaatacaagcacttatggactctagccataacaatgtgtagatctgcattttattttaaattctaaatgaacattttgccttcttgttaagaacagtggtttacagctctacatgtagagactacaggcagatatatgtttcctctgggaaaagtttattttcatgtatttactgggttattttgttgataaacattcatctataaagacacctgaaaagtgccctcattagagaaaaagaaagtgtagtttgcagattaactctgagcatccaatcccaggaatcctttgatctgccctccctgaaatccacaggcagaggggggatgatcgctgataagtagcaaacacatgtccacaggaagggagacatggaaatgtggtcactcccacactcaagaggagcagctcatcccctgtccgtagtggtcctggtgaggagccaccccacacctgtgccttcctcagtatccacaccatggggtctgtgctgatctgggcttcccttctcatcactctcaatattagtgtccttgcggatcaggctcagctgtggctgctccagatgaggctgttctcagtctgttccctctgtgtttgcagaagtcctgtgtgaagttcaccgggggagacagaggaaataacggtgcagccgggggctatctgagtctctcctgcaaagactctggattcaccttcactgattgcagcataagcttggtccagcaagctccaggaccagggttgatgtgggcagcaacagggagaaattgaagaggaagctctcagtggtgccctccatgaatacaaagaatcttcacagtccccaggacacccttacgtgcatggtctcactgatatctttacttcttttatcacttttgttatgtaaatcacaatgaatagtgtattcctcatctattatacatttgttaagtcttttttggtgtctttaaaaaaactgataactttatagtatgtaatatccttaagtcctgaaagtgttttttgatgtctaccttgtcttaaatttatacagctactatagcttttcttggttcatgttttctcatatttatcttttctatttgtgaatatgtagagaaactttcttgtacatagctaatagttgtgtattgcttttttattttggcagtccttaaatattctaattttttatgatactttaagttttagggtacatgtgcacaacatgcaggtttaaacaaacaacctcatcaaaaagtgggcaaaggatatgaacagacacttctcaaaagaagacatttatgcagccaaaaaacacatgaagaaatgctcatcatcattggccatcagagaaatgcaaatcaaaaccacaatgagatatcatctcacaacagttagaatgacgatcattaaaaagtcaggaaacaacaggtgctggagaggatgtggagaaataagaacacttttacactgttggtgggactgtaaactagttcaaccattgcggaagtcagtgtggcgattcctcaggtatctagaactagaaataccatttgacccagccatcccattactgggtatatacccaaaggattataaatcatgctgctataaagacacatgcacacgtatgtttatagcagcactattcacaatagcaaagacttggaaccaacctaaatgtccagcaacgatagactggattaagaaaatttggcacatatacaccatggaatactatgcagctataaaaaatgatgagttcctgtcctttgtagggacatggatgaaactatctattgcttttttaaatcaactataataaattctattttttttttttgagaaggagtctcgctctgtcgcccaggctggagtgcagtggtgcgatcagggctcactgcaagctctgcctcctgggtttatgccattctgctgcctcagcctcccgagtagctgggactgcaggcacccaccaccacgcctggctagttttttgtatttttagtagagatggggtttcaccgtgttagtgaggatgctctcaatctcctgaccttgtgatccacctgcctcagcctcccaaagtgctgggattacaggcatgagcaataaattctatttttaaaccaacaatatttttttccgttaatttttgtttaaattaacattttgtaatgatgcttatttctctattaacatggtatttaattacctttttataaatattgtatagttaccataagatttacaataaaaattgtatgtaattagattctaatgtaaatcctgtgatggccttgatatgaagaacacagatagtgtaactgtgtgctttgaattcctccttctcgccactctttcttgtttattctgtttgcacttacatatgctgtaaaatagaatatgtaattttttattactttatacagttatatcttatagcaattacaaatgttaaagagtacaattcatctagatttttccatttttacaatctttatttctttgtagagatttctattttgagtgcatatcacatggctactcgcagagaatctttgtaaaatgtgccctgaaacatgaatgtgctgacaacacatattctccagatctttttttctgacagaattttatttgccattcacctttaatgaaattttaatgcatgtagaatttcagtttgcatttcacctgtaatttattttcttgtaattattattagtttttcctggagatgatcacacattacattctgctgggcctttattaaccatgtttctgcgaacctagtcaggcttgggtttcaagtgtatggttgccgtggctatcagagttgaaatcagcttctcctgttcacaaaaacttcaggttcctctggtgatacctgcgtttgtgtccctgtttggctttggatcttcacatttcattctccccaaagaaaggctgtctctttcagctgtggcaggtgcatcctgctgacacatttacttggtgactttttgtgggatgaaggggcttggacacaggggcacgttttccaaccttctggctgagcctccttcttagctatgggtggtgagactggctctgatgcatgatcttccaagtgttcctgttccttcccttcctcagtgtcacagtgtctcttcccagtcatgctgttttttcatcagtgtcctcagcttctgacccactgtccttaccccacagattctggatttcattcctcaggaaacagacgggaggtgattctgggtagagtttccctgatgtcctctgtttccttgtgttctagttgattctaccagtgcccacaggacacaagatttaataaatgtctcctgcatataatgaagggggattcagcattgaacggagctactgttcttcctccccagtcaacaccacaggacagcaggtgggtgagttgtctggggatttccccaattctgtaggaaaagcctgcaagtgccaggagtttcacactctcacaccattagcacacacgtcttcaagcaactcattaaacatttccaggttagctttttcctatcttcaataccatgccatgagtggcacctgccccaggtactctaataaacgcaccctagttctctctgcgggcccctattttctcatatttcagggatttttttctctgtgacatcaactcagatatggtgaggggtttattttttgtaattcttcatgttttttgttaacgaggtcagaataatatcattttctcaatttttacattctaacgcttagtatctgatttctaaataaaattcagaaactaagacaacaaatgaagtatccattatttggtgcattgttaaacaatttgagaaatattcatgtactgaaatagaatgaaccactgaaatcaaggcatgcctcattcacataagaacatgagggcattatcaaataattttgctgagtggaggaagctaaagaattcaccatcaatttcatgtgatttcatttgtataaatcacagaagatgcaatattctaaattaacatagagaagatctgaatttctctgaaaatagggtgggcagagtaacaacgtggtgaaataaaattatagacaagttagataaaaaaattagaggttaacttaattgctaaaacatgattgaagtgctgattcaatgactgcacacatatatcaacattttccaaatgcttcactatcaatttgatttcattattgattgtttttttaataaagcagtaataaaaatgaatatattggctgagaaagagcaagaaatggataaataccgacacttgaataatcaaggactcctgaaaatacacacatgtgaacactgattgtagatttcaggtaaacactagaaaaggcaaaattacacaaagttgttatgacaggagggacatcctgaaaacctctctaggcatgtcccacaccaccctggagctgtctcaggggagcagtctcctccagtgtttagaggcacaggcacgcataatagggctaactctggccagatgtgtgatattggacacattgcacaactgctctgttctgtatgtaatttatcttctctacaaatgtaacattgacagttgcattaaatatattctgcaaatatgtaaaagttaaataagctgatgtctgctaaatgattaccaaggcacaatcacataatctgaagttatattttccagagtgataggattacctccagagttttccaggacactctcatctgctccgggcactgccttctcctcagccgtcccacccctgagcttgctatatagtaggagacatggaaatagggcccactctctgctgataaaaaccagcccaaccccgaccctgcagctctgggagaggagcccagcccccgaattcccaggtgttttcatctggtgatcagcaccgaacacagaggactcaccatggagtttgtgctgagctgggttttccttgttgctattttaaaacgtgatctatagagaactagagatattgagtatgaatggatatgagtgagaaacagtggatacgtgtggcagtttctgaccggggtgtctctgtgtttgcaggtatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccagagacacagtgaggggaggtcagtgtgagcccagacacaaacctccctgcagggccatgcgggtggtttcctttctcagctgcaggaggcgggcttattgttgcaggactctggagacttattaggttgtgatattttactatggttatttatcatgaacttttttattgggaattgtgttttattaatttttattttatatgtaaggttatttttttaaaatacataccttcaagaaataattcttcctaataatttgcacttgttctttttagagttttgttaacatctgttgatatcagctactacatagctatagggacattaatttacatctatagacatatgtgtaaatacacaaacttatacatatatgtggtcttttatatttaatgttataataaaattattataacaattataaaatacatcctaaagaatgaaacatatatagtaatccatattcctttcaatcattgcctatagtttacataaattgatgtctatttgtaaccttaaacatagtgtattggtcattttcaaacatccaagaacaaatttcaaatgtccttgtcacacacacaaaaataaaaatttgaggatttgaggtgatatatatgtcaatcagctcgattcaattattccatattgcattcataaatcataacatagctttattcactataaatacatacaaccaaaatttctcaattttcaatgaaattttaattatacatattttatctgtcctaggtcatgaatgtttttctccctgtccggatgtgattagattgtcctgagaaacaaattcagcttcctgcctcctgaaggcttcaggaagcagctcctagatggggtgaagcaggcaacccgtgtgtgtccacaggacccggagcctctctctccttggattaggccccctcctcaggattacagggctcttcagttttctcaacatgctgttataccagagaagcacaaaacacttaatttcattatatttttcttcaatttttcaaaacaacacaaaggtaataattttaacaataaacatattacaacctactatacatgagacccttcctgtgcttcgaggtttcttctcaggactttgtatgtattacatgttttcagtttttttctgagatggaatgttgacgtctccttattacagattattcttttaatttgtctcttagaataattttttccagagctcctgcccgcccgcgcctggcggaatggagcggcgccagggctgagccaggcgcgcaggggccgccgcacgtgccgcgcggggagcggatgcccagcgggcggagagccagcgccagaggccgggtcggagcggccgctggagcagcgtcagaatgggagaacagcccatcttcaccccccgagcgcgggtcttccagattgaccccaacaccaagaagaactggatgcctgcgagcaacaggcggtcaccatttcctgtttctatgatgtcacaaggaacagctatgggatcatcagtgtggacagcgccaaggtgaccataaacaacacaattacacagaatatgaccttcaccaacacgtcacagacgtctgggcagtgggccgacagcagagccaacacggtgtttggtttggggttttcctctgagcagcagctgacaaagtttgcagagaaattccaggaggtggaagaagcggccaagacagccaaagacaagacccaggagaacatggagccctcgagtaatcatcctgagaatcagggcgtggagccccatcttctactccggcatccagtgtcaacgggacggacgatgaaaggcctctcaggccgctgcagccgacacgcacctgcagtctgggaaccacaagctgaaggcggcctcgacgcagagctgcccacgggaagaggtgggagatggagctgcagacccggcgggagaccgacttccggctgcccacggcgctgcaggagtcgacggccagtgcggagcagaggaagaggccgtgagtcagagtgcgactgtgtctctgagaagatggaggcggcagagagaggatcaaaacctggaagataaagtgcgttccctaaagataggccctgaggagagcaaatcccgacagcgccacctggaggcgcttcctggtggcgctggaccggaagatccaggcctgcataacttccgcccaggcctcccaggctgggcaccaacaactagggctggcagaggcccgggatccccaacgtgagtcctaagtatgtgtgcgagaccagatggcgctaggacgttccctgtgtgcgttgcttctgtaaatgcaggcgccgtgtgtcgtgtttccaaaccagttgtgccatccactcactcctttccagaatagaaatctctcgcttctctggccttgtgaggttgtggacaactggaagattctgactgaggaaaccagaaccaggtctaccttcaacatttacgcagtcaggccagggatgtttatatcgttcataagggttgttggaaccatatgaactgaaaaaaagcattttctcatccaaatattgatattctttacaccaggccatcgggctccttttatccgatagcattcagagtatttgaaggtcctccaggtgccagccttgggggcacagggagaacaacattcctctccgaaaacatggggaagctttaaaataactgtttagtggagacttgcccagagatggaaaacaggtttctggtgagtacattttctggtttgggaatcacctgcatccccgatcctgccccgtgccccccagtttgtatggttgtgacaatgttccatttctttgttttaatttctgagcagttgactgtggtgcgggaacagcacacagtgagggtgcctagcacaatgcctggcgcaaagtaggtgctttataaatatttgttcaattaaaaaaaaagagggaggctgaggcaggagaatcacttgaagctgggaggcggaggttgtggtgagccgagatggcgccacttcactccagcctggcaacagagcaagactccatttcaaaaaaataaaataaaataaataaaataaataaataaaataaaaaatattttttccaagccccactcaaaaccatggtattgttagaggtgtaatagttggaccaacattgaaaatacattccatttagttcatgggcgtgcaaatatccttttttctttaaaaattgttctcagttgtaatattacaaaaaatattggtaatttataccaatgacacaggttaaaatgttgtataaataatttaatgacgtttgattggaaaaaatacatgtgccacatgtcgacaattttttccttctctatgaaatatatactcattaataagtttcagatgttacagttatctttttgatttctgggatttaattttagtaggtatacttgaatgcattttattaattcctataatgatgttgatatttcatgtaggattttaatactaattttactatttactgaattttaaactattctacatgttttatttatataagaaaaaaattacatatgagaaaaaatgcgtagacctgaaatgtatcactagagagtttctgtcaaatgtgaatacctttgttcccaacacctaaggtagcctgaagagcaagtccttccccacaacatgcgtctttttctgtgcttgcggtcagctcctgcatggggaaatgttttgatttctgacactatagatccattttttttctgttttgaactttatataaatgcaatcaaacattttagaccttaatttggtaatgggctacattgctattttttgaggttatttcctgctatttaaggtattaaattagatcaacatattatcatttattcaagtaatggactgactctgatatgaaacctcaaagttttcacatatatatggagagagagagagagagagagagatgagggagagaggttttatatctgagtcagtctgttaaataagtaaatgacagtattttgatttattttcctgtaaatcgactttaaatttgtttccagtttatgaatattataaacaaagctgttacaaatgtcttagtgtaagttttcctatgttgtcttccttttattgagaaaatatgaagtatgtatttattataagcttaaattttttcagttttattgaggtataattgaaatattttaataatgtatagctttaaggtgccccacttgacgttttgatgttgtattagtccattctcacggtgctataaaaaatgcctgagactgagggatttgagaaaaaaagtgtgtttaattggctcacggttctgcaggctgtacaggaagtgtagtggcttctccttctggggagagtcaggaaagttaggatcatggcagaagacaaaggggagcaggtgcgtcacatggccagaccaggagccacaggaagcagggaaggtctacacactgttaggcaactagatcttatgagaactcacacactgtcatgagaacagcaccaggagtttgttctaaaccattcatgaaagacccaccccatgtcccagtcatctcccaccaggtcccaccttcacaattgaggattataatacaacatgagatttggggcaggacacagatccaaaccacatcagatacacattgtgaaatgctcatcatggccaaggtaatttgtatatccattttctcatggagctaccattttatttttttaaaatgtactacatgtgtgtgtatgtgtgtgtgtctcatgagaacacctacgatctacccgttcagcaaaaatcacatttacaatacagcattaaatacaagaacattgcagtacattagatctgcagaactcattcaccctgcacaactggacctctacccttcgaccgacatcatctgatttccctctcctcacaggcctgggacccactattctactctctgctttcaagagcttgaatattttagatcccacatgtaaatgagatcattaagtctttctgcatctggcttattccactaagcatcatgtcctctagccccatccctgttgttgcaaatgtcagaatttccttcttttcaaagcctaataaaattcagttttctgtgtacacattttctttacacattcatcaatctgtggtcattaaattattttacaaatctacactattataaataatcttgcagtgaacatgtgtttgacataataattttatttcttttgaatatatgacaagaagtgggatcaccagagcatatgatagctttatttttcaatataatgaataaccaaacctaccacaccatgcttttgaagtcttagtcatattttatttgcctaggccaatgtcccgaaaaatttctcctacattttcttcagtttgtacatttaaatattgaatccatattcaattaatttttgtctatggtgaaaaactagaagtctagttttattcttctatgtgtggctgtctaagtttttcagcaccacttactgaatagagggttgtttctccattgcatatttttgtcagttttgtcaaagaacaggtggttgtagaaacttgtctttatttcttggctgtctattcttttacattattattattgttattgtttttagtagcagtaccatgctgtctttcttactgtatctgtgtagtataatttgaaatcagggaatgtggtgctttcagctttggtctttttccttgggatttcttttgctattcaggctgttttttgattccatatatatttaaggattttttttaaaacatgtaatcaattatattggttacttgataaaaattgcattgaatatgtatcttgctttggacagtgtattagtctactgtgcattgctataaattaatgcctgaggccaagtgatttacaaagaaaagaggcttatttggcttacagttttggaggctgtgtgagaagcatggcaccagcatctgcttcttgtgagggcctcaggaagcttacggtcatggtggaaggcaaaggggaagcaggcggtgtcctgtggtgagagggggcacagaagaggggaggagggtcgctagactgtttttaacaatcagatttcaaattagctaataaagaaataattcactaattaccatggggttgataccaagccatacctgaaggatcttttccccacaatccaaaaactcctactaggacccacctcaaatattttggatcacatttcaccatgagatttggaagggacaatcacctaaactgtagcatttcactcttgtgtcccctggtctcaaatccttgtaagattgcaaaatcatctttttttaaaatagttcccaaaagtgttaacttgatcaacctccaactgaaaattacaaagtctcgccagggtcttaaggcaatttccctccagctgcgtgctggcaaaatgttttaaagagttatgtacttccaaggtgcaatattgccattgggtaaatattgtcaatacaaaaggaataaattggccaaaggccccacacacacctaaagcctagcaggacagatattaaatcttaaagctacaaaataatctatcttgactttatgttcttagtcagggtacaccaggacaaagtgggtcccaaaatcctcaggcatctcatccttatggctgggcacattccatggggctaataacacaggccagagtcaagtgccagaagtagttccaggttgggagtacaagctgcctttggatctaccattctgggatcttgagggttgtggctgcatttctgtagctccactatgaagtgccctagtggggactctgaatggggttccaaccccatctttccccatctttggtactgccttcgtagaggttgtttgtggtggatccagtcctgtagcaagcttcctcctgggcacatagggttctctacacatcttctgaaatctaggtagaaactgcccagcctccttcactcttgcattctgcatatctgccagaatccagttatcccagcaccatttactgaacacagaggtttttttccacattgtttgtttttgtcagccttatgaagtatcagacggtttaggtgtgcagctttatttctgtttcctattttgttccgtttcttctgcatatctgctcttgtaccagtaccaagctgtttttgttaccatgtcattatggtgtagcttaaagttgggtatcatgatgcctctggcgttgttctttttgcttagcattgctttggctattcagggtcttttttggttccatacaaattttagaatagattattttttctaattctgtgatcaatgatgttgatagttttatgtaaatagtactgaatctgtaaattgctttagacagtatgataatttttacaatattccttcttctaatccataagcatgaaatgttttcccatttatttgtgtcatgtatgatttatttatttatttatgctgtgttttgtagttctccttgtagagatctttcaccttgtttgttacctgtatttccaggcatttcatttgtgtgtgtgtgaatattgtaagtgggataagactgtgttcttgatttcactctcagcttggacatagttgggtatagaaatgttagtgattcttgtacattaagtttgtatcctgagactctaccaaagttgtttatctattttagaattattttggcagagtctttagaattttctatgtgtagaattatatcatcagtttggacagatatatctacttcttttcccatttagatgttgtattagtctatttgcacactataaagaaacacctgagactgcataatttataaagatttttaattgtctcatggttctgcaggctgtacaggaagcatggctggggaggcctcaggaacccaacagtcatgacagaaagggaagcatcatgtcttacatggctggagcaggaagagagaggaggtaggtgccaagtacttggaaaccacatctcctgagggctctgtcatgggaacagcacaaaagagggtgaagcatccccatgatctaatcatccctcaccagtccccacctccaacactgggaataacaatttgacatgaaatttgggtggggatgcaaatacaaaccatatcagctccgttttattttttctattgcctggttgctctgactacgatttccagtagtatgctcaataggagtggtgagagagggcatccttgtcttatttcagttctcaaggggtttgagcttttgctcactcagtataatgttgagtgtggttttgtcatagatggctgttattattttgagttttttttttttttttttgagacggagtctcgctctgtcgcctaggctggagtccaatggcacgatctcggctcactgcgacctctgcctttcggggtcaagcgattctcctgcctcagcctcccatgtagctaggattatggttacgggcatgcgccatcacgcccagctaattttttgtatttttagtagagacagggtttcactgcgttagccaggatggtctccatctcctgacctcgtgatccgcccgcctcagcctcccaaagtgctgggattagaggcgtgagcccccgcaccaggctattttgaggtattttttgatgcctagtcttttgagagtttttatgagtgaatgttggatctcatcaaaagctttctcagcatgtattgagaaaatcatatgttttttgcttttattttgcttacatggagaatcacagttactgaattgtggatgttgaatgaaacttgccttccaggggtaaagcctacttgatcatgacgtatcacattttaaagtgcttctggattctatttgttagtattttgttgagaaattttaggtctatgttcaccaagaatattcatctgatgttttcttttttaattatgtatcttcctgattttgtatcccaaggacacacaatgaaggaaggacagtctcccaacaaatgatgtaaaaactggacatccatatgcaaaataaataaaattagaccttctctaacaccatatacaaaaatcaacaaaaataaacataacatgaaaccataaactcatagacaacatggaaaaataattcatgtcattgattcagaaatgatttatttgaagttaatcccaaaagcaagcccagcaaaaaactacatgcaattatatatctgacaagaagttctatcaaaatgtataaataatccatacaactcaatagcaaatatcaaatgacctcataaaaagagcaaaaacctgaatagatttttttcagaagacacatgcatgaaaaacagagcataaaaatgtcctcaagatgactaattgtcagaggaattcgaatcaaaagcacaatgacatatcacctcacaccacttaaaatggctattatcagcaagacaaaagataagaaatgttggcaagaatgatccacagccataaagagagctttgattggccaagagactgatttcagtaactttctcctgtgaagagaccactgaccatggacttgtcctggccaatttccagaggctgtgcactgtgtgtctttctgcccctgcacaaagcccttttgatatgcaggacccaactgtaattcatttagttcttaagtcctcaccccaaagcaaagctgaaatgcatgtatcatgtgtgtttgcttattagacatgagagcctccactccatgtgaatatccatagctccttctatagcctgctgagtgtgtacactcgaccaatccatttgcacaaatttgtttctcatctttccctctcttaaagtgcctgctcacagtctctgtgggaggctttccttcccagcctgttaagatggccatcctgcagcttcaaccctttctgagaaataaagtctcctttctaaatttataaactgggtgattcttccgttgaaagcacaagctgttgggaagagttatatggcaattccataaatgcctggaagacaagtgtggatagggtagggtaagaagtcctgggggctgcacaccccactctgatggaatttccctccagaaacttctgggttctcaagatgagaatccaaacagattccctcatggctctgtcatcaggagaactatactctgataagtatgcccagaacttcctccagacagaccctatagggaaaaaatacttttcaagatctttattctgtgaggggaagggattcttttccatcccagacagcttcatcttagccttcctgagtcatgaaaaggagtataattaataaaacatctggggtcagattcaagaaaataatctgtggatgctgcagccaggagggggagtggaggacggaggaaaatcagctgtaccactgaatactccttgtaaatggtacagcctagagaaagaatagcaagaaatcattggaattcaatttccagaacatatactgctcccctacccaccacatcacctcaccaccaatatgattaatctggattaaagagaaaagtgtggaaaggcacagactccatctaaggactagaatttagggaaaccaaaggcagtgggagagaaaaagtcaaggacagtaaagtgacttaaaacctcttagaccaacagcttcaggaacaaggtcacatcctctccctcactgaaattagatttacctctcatggggcatctgcagggtgcgcaggtgagaactggcaaagagaacatgaaggcactttccaaatctccattagtacctagctcgctttagctgtttggaaaaagcaaaaccacaacaaacataaccaggactaggatcagtgttggaagcacttttcactggcaagacactaagaaggagggcaaattcgaggccagttactatgcaaatatgccactgtgagtgtgtgtggtggtgagctttgagacatagggtctgtgggtaaagttataatcgataaaatcttcaaccacagaatcctaaaaaaaagagccttccccaaagtcccatcagttcctggactcgccatgtgtctggaccgtatcagtggatccggagctccagggaaggggctccctgatggcttttatgattccttgcttgccgtgctgaggtctccctgtagattatgttgggttttctaaggcctattttctattgtaagaggtggtgggggaaacaatttctgtcactgaaagagcattctgagccagggcacagccccttcctactgagcttgagattctgggaggaaaaagttctctgacaggaggaaaaagttcccagacaggaacttccctgcagggcaggagctgagcggcagggggcgctcagggagcacccagcacaggacccagccctggggcaggtgcacaggaggctggggcagggttttctctcaggaattgaatgttccttatttcaaagcaataatgacctaacatttaaataagaatttagcaagtactgatgtgcctgtaagtattttattgtatacgcagcctatacctaacccaataatttaatgcaaaccggatttaaaaggagaaatgtctaggtctttcaaatgtatttctagttaggaattgaggggtggttttattaattcaatgggtgttactgtccggagacacactcatcccagaagttagatgtgcagagggcaaggctcaggaaaagttcaggtagacagtgagccatatgaacagggaatcacattgaggaccatgtcctgtgagattctgggtttctgtgagaggagttctgtcttcatggacttctgggcatgtcagaggacaaatattaaacaaagttcagggcagggagctcagcatcccactgtggcgtggtccacatgtcacctatcttcttcctcagggtggcgtggcctgagctatgaaaaacctgcctcatgaatatgcaaatgcactgctgtctaccgaggtaaatacagatctttccttgcccagagaccatcacacaacagccacatccctcccctacagaagcccccagagcgcagcacctcaccatggactgcacctggaggatcctcttcttggtggcagcagctacaggcaagagaatcctgagttccagggctgatgaggggactgggtccagttaagtggtgtctcatccactcctctgtcctctccacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagacacagtgtgaaaacccacatcctgagagcgtcagaaaccctgaggaatgaggcagctgtgctgaggctgaggagatgacaggatttatgaagtttaaatctgtttagaaaatgggttgagtaattgagtaaaacagcaatggaaagatgtgtacactgtcattatgtaggaaatagtattttcaactgtcaccctataagtaacactcacagagtgggaaaggcagccatcaatcaagctgatgcaaacattcccatgggggctttgtggggacatacattttataattggatctataaatcattagaaacaggattgcttgatctcatggtaagactaaatataatttccaagaagtggccgaaatttcttccaaaatgtctttgcccttccttttacattgaatttattttaaaggagttttaggatcacaacaagtttgagtagaagaaacagagttcccatgcactcctgccccccgacgctcagccttctctgctatcaacaccctgcaccagtgtcataaatcggttacagaggatgaatctccacagacacattggttgtttccttttctggtggtccctggtataacaagcctcaactatcttgaagcaccccaggttcaagtggattcttcaagtgggttactgggaatgatgccaggtagaaggaaagtgggtgggaccattcctctttgcactctttcctcaaggatccataaaatgtacatttacatggagctcctctttctcctggttttatatgcctcttccccaatggtaaggtttcccagtgtttacagcgggggtccccagtccccgtgctgtggatccgttaaggtgtgcagtgcgttaggaactgggccacacagctggagatgagtgggggcgagccagcatcgctgcctgagctctgtctcctgtcggatcagctgtgcattagattctcctacgagccgaattcactttttttatatatatactttaattctagggtacatgtgcataacgtacaggtttgttacataggtatacatgtgctatgttggtttgctgcattcatcgaattctattgtgacctgcacatacaaggggcctagactgagcgctccctatgagaatctaatgcctgacgattgcagggggaacaagttcatcccaaaaccacccaccgccatcatccatggaaaaattctcttctaccaaactgttccctggtgccaaaatggttggggacactggtgtagaggcaggtctgtaccttggaaagccagcagcttctggtgaatcccataattaatgtcctttaatgagaagtggagactttggtcatgagggccttcgtgaataatgccctacagttggattcaaaacattgtaagctcttggggggtgtttctggataaagccctttgtgcagaaaatgcagacacatccatgggatccatgcaggaaaaaagcttcctttacaaagtggtttggcacctggaaggagctctcagggttgggcactgtaccctttgctggctgcactttagccagaggcttaagcctgattggtcttgcagtgggagagccttcctggggtcaaaggttacaaaaatgcctgtcatcttccagctgagcaagcccatctgcgtgcttgtcagtgtcaaccccatgaagggtgcactctggaagatgacaagatgcacacaaacctcctcccactgattatccactaccacacactcagctgcaacccgtgctccagaaacggacaggggcctgcaaggataaacagaatggaagtattttattacctgggaaagcactgccaaatgccacgtttcaggaaggttaactcataagtgttcaggaagtgactgaagggcagtggtgggtgaggtgacgggactgcctcagggctgcacatgaggagggctccctcccacacagccttttcctccaggagctgcaccaggaactcacagaggatcaggaaggattctgagaacattcttctgtggcgctgactagaggggcaaaataaattataaaaaataaatcaattctaaatataatatgatgtttgttattagaaactatttctggatcctgtgggaaccctgacataagccaccattctctgtgaacaaacatttaacctctccttccatggggaggtcgacgagcttggattggttctttcatggatagtatcccccaaactcctctccactccctgcgtatccccgggtctctcagtgacaagttctcctcagtggaatttggttgatgtagtgagatcttcaaatttcctgtcgtctgtgttctcatgttctccccttatctgagattaagaaacgcacctgcatgtagtaaattatagcctactgtctctcatggacaaaataatggccacgccaaccaaccttgtggctgacagcaaccactggcggccaccatcccctccacagcctgtgttggaacatcacctgagagattgtgttagcaactttccttcagaatcatcttaaaaactttgtgtcccatttcacatggagacgtcatttttccatttcatcttcatagagaaatagaaggagaagaataccaaatacacttcctatctccagattattcaaatataattgtccctttatcaccttctgatttctggtcttcacagaatactctacaaatttttctcactggcgttataccaaaagttgtgaagcaccagatactgggattaatttaaccaacattattattctaataattcttagaatttagaattacaattatcatcttttcgtatacggataaactaacctatgcctttgaaaataagcccttacatgagagtgaaaagctatagatttggaggatttccttgcaaatccaatatttggaaaacggattttatcacaaatatacaaattaacttacaattgaacaacaaaaccacagaatttaattttaaaatgggcagagacctgaatagaaaccatatccaaaaaacaaacataaaaagtgatcaacttgattttcattaggtgtacttatgtttaatatttaaaaagttctactaaactatgagaatgggtaaaaattacaaggtagacaatatcagatggtgatgaggaagttgaaaaacaggaactttcaccccttgctggtgggaatgccgaaatggcacatagaaaactacagttaataatttattgtatatttcagaatagctacaagataagatttggaatgttcataacactaagaaataatcagtgatatagatgaaggatatcctagttatccagatttgatcactgcacataaaatgcttttatcaaaatatcagttgtaccacctaaatattttgaaatattgtgtatctatataaatcaaacattaaaaaacaccaatgcagtggaatccagctaattgcagattcccattagatgggatgtgctgcatgatctgtaaactaatcagaatctgtgggtttgtaaaggactttagaaatcaactaggctgcttgtttctaaagataagtctccctagtttaaatattttcttaatgggtggcgattttgaacatagaagaaatagtaatatttgtgtcttgtaagttttcttcttctcgtgtcacgagaaaaggtttgcagggaggaatctgggaccatctttcaagtctcaacttcactgtgattacctcagtaagtattttctgatacccctgactaagataagtctcgtatctgtcctagaaactaaaagtagaattctaagcatctacctgaccagatggacccttcctcttcaccaaggagttccagagacacttttaaacctagctccggccgtgttagaaatagaggatcagaaatgcctcattataccctcctccctttggaattcaagcacaactaaccagcatttttatgaaaacagagcttaaggctcagaaaacagattatttgtagcagtaagataccaaattctaaccttattcgagaatatcatcacaggacagagagcaggcattgaaaggaatcaaaggcttttaccctaaaatatattcctttgacatattttaaaatagccaggcacagttatcttttgtgagagagatttacattctgtagagaatctccttccctttccaggtctttttcttataccgaggagattagctgagggtctagcttcttttaaaggtcttaggagaaaacatttcccagctattgcctctaaaggtggtcacataagagacttcatctacatagtaagaatcttgttctccaaaacctgttatcttaacctagaaacatttttctaccggtttcaggtctttagaaaaaagcttaaatctttcaatcaattgtcaatcagaaaatattcgaactcactgtaagttgtaatccccgccacacactgcctcacttctagctgttttgtctttatggaccaaatcaacatatatctcacatgtattgtttggtgactgtctctctagtacactaaatttaagctgccatcaagccactttgggcacatgttctcaagatcttctggggctgttcacagttcatggtcctcacattcgcctcagaataaatctctctaaatattttgcaaggttgctttttcatcagtagttctaacagaacctactctgtggtttttgttaaaagcattatattaatatagtattagtaatattagtattagttataacacatgttggaaaattcttatgaagttatgcatagactaacaatgggatcaagtgtaaatgtttcaaagtatttaagcaagttatttcaaaatttatcttctgcagatacttctatcagattcattatatcagctaattacttgctttatgatttttgcattttattgtagatgatcacaccctatattttcttggcctttattgtagaaaattgtgtgaaactagtcagggctacatttgcaagtaattgtcgcagtggctgcctgaattgcagtgggtttcctctgcagccaccagtcactcagattactccaatgacaccttaattttgtttcctgcttggctttgggccttagtcttgtgctctccagacagactctgtctttcatctcccctaggtcaggccagagccacatggacctgatgattgtcaatatggtgggaagggtcgcactgaacgggcactctctgtccttctgagggagccatactgcaggcagacatggcagtcctggctcagggtgtgtccttccaagtatccctgcccttccttcaggtgtgatgctgatccatgcatcttcctcccattcctgggtagagggtctccttgttctttccccaatcttctcccagcagccactatgtcttcccactgatgtcttcagcttcctcttttctgcccttcccagcagatgagtctgttattcctgagggaagagagaggaggtgggagatgaggctgttattcctgaaagaatggacagagctttggagcttttctttcttctaccccagtttctacgagttcctccagtgcctgtaacacagagctgtcagtggctttgcccctgcatgttaattctttggtcatgtagtggtggtgagggagctgggtctggatgcatttcagccacagctgctgttccacttccccacacagaaccgtctcaggaggaagaggttggagatttttctgatgtgtcctcaatcctgggagaaaagttttcaatagcaataggaatctctcagttgtatgtccgctgagaatttaaacaataacttctttataatactaaattttaaacaatccaatgaatatatctaatttaattttgtattagcttatgtgacatttgctggcctctcccccagataaggtcatattctcttcctgtttgttcctgcaagtcactgaatttcacaagatgtaaggtctcttgattatactataacatcaataatctggtgtactaaagaaaatgtgctaatttgcagcttactaaaattagttgttttagtaaaaataatatatttgttatagcatgcctacatctccaggctgagtagaagctttgtttgtaatactcagaaactgcaaataacacacatattaaggagctttctaaataaatactatgggtgaattctttaactggaatactgttcctcattagaatcaacacattctttatacacaaccaaattactgactcacaagtaattatactgagcaagaagccacacaaatgaaattgaaaatataagatttcactttaacaaaatcttgaaaaatagatctgaattaacaaagatgagaggttgactcagtatggtgagagggaaataatggggaggcaggaatgagaggaacacagggaggcttttaactgtaatcatcgttatctcgattgttattttggatacacaggtgagcacacgtgaaattacgttttttttccttcggagacatggttttgctttgtcgtccaggctggagctccgtggtgagatcatagctctctgcagcctcagaccctgggtctccagcaatcctcctccctctgccctatgtagctgggactacaggtgtgcaccaccatgctcggcttcagtgcgtattaaaccgcacacttcaattatgcagtatttattatatagcaataatgcctcaataagggtattacaaataagtggatagataatttgttaaagattgatggaaagatagataccaacatgagaaatgtatgacactcaagaaaataaaactgtaggaaacttgcttttctttatatttgttaggtaatcaccacagtgtgtacacatcacaccatgttcccattacagagaaaaggttctgcgaacctcacgagctgtgacccctgtgtgctgggcttggttcagggagaagtcaggtccagtggtgagaagcacaggcccagatgcccaggctcactctgaccaaatgtgagcactggggacattgtaaaacccacctgtgcttttgctgataatttttcatctttaacatggaaataatattgatactatataccatggtttctctgcgtatgtaaaaataaaagatgattggtgctaactttaaaaatatgcagtttatgtagatctatggtacctcaataaaactgttttaaaataaaaattacaaaattataagattttcaggttttaaggtttaagtttatcacaaaacaaactgacaataggaaagcacaatttcccaatgctttcaatatcacagatctccccgaggacattctgacatgctctgagccccactatctccaaaggcctctcaccccagagcttactatatagtaggagatatgcaaatagagccctccgtctgctgatgaaaaccagcccagccctgaccctgcagctctgagagaggagcccagccctgggattttcaggtgttttcatttggtgatcaggactgaacagagagaactcaccatggagtttgggctgagctggctttttcttgtggctattttaaaaggtaattcatggagaaatagaaaaattgagtgtgaatggataagagtgagagaaacagtggatacgtgtggcagtttctgaccagggtttctttttgtttgcaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacacagtgaggggaagtcattgtgagcccagacacaaacctccctgcaggaacgatgggggggaaatcagcggcagggggcgctcaggacccgctgatcagagtcatccgcagaggcaggtgcagatggaggctgtttcctgtcagggtgtgggacttcatcttcttctgacagtttctctagtgaacctctctaacctcagaattctgtgcttactaatgtcatctctacgtattttttaaaagatcattttaatatgagcacctattctcacacgcaccaaatgcagattgacgcttacagagatgaaaagttctcaaccatggtcaccaggatgagagtcctgaggaaattcaggggtgcctggtgactcttccgcaatcagtcctgggacagaaacctcagggacagcctttatgagttttgatcacatctaacagagaggatgggccagggccagagtcatgtagaacctcacaggttccacgtctgacccttctcctgacactaaagccaatcagcatcagcactgacctggtgctccttttgctcccaatccatgttctttctttggagagtttcttctcccttttttatttgcttttcctctttcctgaaaaagaaacagatggtccccttggtccacattccagggctcaaggcattttcttggagctcaggtggggctcaggctgtggctcctgcagccacgtgggagaggctgatgggacttccttctctccccattttctcaggaccctctactgtgttgtgtgtaggctcatctgggaatgcagttgaccattaatactgaaggggacaaactcatttgatcaaaatgggatgtggatgtggagttaaccctgttccgtgcacagtgtcagagtcgtctgcttcagaagtagtgttagaaagagctggtgaaatttatcagaatcaagatggagccacttgtgttaaagccctaatgaatgaagctggggaaggccatgaaggagggttctaacacacatattcctgataataagaactaccataaatagactctgcacaaccataaccttgcacagaagccaccacaacattaaaagaattacttctcccattgtatctgcccagcaactccctgttcaactttacaccgatgtgcccctgttattgatccttctagcccaggacaattgtcttaaacagctgatgtgaccctcctcatttttcctttattctttatcttcctataccaacctgaatgcacccatacatttcaattgcaatacacttcctagaatacatattattatattttagagtctctctctctctgttattcagggttgacaagctacagatggacatgccactttctttttttatgactttttttaaaaattttattattcttgtactttaagttttagggtacctgtgaacaatgcaggtttgttacatatgtatacatgtgccatgttgttgtgctccacccattaactcgtcatttagcattaggtatacctcctaatgctctccctccccactacccccaccccacaacagtccctggagtgtgatgttcctcttcctgtgtccatgtgttctcattgttcaattcccacctatgagtgaggaaaaaaatgatgagttcatgtcctttgtagggacacggaagaaactggaaaccatccttctatcattctcagcaaactatcgcaaggacaaaagacatgccacttttctgtgagatgtggaggatgacagtttttggagatgtctgggaatacccagtgtccagaagatcatccatcaataagtgcaggctggaggtcccagagagaggcaaagctgctgaaacaccatggaatttcattttctccagttctgctctgatggaatcaggcccacctgttttgcttgtcttaagtaaattcacagcaccacatatattagtgttgcagtgaataactacaaagtctatcctaaccaagtgtaccatcaaatttaccattacccagagggaagaatctttaacatgagatctatgttcataattttttaaggtgaaaaagtgatcactatccaatcaggcaaatatgattttgctaatgagtggtagatgttgcatgtatttttggatgtcatccctttttcagatgcatggcttgcaattatattttcccattctgtaggttggaattatttccacactttgtagaatctttttgttgtgatgtagttccacctgtttaattctgcttttgttgtctgtgcctttaatgtgaaatataggaaatcattgttaatatattattttctgggtcggggaaattttacaattgcaggccatatgtttaaatatctggcccattcagagtgatttttgtgtttattctaacccaaaattcttaactctttgcatgtgtacatccagtttttctaacacattcatagggagagacttggtttatctgttttatattgtgggttcttatgctgaaaatcagtttgccattgatacatcagtttatttctgagctctttctacatatttatgccaactccatcctgtttttattattctacttttgttattacttttgaaatctggaagtaagatgtaagtttatttttgcctttttacagatgctatagcaaaatattttaacctttcactcttccatataaaagtatggctttaaataatgacttttattatatacaggttatattcttgtattcctaacttttagaggttttattatgagatcttgaattttttaaatgttattttctatgtctggtgagaagttaactgatgcttttcctttattctcttaatttaccacatcagatttattgatttgaagatattgattcatcagcgcatctcaaaaataatttggagcttgtcatggtgtacaatccttttaaagtcttatagaacttagttgactatgaattgggagtagcttgtttatatatactaagaacatttgtcagaagctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttggcgcg

SEQ ID NO: 9 - DNA, 172895 bp, Artificial Sequence
  Description of Artificial Sequence: Synthetic polynucleotide
  BAC3
ggccgcctggccgtcgacatttaggtgacactatagaaggatccgcggaattctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttccctttctgtactgattgtcaggatcctgaggcctccccagccatgcttcctgtatagcctgaagaaccatgaaacaattaaaaatctttataaattacacagtctcaggtgtttctttatagtttgcgaatggactaatacagaatccaaataggaaaagaagaactcaatgtatctctccaaactgatgatataattctatacctagaaaattctaaagaccctgccaaaataattctagaatagataaacaattttggtaaagtgttgggatacaaaatcaatgtacaaaaatcactagcatttctataccccaactatgtccaagctgagactgaaatcaagaacacaatcctatcccacttacaatattcacacacacaaaatatgaaatgcctggaaatacaggtaacaaacaaggtgaaggatctctgcaaggagaactacaaaatacagcagaaataaataaataaatcgtacatgacacatgactcatctgacaaagggctaatatccagaatctacaatgaacttaaacaaatttacaagaaaaacaaacaaccccatcaaaaagcgggcaaaggatatgaatagacacttctcaaaagaagacatttatggagccaacagacacatgaaaaaatgctcatcatcactggccatcagaggaatgcaaatcaaaaccacaatgagataccatctcacaccagctagaatggcgatcattaaaaagtcagggaacaacaggcgctggaggggatgtggagaaataggaacacttttacactgctggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccagcccaaatgtccaccagtgatagactggattaagaaaatgtggcacatatacaccatggaatactatgcagccataaaaaaggatgagttcatgtcctttgtagggacatggatgaaaatggaaaccatcattctgtgcaaactatcacaaggacagaaaaccaaacactgcatgttctcattcataggtgggaactgaacagtgagaacatttggactcaaggtggggaacatcacacaccggggcccgtcatggggtcgtgggagtggggagggatagcattaggagatatacctaatgtaatgttaatgggtgcagcacaccaacatagcacatgtatacatatgtagcaaacctgcacattgtgcacatggaccctagaacttaaagtattatttaaaaagaaagaaaaaaactattaatttttctgaaccatgaacatggaatatttcagatatattttcaatttgtgtgtgttcactttattttttattatcaatcatttctggttttcttttagaaatctttcacttatttggtaatatgaaatataatttttagctattataaacaaaatgctttattgattttttgctgtttgcatttagcaatgccaccaatttttgtatgtaggtgttgtattctgcaaatttacagaattttttatcaattataacagtttttccagcaccatttattaaatagggaatcgtttccccatttcttgtttttgtcaggtttgtcaaagatcagatggtcgtagatatgcagcattatttctgagggctctgttctgttccattggtctatatctctgttttggtaccagtaccatgctgttttggttactgtagccttgtagcatagcttgaagtcaggtagcgtgatgcctccatctttgttgttttggcttaggattgagttggcaatgcaggctcttttttgttccatatgaactttaaagtagttttttccaattctgtgaagaaagtcattgatggggatggcatcgaatctataaattaccttgggcagtatggccattttcacgatattgattcttgctacccatgagcatggaatgttcttccatttctttgtgtcctcttttatttcattgagcagtggtttgtagttctccttgaagaggtccttcacatcccttgtaagttggattcctaggtgttttattctctttgaagcaattgtgaatgggagttcactcatgatttggctctctgtttgtctgttattggtgtataagaatgctagtgatttttgcacactgattttgtaccctgagacttcactgatgttgcctattagcttagggagatttggggctgagacaatggggttttctagatatacaatcatgtcatctgcaaacagggacaatttgacttcctcttttcctaatcgaataccctttatttccttctcctgcctgattgccctggccagaatatgtagaaagctgaaactggatcccttccttgcaccttatacaaaaattaattcaagatggattaaagacttaaatgttagatctaaaaccataaaaaccctagaagaaaacctaagcaataccattcaggacataggcatgggcaaggacttcatgtctaaaacagcaaaagcaatggcaacaaaagccaaaattgacaaatgggatctaattaagctaaagagcttctgcacagcaaaagaaactatcatcagagtgaacaggcaaccaacagaatgggagaaaacttttgcgatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttgggatggcgatcattaaaaagtcagggaacaacaggcgctggagaggatatggagaaataggaacacttttacactgttggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccaacccaaatgtccaccagtgatagactggattaagaaaatgtggcacatatacaccatggaatactatgcagccataaaaaaggatgagttcatgtcctttgtggggacatggatgaaaatggaaaccatcattctgtgcaaactatcacaaggacagaaaaccaaacactgcatgttctcattcataggtgggaactgaacaatgagaacatttggtctcaaggtggggaacatcacacaccggggcccgtcatggggtcgtgggagtggggagggatagcattaggagatatacctaatggtaaatgacaagttaataggtgcagcacaccaacgtggcacacgtatacatatgtaactaacctgcacattgtgcacatgtaccctaaaacttaaagtataataaaaaaaagaaaaaagagacccaattgttgacaaagttatgaaaaagatagtttttaaggagtctttaagtaatattgtattttctgcaaacagacaatttgatttcccctattccaaatttcaggacatttcttcttttttcttgtcaaattgttctggctagaattacagtaccatgtagaagtggtggaaaagagcatttttgtcttgttcaacatcttagagaaaaggctttcagtttttccagccttggtataatgcaagctgtgggtttcacatatctggactttattattttgagatatgtttcttgtataccaagtttgttgagaatttctataaggaatggaggttgaatttttttctatgactttcttaaagcaattaatcataaaataataataagcaggtcaatacaagatccataaattagtggaagctagttatttgcactgctgccatagagtaggatcactacacaactcatggtgttgatgggaaactataattctgcaataattaaagactagtgatttacactgggctctattgagagatttggttgtcaactacagaaatcgagatgaaggggcactgagaaacatttcgcttcatatcatctcaacttctaatatcaatttttagtactaatacagtcctattttctcagtatactgtctcacaggttatagtatatgtcttagaaaattaagggttgtttcattctaataattaactcagaaaaattcatttcctattatggatgacaagtgtaaattcatatcttaataattacccacactccaaaacactactacaggcaaaggcaagagaaaggcaggtatagatgagattctctgaggtcagttatgtaaatacccaaggactattgtctatgaccttgaatgtcactttcttcccttccatgagctacatccaggatattctgtgaatctgagagcgttgagcatgtttaattattttatctcactgccccttagtcttgctttctccagttgacaaccaaatctctcaacaataggcccagcgtaaatcaccagacttcaattattgtagaactatggtttcccaacaacattatgagttacaaaatgatactactttatggcagcagtgaaaatgatgaacttccactaacttatgaatctctgaatggctagcatggaggtgtgtatgtatcagcgcactgttctagaaatgttccgtttctgtccattattttatgtagtaatgaggacaacgtgaactaaagggagtatccatggccttataagcacagagaccacatccagtgcaggtgcagagcaaggctgcaacagtcagcaagttgctctctgaagagtcttccaattcccttgcccaaagcatctgctcattcatgggctgagaaaagggaagtcatgcatgcagtctactctctctacagagctgacaggggacacggacaacatcgattattcatggaattttcccataggaatgcagctgtgtgcacacacacataatacatttttaaatgttttttttatttatcctctccaattttaaaaaagtcatcaccttttctcctaatcaaagaggattttgaccagaatgcttggtgggagccccctgctctcccagatgcccacccttatttctcttgaagtgaagaacggcagctctcttgatttctactctcatcctctaggactaaaaccagaaggttccacgccccctgggtgaacatccaagaagaccctgtctgtagcagcaggagcctcaagccttgactgagagctatggtcctgaaatgagacagtgtcccccatggagagcacacgtggacgcccacaactgagggctcactgctcttcaccacagatgcgctcccttactgagtcctgagacctgagtgcaccccatagggtagggctcagaagaggggatgcaaatctccaccagctccacccttctctgtgttgaaaagccgagcatggggacctagttcagtgactcctgtgccccaccacatggagctttactccacgcttctcctgctgactgtcccttcctgtgagttcagtggtcagggaatccttcaggggtgaaacacctgttcttttctttgtgggcttcatcttcttatgctttctccacaggggtcttatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaaggagaccacagagacagagcccagggtgcctcttgtacaagaacccaggctgcttctcagtggcgctccctccccacctctgcagaacaggaaagtgtggctgagatgccatttcctgtcagggtctgggtgtcttatcctatctgactcagagccttgtcttcctccctcttctttagtaataaatggcatgacccctgttagtggttcatgcaagcagaggctgtatcctgtttgacaaagattcagcatgaaaggttcctgttacttgagccagatgcatcactgatatgtggccaccagtttcttagactcataccactttaagggaccaaatacaaatgtccatagcatatgccattcttaaactgcagaaatgatgtcaaagaagaatgtggagataagagagcaggaggaattatgaaaatctggatagcatcttctcttctagggtggaaggtatgctagtaaagtaatttaatgaaacaatcagacagatgcaatatgtcctcatcatggagtgtctcacatgggcagtgcacaaataaatttctaaaaattccataaggtagatgtgatggatgaggcttatttccacacagggagcccacaaatatccagagaagtaaaaaatctgacacttggaaagaaaattgcctcatcttgacatcagaaacccatttcaacatgtccgaggggcaatgtggaaaagaaatggaaacttcaaaaacacatttcttatgaaatgtctagctcatgtttgaacataaaaacagaattgtccatgattttagaaaaaccaacccatgacagcgagtcactacactcagaaacaccactgagtcaacagacttcagtctgtgagcaggtcagtactgaggccccaggtgaatcaaggctctcacgtacattgtacagaacccagaattgagccacacaatctataaccaagtcttctttgacaaactttacaaaaattaacaaaaaaatacaccagagaaattcaatatatgaaattcaatatacccattcaatatatggtgctggggaaattggttagccacgtgcagaagaacaaaactagacccccaccctcaacacatatatactcaacacaaaatgaattaaagacttacatataagacctcaaactataaatctactcaaacaaaacaccaggacaactcttctgggctttggcctaggtaaagaatttatgactaagaccccaaaagcaaatccaagaaaaaaatagacaaatgggacttaattaacctaaagcatttttcacagcaccggagtgaacagacaagttgcagagcgaaagaaaatttttccacaccacacctgtgacagggaactaatatgaagaatttgcaaggaactcaaactactctacaacaacaacagcaacaagaaccaaataactccgttaaaattagcagaggacatgagtagacattttcaaaagaacacataaaaatggataataaatatataaactacgctcaacatcactcatcatcagggaaatgcaaattaaaaccacaataagatatcatcttccaccagtcacaatgactattactaaaaactcaaaaatatcagatgttggtgaagatggaaaggaaagggaactcttagacactgttgatgaggatgtggatgaggacaacttctatggaaaatggtatggagatttcccaaaaaactagaaatagaactcccctttgatccagcaatcccactactgggtttactacccaaaggaaaataattttttatttccaaaagatatccacacttctatgtttatcacaaaactattatcaacagcacatatgtcaacctgagtgtccaccaacagatgattttataaaagaatatagcatatatgcacaattcaatactagtcagccacaataaggaatgaaactgtcttttgcagcaatatgcatagaactggaagacaacataattagtgacctaactcacaaacagagagtcacatgtcacatgttattatttataagtggaaggtaacaacgtgtccacaaggatatggagagagaaatgatggacaccagagacttagaaggatgggaggtggaaggtgggagcatgaggagacattacctagtgggtacaatgtacattatttgggtgatagtacactaaaagccaagaccactatggaatatagccatgtccaaaagtggcattcgtagtccttaagtttatacaagtaaatgtacacacaaataaaattaaaaatataaaataattaacagttgaccaatgatcttaaaagttgatttaaaatataatcaataaatgaaatgaatatcagttgaacctcattaaatttgaaaacgttttatactcaaatgactataagaaaatgaatgtcaagtttcagatgagaaactgtttgcaaatcattagccaccaacataagtataataagaaccctcagaactcaactgtgaaaaaaagaaacaacccatggatagaataggcaaaggtttgtgcagacatttcatcaaataagatgtacagatgacacataggcatataaatgggctcgcaacaggattttccattcgaaaaattcaaatcaagccgacagtgagacactactatacaatttttagaaattaagaagaaatacagataataccaatgctggtgagcatatcagggtccaagactctaaaacgttgcaaacaggaatgcaaaatgaaactgctactcaggaaaataatttatagttttttctaaaatcaaacattttcttaatatatgacctaaatatcccactcctgaatatttgtgtcagagaaatacaatcttagattcacaacaaacttccatttaaatgttcaatatattgtgctcacgtgtgtgtgtgcacgatagaaacaaaaagtaacatgaatgtctcaaaatttgaataggtaaaaagtaggaagtgtctattaattgaataccatcagcaataaaaaataacaaaatgactgatacacaaaccattacaggtgaactccagacatgatgctaagtgagagaagccagtctcaatgatcaaagggacacatctgtaagcaccacggtcatcctcaggtgtcagtggtttgggctgggctctctgtctctttcctgaccagacccagatgttgagctccgccacttgcagatggaaaattctactattttcaacaatgcactgaggtttgaactgcttcacagactgaacgaaacaaacacgggctcctttgaacagtgtgcagcatttgttccaaccacaagagaatgtctcccagctctgccccttctcagttttccctgcaagccagcagccctgcagtttagcctgcatctcccatgcatgcacccatctccttccaagggccttactccacaacctccacttattttgagtgcactgactggctttgaacttttccacattctgttgttattgaagttaggatgtttagagccatattaaggatcatattttatgactgaattccagtgccccctctctcctgggacagagcacgtaaccaacattctgcatgtggagacaaagatgagcttttttcttcctcagcctaggagatgagcgctcagtggagggttggatagaagcttcccaccttctcagcactccagttctggtggggagaacctctgccataggagcagagctagaaaccagggaccgaatgttcccagtgacactggacccagggtagagcctccatccacgagtggggctccatggaagaagcgagtctctggctctcagtagcttttgtccagaactgagccttaggatcgtgtactgtgggcagagtcagagggccaatgtcctggctcctggggaacagtttcctctgaagggagctgggtagaaggtgtcctgtcttcttggctacatctgtttgcagtggagtttacatcatgctgagttgggatgtggaaggaaggaggagcatcttagatcaattatgatggctagacttactgaattttgtagattttcttgaataaatgtttcttcacttgctgtatgctgtgagagcctttccaaaccctgtattttttcaaaataattttcactggtctcatgagggcatggattcattgagcccctcatgctatcaaagagaaatagaactttttttgttcactttttagagaacatccatgggttataaaacaatgggttgacttctcttccaaaactttacagataccgtcaattttcctcttgcttgtaaggttttatccagaagaatgctgtcatcattttttctgcttttttggaaggaatgccccttctactcacctcaaattgcctgcatgtatttctatttttctttggttttcagcagttttaataagatttagctaaatgtgtgtggggggagcagggagtgtcattctgctgttctgtgttctctgagatgcatggattcacggtttactctgtctccattttggggaacacaattagaaaaaatgtcagtgtgagcccagaaacaagcctccctgaagtgggcagaggaccacctgggggcgctcaggacccactgagcacaagagccagccccagggcaggtgcagacgggggttaagatctggtttcccgtcagccctgtggcttcctctccataaaacagttccctcgggggcacgtctctggattccttatcttgttcttactgtgaagtctctgaagaataaacatttgttgtaacaagagaaaaattttctcccatgcaccaaaggcagagtcacctacagtcaattagtcctgtttctcaatgttaataaactatcaatgtttctgaaggtacattgtacagaacccagaattcagccacacaatgtatagccaagtgatattgacaaacttaacaaaatatacaccagggaaaggacgtcccattcaataaatggtacttgggaaaatggatagaaacatgcagaagaacaaaactagatccccaccctcaacacattagtcaggtctctaaaatgcaggagtacatatctaaaatttattattttattgtgcatttttacgtgttccagaaggtgggagaaatttctttctgtgaagagcatcccaaagtcaggcactcctctagaacacgtgtttaatccttgtctttggcttattgatgagctctgttggctgcaataacttctgccatccgggctgactttgcatcatgtagaggagcaaattctgaatgaaagtttgcactactcaattgagtgcataacctacagttttgttactgatgtatgattcatcagagatgatatcagatcaaggatttcaatgagaatctaatctaaaagatgtaaacaaattttcctaatttagataaaattactgtgagcacactgctagtattcagccatgtctcctatcacattgaatctacactaagtttgacctaaaagctagcacttgttctcatgttccaatatgttatttttattttaatgtattcagattactatgtgttgctattttacccaaagtgaaggaaagcaattttaactgactgaaaatgagaaaaagcacaacctaatgaaatggaagtcaggacatgagtgtctccagccttgtctatttcaaaaattcacgtacgcagggggatttctttcctcaattttacacagagaaacttccaaaatgtttgtttcctctcccatggactctatcatcagtttctatgtcagtttgcttagaattttggcctccagctccaaccaatttggtgcaaaaacatgatttcattcttttttatagctgcagagtattgcactgtgtataagtaccatgttttctttatgcagtctataactgatgggcgtctaggttgattccctgtattaggtaatgtgaattgcacagagataaacacatgagtggatgtgtctttgtgttacaatgattggttttctcttgggcatatacccagtaatgagattgctgaggggaatagtagctctgttttaagttctttgagaaatctctagactgactgaattgttttctctgtgaatggtgataattatgtcaatatttgtcaaattttgaatgtattgtttgaagattgttatttgtcaatattacctcattaaaactattaaaaatggaagtgtataatttggtagaaaaggattaaaagaaagataaaaataatacaagaaaagtcacagactcctgaatccacatgtgaattagcactcagtttttctatattatttataaaaacactaagatacagccaaataatatcatgatatccttataagaagagtgtttcgtaaacctcactgggaatttctagctctgtcctagagttaatttagggagcagtcggatccagtcctgagcaacacaggccagacactgagacttaccacatcttaccagatgtgagctcttagacacgtcacatggcctctccatgcttgggggtttaccttcacatctgtaaatgaaggaaacattgactgccacagaacatacttcatgtgcatctatacagtagaaatgctaataagaattaattgtttatgaagtgtaatcactctgggacacagcccactcagaggcatcccttccagaacccgctatatagtaggagacatgcaaatagggccctccctctgctgatgaaaaccagcccagccctgaccctgcagctctgggagaggagccccagccctgagattcccaggtgtttccattcagtgatcagcactgaacacagaggactcaccatggagttgggactgagctggattttccttttggctattttaaaaggtgattcatggagaaatagagagattgagtgtgagtggacatgagtggatttgtgtggcagtttctgaccttggtgtctctgtgtttgcaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacacagtgaggggaagtcagcgagagcccagacaaaaacctcctgcaggaagacaggaggggcctgggctgcagagggcactcaagacacactgaaaacacggttaacactgggacaagttgctcaggaaggttaagggctggtttcctttcagagtctttgctgtttctgtatctaacagtttccccaggaaccctgtctagatttgcgatcttgatctgcttaaactgtctctgtgtcatttttcttacctgtgactttaggggagctgatcgtggacactccagtgtgtggagatttcctggtgacagcaattgtgtgttctgtctaagcatgtctagggccggtcatcaggaaggacaggaaggacaggctggaattcttggaaacagctgcacctgccatccaccagggaactttattgtcttctgttctgctaaaattaaatcaggcacaccaagtttaactagcactatcttcctagcttaagaaaattgatggcaggtttcaataacacctatattaaaccttcagagcaacacctacattagtgtctgatttgataattgagactatgttctagccaagcagacacataaaactggtgattgccatgcttagttcatatttcatatttatcaatagaatctggctggtgttataaacagatttgccaacacatgtgtgttagtgtttgtcttcggagaggcacattctatgactggattaagtttgtgtacaggttcctaaggaacctgttcatgcttttgagaggaaatgcagagggggtggaaggcggctggggaagctgaaggtatacgagggaagtcagtccctgagtgaaggagagagggaggagaactgggtagaactttcctaaacttctgtgctggtctaggaaggtccagcaagatcactgagtcagattcgtgtcaaagtttcccatcggggacccccgtgactcccagcagtggctctgctcagatcagcacagagctcgttcttctcctgagagtggagcagaggatgtggctccagcaccagccatggcatggacgtcagagagcagccccaggcacctgagtcgggtgcattgtgccccctgcaggtggacggagggaggtgctgactcagggcccacacgctgtgggttctatacagaacacacacttttacttcatttctgtggatgacatagaaacaaacatgcagtctattaacagcggtgattcctacatttgccccaattgctttattccttgattccgcagaatatcctgacgcagaattgtctttctctcgtggaattgcgacgtgtttaggacgtgtgttccccactttcagtgttctgctccatgaacagagatcctgagtagagtacagctgaccctccttccacactgttcctctcctccccacaggaagagcagataattacctgaggctgaatctgaggtgggatctgtcctctgaacctcagagcctgcagagacccccggctgcagattcatggagtcaggtgtttgtacatgtgggaaacttgagctgttcttttgtcagtgaacactccttagaactaattgtgggttcagaattaggacacccattgatctatcacacctcagctcattctgccactcagaatctccagaaattcaggaaatggttcaatttacatgtttgtgacacattgttctcatttcatttagttgtgagtttggtcagcaaaagtgctaccatttatgtgtcccaacctgatgaagctaacttgcttcaccagatgttgggagctcctgaattttatcctaagcccctctctctccacttcatgtgaaattcggtttgacctggaattctggtgtgttgatttagccagatttccccatactgagtgtctgattttcctggatatctgatcagtttccttgtccttcaccataacttgggtgacatctgatcaccctgggctaacttcaacaaaaatcctggcaggttgccttaagcaggatttacctcactcctgatgtttcttcttgattttccatcctttgccccaaccctgctgcatgcctataaatccccacgttctcactctgtatttggagttctgctgaatctctccctcattgcaaaatcccactgccctggtccctacacctatcatgagggccctggataaagtcttccttactgtgctgtagaaagtgtctttgtatatacattttttctttaacaaatctgcctttagtatttcctaattgatcaaggaacctcaaacattgaatgaaagtgaggttttccattttactaacatatgtgtatctgtgaatttcaatttcaatgtgtggtgtccagaagtcctgagcaccaacagttgtgcttctctgtccaattatttgattctgaaacctgggagtcatcccaacacaggtaaatatgtgattttttttttttttttggtttttactgtttagtgactgacttatttcacttacactgaagcttcatgaacacaatgatgaaaagtagagagaggacttgtttgaaaatgccagatttatggtagactttaccacccacgtgtgtctggaggtcttcttaaggttccaagaacaggacatttttcccacaacaagacaaggatgagaacctctgagctgtgaggatggaggacaggcagggccatgtgtggacaaggacgggctgctgctatgtccagggtgttctctactagcaaccactccatctccttcctcactctgtggtatttgtcagatgggaaacatgcctagaatttatctttgacatctggatggaagcccaggcaagaggcatttgacagcttattcgtgagcctacttctttaaggaatgccagatcccttgctctccttcctagttcttaacccctttaactcccttcccctcctgcacccatccactgcctatttacagccacgtccccacacccttcactgtagcaccattttcttgggctcctgggaaacacaacagctttggtttaactcacagctcaggcacactcacgggtcctttcagaggctctcaacttccctcctacagtccctcagctcctcctggggtcctaacttggccatctctatcctctctgctgagcctggccatacacaatccatcccatctggatatgtgtatagcagtgggttaactcagcaggcatgaatagttcaaaccctccacgttcctaaaaaggtaaataactaaaaaataaaaacaaaagtaaacctttgttcatttatggctgtctgttacctcctgggatgagatctccgagtccatgaaatcttacacctgataaaagtgtctgcagatgtctgcagccttgggacatgctgtacgagtttaatcacagtgatttatagtgaacgcctgcttttgttttgctggggagggctgtggtctgagtattgtggtcagttacccaggtgttccatagtctatgattcattccccaaacacagccctggacaagaaaactcaggggcactcccctgggtgttgacacttcacacatgtcatcttacctcatagctggagcattacacatgtgcagaaggctccacagtgggaggacccctgagagcttgtgcctggattctcctgagcttcactctttgtgccttttttttccatgtattttcaattgtatcattttgctgtaataaactgttcctgtgaatacgagttttcatgagtcctgtgtttttactgagttttgagcctgagggtggcagatgcaacttctcaatgcagttgtatcagaagaaggatttcctagagagatcctaagtgacacatggctgaagtattgttcagaaaacataagtattcaggtgtggaatggcaaaatctgatacttgggtggcaacagaattacccggtctgagacagcagctgaactgaagtagatgtctggagataaatgcaatttagaaacgataactcatactcccaaagagctggctcaatcgatacataaggaaaaataaaatgataaaaaataacctaaatatgcaattactatttgtgagaacatccgggagagtgattgcagggaaagtggcctgcgccgacctcagattttggccaatgtcatttctggctgatgggctccagggcactacctaagggagcaattatgctgcaatgacagacagaagcttcgcaagctctctccacccagaaggtggttcaggtggtgaagtgcggggactggtgagccacaaaacactgaaatgagggaggaaagtgagaaagtgaaaggcttttgagctttttctttagcttaataatttttgttaattattaacaaaataattggacaatgactaatgtaaaagtggaccgtgttttgagtcccttagaacggaggagaatgcagcggtcaatgttgtgcccagagattactatagaacaatagtaggtggttgaacatgctccaaacacaaagcctcttgttgctgatgggacagctgccctcgtctactgcacaacagcttctccaaagtgtgtttaccctgagcattgagattgcctttctcttgtaagtgaaaaaatcggaaaactccaaataaaggaggagttgtaacgctctatgtgtaagaaattctaatgtggatttatgataactgggatatgcatccacttatctttttatctgtaaaaattcatgggtgaaagtgcaattttgttacatggatatattgttcagtgatgaagtctgggctttgaggagagtcatcatctggatggtgtatattgtacccagcaagtaatttctcatcccacacaccactcccaccatccaaaccttccaagtttccaatatttattatgccacactctatattcatgtgtgcacattatttagttcttacttatatatgacatgtggtattcaactttattcttctgagttatttaacttaagatagcagcctacagtttcatccatgatactgtaaaatacataatttcattttttattattgagtagtaattaaatgtgtgtatatatattcacaaatatatataatgtatttgtgagggtgtgtatgtgtgtatatatgtgcatatatacatatacaacatgttttctttatccaatcattcattaaaaacacttagtttggtaccgcatatgtgctattgtgaataaggcaacagcaaacataaatgcagcatctatcgaatataaaattcatttttctttgagtcgataccaagtagtggatttgccgaattaaatattagttccatttaataagagaacttaccaacatctgtttcttgtttagtttagtttttatttttgactttttaataatagttattctgactggtttaatatggcttctcgttttgacttcaaattgcatttctgtgatgattaatgacattgattgttttttcatatcctggttgatgatttttatggcctcttttgaaaaataaatgtctgatatttgctcactttttaatgtggctatttgtgctttttgtgttgctttagtttcttgtagattccaaatattagctctttgtcagatgtagtgtttaaaaatatttttcgtcattctgtaggttttctgttaactttgttgattatttattttgctgatcagatgttttgcttcttatttgtattaagtccaaataacctattttggtttagttgtgtttacttttaaggtcatagtcatgaattctttgcctagcacaatgttcagaaaaacacttcctaggatttcatttatgactttcagactctcaggcctcccagtcaagtcttttatccatattggtgtaatgtttgtatgtagtgagacatatgggtccagttttattcttctgcaaatagctgttcagtttttcctgcacaatttattgaacaaggtgacattttcccagggtatgctttttgtctggttggtcacagtcagttggctgcaggcacatgactgtatttctggaatgtctattctgttccaagtatctatggttctctggttgattgttacttgtgtataaaaatcctactggcttttgtatgcttttttatcctttattctaaaacttcactgaattaattcatcaattctaggagtacttctaaagaatattagtttttaagtacaaaatcatattgtcagcaaacacacacaaaaaactgacttcttcttttccaatttgggtgcctttatttctttctggtgtcttatttctctggctaggatttcaagttctatattgattaagagtggtgaaagtgggcatccttgacgtgttctgagtcttaggaggaatactttcaacatattgctactcagtataatgttgtatgtgagtttgtcatatatgatttttattaatttgaggtatgttttccttctattctaattttgttgagggttttttatcataaagaaatcctaaatgttatcaaatttttttttctggacctattgacatgattatatgttttttgtttatgtggtggatcacagttattgagacatgaacgttgaactatccttgcatccctgaaatgaaacttagcagattgtagcatattatctttttgatatgtagttggacttgattttcttgtgtcttgttgaggatttttccatctatagtcatcagtgatattgatctgtagtattcatttttgggtccttgcatggatgtggtatcaggctattagtggctttgtagaatgagttagggagaaaaaccctctcctcgtttttttggaaaaagtttcagtagaattactagcagatctttttgtatattggacagaattcaccttttaaaataatatgctttacggctttgatgttgagatttttttaaattactgcttcgatgtcactaatttttgttggtcctttcaggatttttatttcttcctatttcaatcttgggagattatatatttccagacatttatctattcaccctaaattttctagtttatgagcctggagatgttcatagtagactatgttgatcattatatttctatggcatcagttgtaatcttttcttttttgtttctcattctgcttatttaaattgtctgtctactttacttgcctaatctagctagtggtctgtaagttttgtttatcatctcaaaaacccaatgttttattgtattggttctttgtatttcttggttcttaactttatctagttctgctctggtctttgttatttgttttcttctgctgtgtgtttggtttgatgttgtttttctagttatttgatacgtaatgttaggttgttaatttgtgatctttctttttgatgtggtcatttaacattataatcttatcccttagcacagcttttgctgtaaaccagaggttttggtatgctgtttctctatttttattcatttcacaacatgttacaatctttttaaattttatcattgacccaaagttcattcagttgcaggttgttaaattttcattgtgtgtgtagtcttgaatattcttctagggtttgatttctggctttatattactgtggtctgagaagatatttcatttttaaaaagttattgagtcttttatttctggcatagtatataatccatgtttgaaaatattccttgctaatgggaataatgtatattctgcagtcattaggttaaatgttctgttaatgtctgttaggttcatttggtctagagtccaatttaagtctagtgtttctttgttgattttctgtcttaatgttttgcctagtattatcatttgggcattgaaatccatcacaattgtattgttacctgtgttcttccttaggtctaatagtatttgttttatgaacatgggttttctggtgcagagtgcatatatatttagaattgtcatttttaatcaatcattttatcattatataatgactttctttgtctttacttactggtgtttatttaaagtttttttatatgatatagatagtcttgcttgcttttggtttccaattgcatgaaatatattttttcaccctcttgatcttgaatctacgtatttttaccaattaagtgagtttcctgtcagcagcataaatttcaaaactcttttttattctttccactaatctatatattttaggtgaagaatttaactcatttatattcaaacttaatacagatatgtgaggtctggcttctgttgtcatgttaattattaactagtggctttgtagtcttaattgtgtaatagttttatgagtgaattttataattttgtgttgtttatgatggtgagtactgacctattgcttccatgtctaggtctcccttgagcatttcttgtaggtgcggtctggtgtaaataaatgtccttggcattttcttaccttagaaatactttatttctccttcatttatgaagcttagtttagaaggatacaaaattaatttctgacatagaattttttctttttttttctttaagtagtctgaaattgggagtccaatctcttctatcttataactttatgctgagaagtacactgtcagcatgatagaatttcagataaattattagacacttttctattgtgaattttaggatttttttcttcctatttactttagatagtctgaggactatagatcttggtaatgtctgtcttccagtgtcttctcatgtagttttctgaaccacttttatctgcatatgcaaatatctagcaagactagtgatgttttcctcaattacttcatcaaattggtcctctaaaactttttactaattttctccctcaggaatatccatgattattggctaagttgttttacataatcctatacttcccaatgattttgttcatttttttgttattttcatctgactgggttaatgcgaaatatctgtctcttaggtttgatgttctttcttctttttagtgtagcccattgtgaaagttttaaactattttttgtaattaaaattcaatgaagtctttactccctgaagctttatttttaaaatattaaagtcttaagtaaatcttgaattgttctgatttttttttttttttttttgacacggagtctcatactgtcacccaggctggagtgcagtggcgcgatcttggctcactgcaacctctgcctcccgggttcatgcaattctccttccttagcgtcccgagtagctgggactacaggcacacaccatcacacccagctaattttttgtatattgagtagagacagggtttcactatgttggccagactggtctccaactcctgacctcgtgatctccgctccttggcctcccgaagtgctgggattacaggcataagccaccacgcccggcctgagttattctgatttatttgtgttggttctcaaatttcttttggatttaattgagattccttgaggtcaacattttgaattatttatctgacatttcaaatatatcatgttgtgtaaattctatttctggagagttaaggtgatatccggcgtcttgtaattgtgttttttcatacttccacaattgcttacctgcttgcttttcattggctaaactatctcttactgtttttgaattcattttgattttcatgaaaatttcattccctttagaatgtgaatataacgtatattatgtgggtcttttgatttggttcttggtttactcattggcaaaggctctgtaagagtttcttgtatatagatagtcattatttagtggctttctgaaactatggttgtagtaataatctactgggcctgtgagcaggctcactgcctcctgcaggccctaaatagtggaggcctcagaaaccatttcttatttgcaatgcacttgtttcagcacattttatattgggatgttaagttcacctacacattagtatgtgtccttacagatttgagctgactgtggtagaagcagatgagtacatgcttgatatctgtacacagggagaagctctctgttgcctcaggcgatggactggtctatgaagtgcacagtgacttgagttctctgatcagcccctgagtgggggatgaagctggacagagatgagccaccgagcctggcaagcaaaagcgccagccttgatggaaatggcgagctgaggggcatctactcagtgtggtttcttttgttattaagagctttagtgtggtggctttttcaaattcccgttgtagtagtaacatactgagcatgtgagcaggcccgcggtcttttgcggggttggaatcacagaagtattgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttaccggtggttaaagtgggaaatttgtcatgttccagatcttagagaaaagacttttagctatttctcattcattataatgctgcctgaaagtctctcgaacataactttttattatgtcgagatgtgttctttctatacccattttttacattttttttcctgaaaggatgttgagtttcatcaaatgatttttcagcatcaattgaaaaaaactatatgtcgattaaagatctaaatgtaaaatctaaaactataaaaactctggataataacctaggaaatacaatttaggacattagaactggcaaagacattatgaagaaaatgcaattttaacaaaatcaaaaaatggcaaatgagccctaagtaaactaaagagcttctgcatagcaaaagatactatcaacagagcaaacaggcaacctaaagaatggaaaataaaatatttgcaatctatacatctgacagggtctaatatttatagcatacatgcaattaaacaaacatacaagaaaaaaagtgcccaaaggacatgaaaagacacttataaaaagacctacatgtggccaacaagcataggaaaaaatgctgactatcactatcattagagaaatacatattaaaaccacaatgaggtaccatctcacatcagtcagaatggctaatcttaaaaaaataataacagatgctgctaaggttgcaggaaaaagggaacatttatacacttctagtgcaagtataaattagttcaaccattgtggaaagcagtgccatgatccctccaataacctaaaacagaagtttcatttgacccaacaatcctacaactggacatatacctaaaggagtataaacgtataggttcattccagcactattcacaatagcatagacatggaatttacctaaatgcctgtcactggcataatggatagagaaaaatgtgatacatataaccatggaatactatgcagctaagaaaagaatgaaatcatgttctttgtaggaatatgatggaactggtagtcattactcttagaaaactaattcaggaacagaaaaccagatactatatgttctcacttattttttggagataaataatgagaaatattctctcagggcctgagtcttccatattcaaaaaaaaattctaaaataagtgttcaacaagttgccgacatgcctttaaatatcctgtttcatctggaccccttatatcactcaataaagccatgagaactatatttaaaagtgggattctatgataataaataacttaacagtaagaataggaaggatatggatggttttactaatttaatgggtacataactgtggtatacactatattcctatgaataagatattctgatttcagagctaagtattgtttcctacgttgtgtgtgtgacttggttgtgttggatttgagagtgtagcacgtgcacagaccatgtggatcagaaatccacatgtaaagatgacaatctatggatgtgaactacaagtatgtaagtacttcaagtaattctatttaatggagtttgaaataaaactcaaacttattcaaaacactaattacttggtatttattttgagatctatgagtttatcaagaaattcaaattcctatttctatttaaactcccgattcctactctcagtgggagggaaaactcacagccaatcacacatcacaggacaaatctgtaaacgaagagtcattcctctgaaggtcctgggtgttcaggactctcaggcaggtgctgaggaccctgtcttgggagtgcccagcagatctcagaaccctacatggggcctgctggacactcatgtgggataactagtcgccacttattcagagttaccagtgagctttgactgttccgaatgggaccagcatggagtcaaggtgcctgctcaatgtcagagacagcgatggtctcagaaacaatccaggtaatctctaggccaataaaatgtggattcacagtgagaagtacatcctggaggtggagcttgttcttcagtgggaagagtgctgtgcacagaaagcttagaaatggggaagggggtgcgtttcctcaggcaggattagggcttcgtccctcagcgtcccactcttgtatggctgatgtggcatctgtgttttctttctcatactagataaggctttgagctgtgaaataccctgcctcatgaatatgcaaataacctgagctcttctgaggtaaatataggtatattggtgccctgagagcatcactcaacaaccacatctgtcctctagagaaaaccctgtgagcacagctcctcaccatggactggacctggaggatcctcttcttggtggcagcagctacaagtaaggggcttcctagtctcaaagctgaggaacggatcctggttcagtcaaagaggattttattctctcctgtgttctctccacaggtgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggcacagtgtgaaaaaccacatcctcagagagtcagaaaccctaggggagaaggcagctgtgctgggctgaggagatgacaggggttatcaggtttaaggcttttttgaaaatgggttatatatttgagaaaaaaataacaatagaaacaagtacacactctaattttaagagatatattcaattcaagaattgtagaagccgaattcacagtgggaaaggccacactcaataaagttgataaaaacattccaggaaggtgctactgtgaacaagttttcaaattagatgaataaataatttggagcaatgttatttgatcatgaggtgagacagtatgattcttaaaaagtggaaaaaattctttcaaatgtttctgccactctttatcataaaattaattttagagcagttttaggattacaatgaaattgcacagaaggcatgagaattcccatgactccctgccctacacaggcagagcctcctccactatgaccatccagcaccacagtcacaaatcagttacaatggaggaatctccaaggacatttgattctttcttttttggtgatgccctaatataacaagcctaatttatctcggaataccacaagttttgttcagtggatttctaggaatcatattagttagagggaaagttggtgaggctcttactatttgaactcattcttccaaaatccacaaaacatatattaatttaaagcttatcttacttctggtttacaggatccttcccagagagtaagatttttaagattttagaggcaggttcatgtctctaaaaggccagcaagttctggggaatcccataatgaacatcctttcatgggaattggagaccctggcaatgagagactccatgtataatgccctagagttggattagatgcactgtgagctcttgggtggtggttctgaaaaaggtggtctgtgcagtaaatgcaaacacatgcacgggacacaggaaggagcaaaagcttccctttacaaagtgtgtgggcacctggaagaaaccctcacaagggcacgtctcacccttaatgactgcacattagccaggggcatgatcatgattggtcttacaaggaaagagcaccactgaggtcataggttatgaaaatgtcatcctccagctgagaaattccatctgctggcatgtgcgtgtcaaccccgtggagggtgcactctgggagttgacgagatgcatagaaacctcctgtcatgaattatcgtctaccacacagtcagaatcaacctgtgctccagaaagagatacatgcctgtagaaataaacagagcttaaggattttcttacctgctgaatatagtgcccaaaaccacactttcaggaagattagctcagaaatgtttacaaagtgactgaagggcagtggcgggtgaggtgatgggacagcctcagggctgcacttgaggagggctccctctcccatgcaggcttttcctccaggagctgcatcaggaactcacagaggataagggagaattctgagaacatgctactgtggtactgcctagagaggaaggataaatgatgacaaatacatctctgagtaacatatgggcatttgttcatgaaaactgttttttctgaaagcttatgaaggtcttgaaatgcccctgattagctgaggacaaacatttaaaccctccttccacagggagttcaagcaggctggatgtgtcctgctatggatgatcttccccagccccttcctcttcccagctcatccctggctctctgtgtaaaaagttttcatcagtggaaggtggttgatgaagtgaggtcttcaatttcctcatcttctctgtggtcatgttattttcctcatctgaggtttaaaaactcacctgcatgcagcacatgacaggctaaaatctcttgtggacaaaacagtaacaaaggcacccaccatggttgagcacccgtgttgctgacagtgaccaccaagggtcaacgtcctcttcacaatcctgtgtcagagcagcacttgagtgatttcactagcaacttcccaggagaatcggcttaaaactacttgtcgcattttccatacagatataacacatctattttcctgaagaaatagaaagagctgaatgctgaatacactgtatgtctgctggttctgcaagtttgtgactatcactttctaatttctgatctgtgtggaccaccctccagatttttctcactggtgtgaccagccttctggatgtcaaatataattaactttttttcatataaaagtcaacacaagctcctcatggtttcggtgctcactgactactttaaacttacacaatatgtttctttattagttttgttttctggtatctctactcagcatcttcaacacacccatgttaagatgcttgtacaggtaattgttaattttaaatttactggtgtttagtttaattaaataggcaggcaatagcttagaatttagaaacaacaatgtaaaggaaaagtaaatgcaataaaatttaacataagaaaaccagcagctgaaaggaagggaaatctattctgccacctaagagggtatggtgacctcatagtacaacgaacttctgcagtttaatcgatactgctcacaagtgatagcattctctctctttatatcagagcattccctaacatgtacaataaagagtgagcagatacctccaaccagactgaccagtacctctccctgagtgcctcagctgatagagatagacatcacatttgtctaacaaaataattacaggctgtaaggatacccaccagtcatatggagataatttgaaaaacttagtcaaagcccaaaccttataggtagtcatttatacttagaagaattaactcttatcttcacatgtatttttcttaatcatagagaagctactagagtcactgtccaagttactgaatatcttattcctagaatgagacattgcacaatgtgttctgacatgagggaatgtagctatagttaaaggataggagatgtgatcacggaaacacgagtctgcgatccagcagttctttctccctcacatttgcccagaaacaaagaccccagcagaaaaatggaagggttgacttcagtctccaaagtatgatgtgagatatacgtcaggtatttcatgccattgttttatagtaggaaatttaatctctaaagaaggtcattttcaggataatactattctccaggatacttaaatgcccgaaaacagagagcgctacagtgcccagtgtccaggagctacctggcacgggtctggaaaccagtggacagaaatatcagtttctcttaccacatgtatgttggaaatttgaagaatgtttctttccttcttcgtaatcataggctgcaatggactggaggtcccagtacataagaggaaatgtgtctccagtaggaacacaattagtcccataaaataattgtgctcacactgtggtgcccacactgttggaccagctgactgagaaagtgttgtaagagctgcagtgtctactgattcctatcatatttggggctacattcgcagctaccaacggaaagagagagaagtaaaactggcttaggtagagtctatggatttgctttctttccttcaaactgaagtaaaaaaaaaaatcacatcaactaaaatggggacgatgatgaagtgatcaaggacaagagccactcagtgttttaggtgggttttaacctaaagtcccacaacatgtgagaacctgaactctggagtccggggcatctctggggagaatgtggaaggtgggcgggaggaaacagtgattcatgtctagggaaatttcagggctacctgctctgggggaaaggaaagcctgagcctctccgacagtgtcctctgttaaaattgttggctgacttattgtattcttcaacaccaatatttttttagtcctcttttaattttgtttttattattatactttaagttctagggtacatgtgcacaatgtgcaggttagttacatatgtatacatgtgccatgttggtgtgccgcacccattaactcgtcatttaacattaggtatatctcctaatgctatccctcccccctccccccacaccacaacagaccccagtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtctatcattgttggacgtttggcttggttccaagtctttgctattgtgaatagtgacacaataaacatacatgtgcatgtgcctttatagcagcatgatttataatcctttgggtatatacccagtaatgggatggctgggtcaaatggtatttctagttctagatccctgaggaatcgccacactgtcttccacaatggttgaactaatttacagtcccaccaacagtgtaaaagtgttcctatttctccacatcctctccagcacctgttgtttcctgactttttaatgatcgccactgtaactggtgtgaggtggtatctcattgtggttttgatttgcatttctctgatggccagtgatgatgagcattttttcatgtgtctgttggctgcataaatgtcttcttttgagacgtgtctgttcatatccttcacccactttttgatggggttgtttgttttgttcttgtaaatttgtttgagttcattgtagattctggatattagccctttgtcagatgagtagattgcaaaaattttctcccattctgttggttgcctggtcactctgacgatagtttcttttgctgtgcaaaagctctttcgtttaattagatcccatttgtcaattctggcttttgttgccattgcttttgctgttttagacatgaagtccttgctcatgcctatgtcctgaatggtattgcctaggttttcttctagggtttttatggttttaggtctaacatttaagtctttaatccatcttgaattaattttcgtataaggtgtaaggaagagatccagtttcagctttcctcatatggctagccagtttttccagcaccatttattaaatagggaatcgtttccccatttcttgtttttgtcaggtttgtcaaagatcacatgcttgtagatatgcggcattatttctgagggctctgttctgttccattggtctatatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagtagtttttcccaattctgtgaagaaagtcattggtagcttgatggggatgtcattgaatctataaattaccttgggcagtatggccattttcacaatgttgattcttcctacccatgagcatggaatgttcttccatttgtttgtatcatcttttatttcattgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgattttttcacattgattttgtatcccgagactttgctgaagttgcttatcagcttaaggagattttgggctgagacgatggggttttctagatacacaatcatgtcatctgcaaacagggacaatttgacttcctcttttcctagttgaataccctttatttccttctcctgcctgattgccctggccagaacttccaacactatgttgaataggagtggtgagagagggcatccctgtcttgtttcaattttcaaagggaattcttccagtttttgcccattcaatatgttattggctgtgggtttgtcatagatagctcttattattttgagatatgtcccatcaatacctaatttattgaagagtttttagtatgaagggttgctgaattttgtcaaaggccttttctgcatctatcgagataatcatatggtttttgtcgttggttctgtttatatgctggattatgtttattgatttgcatatgttgaaccagccttgcatcctagggatgaagcccacttgattatggtggataagctttttgatgtgctgctggatttggtttgccagtattctattgaggatttttgcatcgatgttcatcagggatattggtttaaaattctctttttttgttgtgtctctgccaggctttggtatcaggatgatgctggcctcataaaatgagttggggaggattccctctttttctattgattggaatagtttcagaaggaatgctaccagctcctccttgcacctctggtagaatttggctgtgaatccgtctggtcctggacttttttaggcaggaatttccttgtcctaataagcccaggagtgctacaggagaccagggcttatttcatccctcagcggcgaccgtaaaagacagccatcccgaaagcagccatttcagaggcctcccctcagggatgcattctctttctcagggatgttccttgctgagaaaaagaattcagtgatatttctcccatttgcttttgaaagaacagaaatatggctctgttccacctggctcaccagcagtcagagtttagggttatctcccttgttgcctgaacattgctgttattctgttcttttttcaaagtgcccagatttcatattgttcaaacctacatgctctacaaacaatttgtgcagttaacgcaatcatcacagggtcctgaggctacatacgtcctcctcagtttacaaagattatgggattaagagactaaagtaaagacaggcataggaaatcacaagggcattgattggggaagtgataagtgtccatgaaatcttcacaatttatgttcagagattgcagtaaagacaggcataagaaattataaaaggattaatttggggaactaataaatgtccatgaaatcttcacaatttatgttcttctgccatggcttcagccagtccctccgtttggggtccctgacttcccacaacagtttattaactttgtatgactaataatgtaaaatgttccccatatttttagcaatgttttacttatttgtgaaaggtgtgtttattaatttttcattttaaggtgtcacatttatctttcttgtttctgggatttcattctagtagatatagctgaatgcattttaacaattattgtaatcatctcacattttatatttggatttgcatatacattttattaagattttgattttgatataaaatattttcttacaattgtctcttttctatttttatgagataaaattaatgtatgcataattgcatacatcttcaatgtacagtttcagggtttctgacatatgtgcacacatttgtctccagcacctaagttaggatgaggagcaggtcagtctccacaacaagtgtcctcttcagtgcttccagtcagctctcacataaggatttttatttaatttcaagttttcattttcactaatcatcagagaaatgcaaatagaaaaacgttctggtttctgtcactacagttcaattttttcctgttttgggcatcacataaatggaatcaaatgttatagttcattttttgtaaggggctacttttgctatttgtgaggttcattcatgtatttgcatctaccaaggttttgtcatcatatatatacacacacacacttatatatgtactaatgcacatataggtatttcatatctcaatcagtccattacgttaataaatgacagtttattaagtaaatccattcattaagtgaataagtgacaaaaaatatatctattttcctgttgatggaatttagtttccaaaataaatatcgtaaacacatctgttataaatatctttgtacaagttcttctgcttatatctcccatttttattgataaaatatgtataaatataagtatgcattataacttttcagctttatggagctataactgacaaataaaattgtatgaatttaaggtacaccacttgaggtattgatatacatggggaaatattcatcgtgatcaaagtaattggcatgcctatcatctcagagaatatcattttatgcctttaatttattgtgagtctgtgatgaaaacacctaagatctactcttctggaaacagataagtttataatataatattcattagtatagttacattgctgtatgtttcatctccagaactccttcaacctgtgtatcagtccattctcaaactactttagagaactacctgagactgggaaatacatgaagagaagggagttagttcactcacagttctgcaggcttagcaggaacttatagggaggcatcaggaaaattacgatgattgtggaaagtgaaggggaagcaaggaccgtcttcacatgctggcaggggagagagagaaagagcaaggggagatgcgccacacttttaaacctcaagatcttgtgagaactctaacacaagaagagcaaaggggaaagccgcctccatgattcagtcactccccatcagacccctcctacaacacttgaggatgaaaatttgacatgagatttgggtggaaacgctgagccaaacagtatcattatacccggccactcacaaatctcatatccctctcacattgcaaaatataattatcccttctcaacagtctcccagtcttcactcaattcagcattaacacaaacttctacagtccaaagtctcctctgagacaaggtaagtttcttggatgtataaccctgtaaaataaaaaacaagttagttacttccaagctaatatgagatgaatgcactgggtaaatgttcccattctaaatgggagaaattggccactacaaatgggctacaggccccatggctagtccaaacactagcagggcagtcatcaaatcttaaagctccaaaaaaatttccttttactccatgtctcacatccaggacacgttgatataagaggtgatctcccaaggcctttggaagctccacccttgtggctctgcatgttagactccccatagctgctttcataggctggcattgagttgctatgtcttttccaggcacaccatacaagctgctggtggttctaccattctggggtctgaaggacagtggtcctcttctcacagatccactagacagtgcccaagtggggactctgtgtgtggaatccaacaccatattttccttctacactggcctagtagaggtactccattagagctcagcccctgcatgagacttctgcctggatatccaggcattatcatacatcatctgaaatctaggaggaggttcccaaacctcaactcttgcctcatgtgcaccagcaggctcaacaccacgtggaagcaaccaaagcttagggcttgcaccctctggagcaatggcctgagctggaccttgaccccttttagccatggctggcacaggacagacagggatgcaaggcgccatgtcccgaggctgcacagagcagtggcgtcctgggcttggacaaagaaaccatttttctctcctgggcttctggacctgtgatgggaggggctgccacaaagatctctgaaatgccctgcggacattttttcccaccggggtccttgttacttatgcaaatttctgcagccagtttgaatttctccccataaaatgaggttttttgtctaccacatggtcaggctacaatgttttatcaaacttttatgctccgcttcccttttaaacgtaagttccaatttcagaccatctctttatgaatgcacatggcttatgttttcagaaacagccaggtcaactcttcaatgctttggtgcttagaaatttcttctgccagatataccttaaattatgtctctgtagctcaacatttcacagatctctagggtagggggaaaatgccactagtctttttgctaaagcatagcaagtgtgaccttcactccagttcgcaataagttcttcaccttcatctgacaccacctcagactggacttcattgcccatatcactatcagcattttggtaaaacccattcaacgagcctctaggcagtttcaaacttttccacatcttcctgtcttcttgtgagcactccaagcttttccaacctctgcccattacccagttacaaagtcacttccacattttcaggtatcttaatagcagtatcccactcctggtgcaagttttctgtattagtccattttcacattgctataaagactacctcagactgggtaatttatgaagagaagagttttagttaactctcagctctgcccgctaaacgggaagcattattgggaggcatcaggacgaacaatgatggtggaaggtgaacgggaagcaagaaccttcttcacatggtggcaggagagagagagcaagtgagcggggaggtgccacacttttaaaccatcagatctcttgagaactttatcacgagaacagcgaagaggaagacaatcccatgaccaaatcactttatcttaggcccttccttcaacatgcagggtctacaatctggcatgagatttgagtcggaacacggagccaaaccatatcaaccttcataacgggaagtttttaccctttgaccaacaatacccaattttttcctcctcccagcccctgcgacctactattctactctgcttccaagagcttgaatattttatactttagattctatatataaatgagatcatgcagcttttgtctttctgtgtctggcttattccacttagcataatgttttctatttgttgcaaatataagaatttctttgtttttaaaggctgaataatactcagttttatgtaggtataagccacattttatctgttcattcgtagatggacattgactcgttttccttatctagactattatgaataatctcacaatggacatagatttgtcacactcagtttattttctctagatgtatgctcagaagtggggatgctctatgtccagttcactgagtaatcttcatgttgtttttcatactggctgtaataattcacattttgttccaaaccatacatggatacctttgtaccacatattcaggtctttgtgtaactcttgaatccatttttagctgatttctgtgtattgtgtgaggtgagttctatctatttcttctgcatatggatgcccgtttttcacaccactcgttgaagagactgtcctttctctactgtgtgtcttgggaacttgacaaagatcagtttattaggaagaaatgggttggtttccaggttgtgtttaatgttccattggattatatgtctgtttaaatgccagcattataccattttgatttatatagatttgattttgaaattatagattatgatatattcagctttgttatttatgcccaaaattactttggctatttgaagtcttttatatttttatataaattggagctttttaaaaacattttgtaaaatcatgccatggagattatttatttattttattggcatatagtagatatacctattttatgggaacatgtaatatattgatacatttataaatgtgtaaagattagtgtaagatttacatatctgtcacattaaaaatgtaccctttccttgtgctgagcacatttgaatgactcctttcgctattttaatgttgtgcattagattattattaactatagtgaccttactgatctatcaaacatttaggtcttatttctcctctataaatgtatatttgtatacagtaatcaacctctccttatctccttctctcttctatccatccaggattctggtaagcaacagtctattctatcttcaggcgatccagtattttagttttgatgtaaaataagaagatgcaatatttgtctctcttttattggcttatttatcttaacataatgacttccagttccattcatattatagcaaatgacagaatattgggtttcatggctgaataatatcctatcgcatacatagattacatttactctatccatttgtccacctacagacactgaggtgctttcacatctgggctattgtgaaagagctgcaaagaacatgggaggggacatgccttcatgaggtggtggtggttttatcttctttagaacatacccagaagaggatttgccaagtcataaggtatttctgtttttaatttattttggaatcttcatactactttgcacatagtggaaacacaaatggagtaaacattaaaaaagcagtttcggttttgatgtataatccagaaacaaataatgtttgaccatgattctcattaggagtctctaatggatctggtggaaatgcaggaagttttctaaccttgttcaggaaattatgagtttgcacctttttctttttgaggcttgaaattggcatgattcatgatgcatactgttgggaggtttcagaatgatatggcaaaaatcataatgaaaaggcaagacagagagagagggagagagagagagtcaggcctagaaagagaaaaaataattttctcaacaggagaaagtgctggatatctgtatcagtgttgagttttgctcatagacacatctgtaccgagtgaggaaccatgaagtcaagggaggggtctagaacttgttcaagtgaagcatcagcatatttctcacaggcaccaatttccaccacatcacaagggtgatgcatttttgaatgccattaaatatgagttcacagtcagtaatcatgtttccatgaaattcagttaaaataccaagggtgtgtccagatcactcatgcacaaatacacaaaatttgctttttcatgtgtggctatctagagacaaagtgcactgaggagacttcagcaggttacagagatttgcttaagtttggaaaaccatagaagagtgcctttaagtgaaggttggtatataaattaaataggtcaaaatcccctctatggagtagcgttccaattgtgtggaatttttaattccttattcagttgtaaaacataatccctaggactgactccgtggagttttactgctgtgttgacaaaaatatctaacaagcttccttccagtgtttcaagggaagtttttctctaaattttttccaatgtataaattttcctggctaaagatagtaaaaggctgttaaaaacacaactggaatggcagctttaatcttttgctgattgataggagtgagcataatacatgaatctctttgagtgttctgcctcatccaaatacaataggtcaaaggctagtactggaggtaagatttccaaatgtgtttttttccagctaccaagtcataggaaaataacagatacatccttgagacagaggaccataatgccacaatgctggtaggagtacatgtagacaagggagttcaagggtttcttaaaactgataattttaatgtaagaataccattcttttaaacttatgtggaagactgtgggaggttataacaatgccatattttagtatcagccctgcctcacagaatcattttataacagttcctttcatgagtgtgcttcactcggttcatgcaaaaacctggcagatcacaggctaaaaacagaaaatatagaagcttttaatcaactgaaagagctgtagcctttgtcaaggaattattggaagacacagagaacacagatagatgataaataaaatacattcatatcccgttaagtgtggaaattgaggaaagtttacataaatgtgtccaagtggcaaactgtttatttaatctggtaaccaatttttctataaattgtagagttgaaatgcaacaaatacatatttgaaatgatctggcacaaattaagcaaatatggtaactatgtattttcactcatttttatttaagatcagcggctcagcattgatatttttgataatatctgtgactcagcagctttaccttttgaggatatgatctggtatggcagttttcttagcttcaatgttacctctttttgcattgacttccacctttatatctgccaggaatctggggaaaaggagtgcctgtaaacgttccctaacttgcccattttggtgggttttccagaatgtgtgagatgctttttttttttttttcaaagcatcctgaacccatgcactgccctgaaacatgtttatttcctagtttaacaaattggcacttctaataaatgcaatctcttctgccatctgtgctgattttacatcagatagaggactgtgttctaaaggaaatcttatattagtaagagcaattttgtcattaacctagagttttattattgaggtgtgattcataacatataatattaggtagaggttctcagtggcagtgtctaaatctcttgggtgtacagtgtcttccccgttaacatgaagcatttacgagcacagtcatagtttccagccatgcttctccctgtctcacaatcaccacaaactaactatgaccacaactggaacttggtgagttattctttaataagttttaagtttgtctttaatctttatgcctctagattattatgtgagacataatctttatgcctctagattattgtgtaaagctatttcagaagaaagttaaaaagaacattttaactgactaaacaacacaggaaatcattaataaaatgcaaagtgtagatgtgagaggctccaggcctggataatgcaagagttcatgtatgcaggcagtttctttgcccaattatactgatacaaccagcatgtcagcttcatgccccatttgactcctattatgcaagcgcatggaaatgacatgctcaagggtcacacacagatatgaaaactggtgggagcaggagaggagacgactctgcacttctcctctgaaggaccaggaaagcctggacagaccatctccccagcctccatgactgcgcgacgtgcccacatggacactcatctctgacaagataagaagactccattgatgaggctgaacattttatgatttaaattactagagacttacattgaggtttcaataactaatttttataacccaaatttacttacccccatgttgttacctctttcttcagtgaaaaattgcttttgctgtaattgagttttaggaagattcccagtgttcacaactgagcttccaagagagtgttgagaacaaaaactgaatgagggcagagaaacccatctttactgtgttcaccactaaactcaagtggactcggcactgcctttgatcactgttgcttctctgcagagttcaggtttgtatttctcacaattctaacacagactctccctctcctcaaaggtttggcctccactggctgtaaggtcacactgttctgaatttcttgtctgaaccgttttatgagggtggtgatgagccatttaatggaaattttatatcatctcagcatgaatcctatgggcggtcacgaattattattctgattatggtaattgatttttctcagcatattcattactagtgatattcaaaaaccctttttatttaaatctttgatgcttcatttttgttgctatgacactttttcttctactgagtcttcccactagcattataacatgacctaatatccagggctcagttgttatataacaaccacatatgtcaaaagctatgcattcttttcacagcagacataattttctcttttctggagatgaacacacactggctgagctacccccactcacaagaacatatggaaaatcatgacatttttatttacttgactaataaattatgtcattctctcttcaaattctttatcccccagaatgccatgacaaactcttctgcatctgttcaaaccataaactcagaaaccacatggtgagtaaaagctcacttgattcgggatattgggtcaagctcttcccctccaatgtcccacagcattgggacctcagcccacctgtccaggttctatcaagagagtttagctccttcacagtgaaggaaacaattgagttaagagggaacctgcagaagatagacaatattgaaaaccattcatatgacaagggattactatcaagcatataaaataaactcaacccaactgcaaataataatgtggctaataatggaggaataacattaatacatatttctcaaaagaagaaaagaaaaagggcagatagatgatagatagataaatagatatattagtatgtatacatacatatatcgctagaaaacactaatattcaggaaaatgcacattcacaatgagatgtcttttcatcctttatctttgcttgagagtcagaaaatctaaataaataaataaataaaacaggagctggccaggattcatagaaagggaaactcttatagaccattggtggaaatggaaattagtgaagccatcatgggaaaaaatagaactaccatataattcacaatccaactgctgagtatgtatctatttaaatcattaaagtaaaaaactaatattgaagagatacatgtacacccatgtttattgcagcactatccaccatagctaacatatgaaatcaacatatgtgtccatcaacagatgaatggataaataaaatgtgttatatttacacaatggaatattgttcagtcttaaaaatgaaattctgctgttagaagcaacatggatggaactggacaccatcatgttgagtgaaacaagacagacacagaaaaataaatacagcattttctcagtgttatgtggaaattttaaaaagttgatcttctagaagtaaataatagagtagtggttatgagatgccgggaatgggaggagactgagagacaataagaggtttgttaacaaacgtataatttacaggcagataggagggatgtgctccagtgatctacagtgcagtagggtgactgctgttaacaatatagtgcacattttatgtttacaagtagccagaagacagaaatttgtatgttaccaacaaaaagaaatgttagtgtctaagctgatgaatttgttcattgttctgatttaatcataccacatggcacacatgcatagaaatatcacactgtaccccatacagttattatgtgctaactttaaaaaatcctttaattaaaacagattttatttgcatacattacaaatgcttcaacacagagccaggaataaataccatttttctttgaaatgtgaatttcctaacaacgtagttacattcatttgaaccaaaccgtgtatttgatcatggtaagaatagacaggcttatgcatagaatgatatattttaattttagacttctacttaataccataaattcaaataattttaaaacaactaagtaaaaactataaagttgaggaaatgtgtacgtggtgtgtgatgtgtgactttttccttgcgcaccactctgtccatggtggatgtgtggtgtgggtgtctgtgtctatttctgtttactctgcttgaggttctctgtgattctaggatctgtagttcagtgtctttcacaaaactgggaacgttcttagccattatttctttcaaatactgtctctgtatctacaatttctcctttcagatttaaaatgtacatatacaatactttttaatattaatgtttactttcttcactctcttttccttgcactttactctgtaaaatttctagtggtattttaagtgagtggtttcatttaaaaggtgagccagctctactgaagggtgtgcccaaagcttactcaatgtttatactgcattgcttttgatttcttatgcatttccatttgattttttcttagtattttcaactctcagttccctatctagtccttcattatgtatacagtttccttaatagatttttacatatgaattatagttactttatatatcttgtttaattagatagttctaagatccatatcatatagaagtctcattctgatcatttgtttattatgactttggtatttctcattaatatatgtaatctttgttgatagccagatattttaggttggacagttgatattggcttattacttcattttatgcattttctgcctgtatttgaccatactttatttttgccaggcctttaatgtggaaatgtttgaatcttctcagagctacatttgacgtttacttttgcagtagacgtcatagttgaagtctgttcttctgtgtccaccagagacttcagatcctccagtgataccttgtttttctttcctgcttggctttgtctcttcaccctgttccttcctccagagaatctctttcagctccttcaggtggattaagatattatattgaactgacaattgtgaaattggtggaaggcaatagaataaagggagattttctgacctttcatgggtctatatttctacgaaggcattgtgaccctgagtctgggtgtgacattgccggtgtttctgaacttctgccagatgagatgttggtctgtgtgttcttgctgttttccctgctgtggagtcctcttgttttccccagttgttccctcccacagctccaatgttctcttttggtgttatcagcttccagagttgatgacctgacctagagattaaggctctgattaaataagaaggaggggagatacttctcaatggaacttaggtgaagacctctttttccatctcagttcctaagggatggccccagtgcccctaagatcctggctttggtggcttgctcctgcagagtaatttcttagttctgcaatggggattaaggaggtgggtctgaatgcatttcagagtgtgggctctttttctctcccagacagacacattgggacaaaagatttttgtgactgtccccatttttgggaaaaaggtttcaaggtataggaaagctcttcagtatgtggtccctgagaaattcacgctacaacacatttaccacacttgacttcaccaattcagtatgtatgtatttttttctcttataatagcctacatttttatatgccagactctgcctcagttcaactcatacccatgcctttttactctctgcaagaacttgtctctccctaaatttcggatttgatgattatcttaaaacctccagtatttaaagtatattttaaaattggcaaaattccatctcctgtgtttatctgttatgttgatgctgtaaaacagtaagtaaaatatactcctcatctatgtacattttgaagctgagttgcaggttttttggtaagacccagagtcacagagaattcaaatattgttaagctgcttaatagaaaaacaaattatggtaaatgtgttcactggaatactacccatgatttataataaataaatgcctgacacacagaacagcagcaaaaccacacatgctcttattacagaaagtggcttctgaaaaccacaccgggcacgtacagctttgtcctggagttggtttagggggatgtcagagccagtgacgagaagcacagggccagatggcagcgttcactcatcccagacatgagctcctggatgcatacagagcccccccatgtgtgggtttacttccacttctgtaaaaggagaaaatactgactcctacagagcataatttacacattttttaaaaaatgtaatagggtgatcagggcaaagtgtttatcacagcacaatttcataagacagcatattttccaaataccatcattgtcagcaaacttctgcagagcaccgtcttcttatatgggtacagcctattcctccagcatcccactagagcttcttatatagtaggagacatgcaaatagggccctccctctactgatgaaaaccaacccaaccctgaccctgcaggtctcagagaggagccttagccctggactccaaggcctttccacttggtgatcagcactgagcacagaggactcaccatggaattggggctgagctgggttttccttgttgctattttagaaggtgattcatggaaaactaggaagattgagtgtgtgtggatatgagtgtgagaaacagtggatttgtgtggcagtttctgaccttggtgtctctttgtttgcaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcaggggtcccttgggaccaccagggggcgacagggcattgagcactgggctgtctccagggcaggtgcaggtgctgctgagggctggcttcctgtcgcggtctggggctgcctcgtcgtcaaatttccccaggaacttctccagatttacaattctgtactgacatttcatgtctctaaatgcaatactttttttgtcctttttgtttctttgtttttttgcaacaggagtacatatcctcagctccacagaagccagggtgtcactttgggggcagaaataatcgtttcgtggtcaacaggatgagagtcctgaggaatcccagggaaacctggagagtgttttccaattagactcagggcagagacctccatgggaatttctgattagaacgggctttgagctctgatgggagccaagagacaggctcacccagggtcggggtccttaaagcctgatggttttcacagctatcccccctcgtcttgtaaactcagactgattcagttgaccctttttctgctaatccattttgcttctctgtaggtttgattctcacagttcgctttcttcttctcttccctgagaacaaacgatgtgttttctgttttcagggaaaatcccagggctcaggtctgcaggacctgggtaggctgaggagactttctcactcaccattgtctggacactcctgttgtcttctgtgcatggaggcatttgggaaatgaagtggacattagtcattaagggaataatactagttttctccaattggatattgatgtagagctgaacttgtgcttctcacactgtcacagagtttggaccctcacctataactttgaggagagttgatgatggatagtccattgtgggtgagctctgggtaacagtaattgtagggtctggctaggcagcctaaggtcaatacttctggacctcaggaaagacaggctggaattcctgggaagacctgcatctgccatccaccgtggagtcccatcatcttctgttatgctgtgattgaatcagccccacctagtttatctagaacactcttcatgacttaggaaaacataatggcaagctctcctaacacctgtatcatgccatgggagcaacacctaagctagtgtgtgattgagtagatgagactgtgatctagtcaagacgacaggtaaaattgattgttgtcattatgatattttatatttggcaatataatcatgctcatattataaatacttttgctacattttttgagtgtgtcagaggctttggaactggaacaacttcatcttgaataggggctaggaaaaataagaccgagacctgctgggctggattcctagtaagttgatgcagtaagttagtcacaggatgagataggaggtctgcacaagatccaggtcataaaggccttgcagataaatcttacagtaaagaagctgggcaaagccctccaaaaccgagacagtggctaaaatgacctcagtttgtcctcactgttcattatactctaattataatgcattaacatgctaaaaaacactcccttccagcccccaagacagtttacagttgtcaaggcaacatcatgaagtttccttgtgtggtttaaaaaggaggggaggaacactcaacttcaggaattgcctggaggactcatgaataatccatccattgtttaacatataatcaagaaataaccataaaatggacaaccagcagcccatactgctgctccacctctggtgtagccagtctcattattttacttgcataagaaacttgttttcattttaatctgtggattttccccaaattgggacccctttctcctaatatttgtgctattattcgtgttctgagcagaaaaccccaagatggaatgaagtttccctacatttttataagaagtacattcacccctttgagcgaaaatgcacagggagtggaatgaggctgggaagctaatggcgtatgatggaagcttgtccctgactggaggagagagggagggaggattgggaggaaggttcctatatttttgtgctatgcaaggaagctgcaaaagataactgagtctcgtgtaagtcagtgctacctctcaggggatccctgtgactccaagaaagggctcttcttaggaatcactgtggagtcagtcctttcattagagtagaccacaggacatgggcctcagcacacgccatgccacagatgtcagaaagcagctgctgggaacctgatccacctgcattttgctgcctgtaggaggagggagggaggtgcattctcagggtcagcacactgtttgtgaatttttatagagaacccctgcttttgctgtatttttattggaaaatatatgaacaagtgtgcacctgcaaacaactgtaattttcacatttccttcagttgcattatttcttaatcctgaatgacgtcctgacacagagttgagtttttcacaggcattgttcgaaggatcgagatgatggcattttccacattcactggtttttctccatgtggcagagaccttgagtagagcacatctggcccttatccacactatctcttgtgtcccctgggaaagagcagagatttgcctgactgcagaatctggggtaggagtctgcacacctctgagcctgcagagaagctcagcgaagttttgtggagtcagagagctttccgtgtggggaacctctagcttcctcactctcggagattaatggtcagctgtacttgaggggttaagaattagagcaccttgggagcctgtctcatcacagttccattatgtaacttaccaccattagactgcgggtaataactcaatcttgatttttctgacccgattttttcatcttattcattactaattttgtttatggaaaatgttatgtttagtttatgattaaaacctcagaactttctgaacttatcaggaataatacaaatgtgtccagtttgggggaaatgtaaatgaatgtccatgcagtttgggtgtgtgtgtgtgcgtgtgtgtgtgcatgtgtgtttgtttgtgtgtgtgtggatatgtcagtcacttacaccacaatgaacatgattgctgaattacatagtcaaactaaaattagatttgctgaaaattgcctgcagcgatgtctgtgaagctgaccctgtcactttgctgtgaagaaactcagtgtacaggcgaggttgcacgggagagctaaaagcttctgcacacaggacaggctgagctcctgaactggagccaggcacaggactgagcacctgagaaacagaacccccagccctcctttatctgggctggatgggcaccagaggacccgcaggagatgctcagaactcacacaagacagagcctcagtgaggagcagaggcagcgaggaaccagtccagggagccctgtgaccgccacctcgggttgtcttattttgcttaacagcatccaaacctcaggagaccatttattacgttatttagacttccatgccctttctgtcccgaagtaaaacaaacataaatatgactctgcagttagctctttgaacctgggttatttttctgagaatgtcatcttcgtcatcaacatcatggtcatcatgtcaaaatcaacaggcaaatccagtcaccgtgaagacagtttcatggcatgattcatacacaatcattccattccacagagaatctctttcagattcttaaggtggattaaagtgttatatttaattgccaattgtgaaattggtggaagacattatactaaaggaattgtctctgacctctcatggggtcatatttccagaaaatcattgtgatcctgagtgtgagctgactttccaagtgttcccaaccctcctccagatgagatgctggtctgtgtgttcttgctgcttcccctggggcagattcctcttgttttccccagttgttccctcccacagctctcataatctctgttggtgtccccaacttccagatctgctgccatgacctgcagattaaagctctgattccgtaagaaagtgaggggagctgcttctcaatagagctttgatgggaacctctgttcatacctcaattcttaaggggctgcaccagtgccctaggatgctgattttcatggcttgctcctgcagggtaatatcttagttttgtagtggggatcagagaactgggtctggatgcatttcagaagtgtgagctcattctctcccagacagatactatgggaaaggaagatgttttgcaggggtaaatgattcaagagattagggcaactctccagtatgaggtcccttagaatttctcactataacatgcctaacacactcgacttcaagcaatccagtgtatatttgttcttcatcttgtaatagcctacattttatatgacagcctctgcctcagggaatttcatactctggcttcattactctctacaggaacttgcctctccctagatttcaaatattttgtttgttttcaaccctcaattatctgaagcattaagtaaaatttgcaaacttccatcttttctgtttatctgttattgttgatactattgttgtaagaatgaatatatgggcccggcgcggtggctcatgcctgtaatcccagcactttgtgaggccgaggtgggtggatcacgaggtcaggagatcaagaccatcttggctaacacggtgaaaccccgtctctactaaaaatacaaaaaattagccaggtgtggtggtgcgcaccagtagtcccagctacttgggaggctgaggcaggagaatggcgtgaacccgggaggtggagcttgtagtgagctgagatcgcgccactgcactccagcctgggtgacagagtgagactctgtctctaaaaataaataaataaataaataaataaataaataaatatgtgtgtatatatatatatatttctcatctatgtacatttttaagcttagcagcatattttttagtgagatccagaataataaaagaatccaaacatttttcagctgcctaatagagaaacaaattctggtaaattttttcactggaatactactcaacatttataataaatatatttctggtacacagaacagcaaggaaaagtatctaagtatttatgctgagtaaaataagccagacaaataagaatatgtactatattactccatttatgtaatttatttcaaatgaaaaaaatctaaagtaatatacaaaagatgagtagttacctgggaaaagggtagaataaaggaaggggaaatgtggaaacatacagaagaacaagagaaaatgttgaggggaactcacttgtccacctcagtaatgatgacgcttacatcatgttttcaattctacactttaaatacgtgaagtgtattatctgccaattaacactcacaaaatttattgcaagcaaacaaatgaaaaattagaccaaaagcggtggtataaagatacaaaatatccattaaaagtcagaaatatatgagaatttgcctcctgaaccctagttctctccttatttttaggtgaatgctagagtgccacaaaaatcactcaagttctcaatacaggaagtgggttccacaaagcacactaggcatgtccaattcttacctggagttggttcagggagtaactggggccactgatgtggagcacaggccaagctaccagggctcattcatctcagacatgagacacacacagcccctcctccgtgtgtgggtttatttcacatctgtaaatggagaaaccattgacttctacagaacataatttacacaaatatgtaaaaatataatagtgcaaaatgtttatcacaacacattttcataataagacagtgtattttccaaataccataattgtcacccaattcctgcggggccctgtcattttatctggggtctgccatctcctcagggttcccaccccagagctctctgtgtagcaggagacacgcaaatagggccctccccatgctgatgaaaaccagctaaaccctgaccctgcagctctggcagaggagcctcagccccgggattcccaggtgtttctgcttggtcaacactgaacatacaggattcaccatggagttggggctgaggtgggttttccttgctgctattttaaaaggtgatttatggagaactagagctattgagtgtgaatggacataagtgagcgaaacagtggatatgtgtggcagtttcttaccaggatgtctctgtgtttgcaggtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgtgagagatacggtaaggagaagtcagtgtgagcccagacacaaacctcccttcagggtacctgggacaaccagggaaagcctgggacactgtgcactgtgctgaccccaggggcaagtgcaggtgctacaagggctgggtttcctgtcttgatctggggctgccttgttaccaaattacccgagggaacttctctagatttgcaattctgtactaacatttgatgtctgtgactgctaaacttccctcacatatttgttttttgtttgtttgttttgttttgttttttgtaacaggaagacccatcctcacccctacagaagcccgagtgtcaccttgggggcagaaatgaccctgccttggtcacattgatcagtgtcctgaggaagcccagtggaacctggggagtgttttccagtcaggctcagggcagagacctccgtggaaatctctgattagaataggtttgggattcagacttgggccaagagggagtctcacccatgggagggtccttaaatcctgacagtttttacagctgttctccctcctctggcaaaactgtgcacatctgactcagaactgatccagctggcccttacttgctaatcaatttttcttctctctacacttcattctcatagttcccttttcttcccttcccagaaaacagagagtgtgttttctgtggtctaaatctcagggctcaggcctgttacctggaactcaggtgtggcccaggctgtggctcctgtgagacctggggaggctgaggggactttcccactcaccattgcctggacccgcctgctgtcttctgtgcatggaggcatttgggaaatgaagtggacattagtcactgaggggataatggtagctttctcaaatgagatactgatgtagagctgatcttctgtttctcacactgtcacagaatttcctccttcatctgtgactttggggaaagctaaggatggacactctattgtgctgtgagctctgggtgacagcaattggagggtctggctaggcaaatcctacagggtttcaggtcaatggagttggaatttctgggaagacctacactgtcatcctccatggagtcccatcatcatctcttatgctctgatggaatcagccccacctaggttatctaggacaatcttcctgacttaggaaaaaaatgatggcaggctttactaacacttatattataggatcagtacaacacctaggttagtgtgtaactgaataaatgactctatgagtcaaggggacacataaaattgattgttgccatgacatttatttatttatttatttatttatttattggaaaccagagttttattgttactgaaatgagtctcgccaagcattcaagaatgggattttttaaggatagcttggtgggttgggggcagccagtgagtcatgagtactgattgatcaggtcagagataaaatcatagggagctgaaggtgtcttgtgctgagtcagttcctaggagggggccacaagatcggatgagccagtttattgatctgggtgatgccagctgatccatcaagtgcagagtctgtaaaatatctaaagcattgatcttaggctttataatagtcattttatccccaggagcaaactaggaagggttagaatttgtagccaccagctgcatgactcttaaaacataatttctaatattttggctaattcgttagtcccccaaaggcagtctagtccccaggacgaaggagatttgttttgggaaagggcagttattgtctctgttttaaactataaactaaactaagttcctcccaatgttaggtaagcctacacccaggaatgcacaaggacaacctggaggtttgaggcaagatggagcaggttaggtcacagctctttcactgtttcagttgcagctttgcagtggtggcttcaattcctccctttgagttttgaccttatcgacttgttttgtttctctttaagtgatggttttataaccatctatgaaactctaacaggtgctctcacatgcagatttctgattaaaaactctgaagatggttacaatagtatagagataaaactatcaaatagaagactatcttttttgacttttcacttaaaatgttgcccaagaaaacttttcttttgagctatttatagctttcaacaattgagtatagtcctgtacataaaatttggagaatatttgtttctctctgtccactttctccagaatttggaaactctttgtgaatatccttaacttatggcaatatgatttttcataagtgcagtaagattttttttttttttgcaacaggacacaattggagaaactggttattttaccaaggctttgactgtaatggcgtgcttcaccttaagcaatcgaacttgacttatacagccaataagagccccttgggaaaactggcctgtaccttgtccacacagtctttgtacaaggttcctgaccagtggtaagtaaagaatgtcactttctaacaggcccaagaaccccatgttttcctgggaccccagaggaaaaataatttaccagacttacaggtatttgatggtaaaaactcatggctgggcttggctttaaaaaagtcttatctgagattccttatggaacagagttccaccaaagccaattttaaaagcctgtgtaaacaataattatttgtattgtgctttatgcaaataataaggccatgaataataagactaaagtttattttgcaaataaatcagtcctatcttgatttgttttaaataaaaatggggacaagagagaaaaaaattatgctttaaaaatatagtacacctgttgtttgctgttcttgtttttttttcttcagcagtttggacgaaattctaaattatttgtaggctacaaagccataaactaatgcgttcaaatctttacttttaaaactgcgaattgcactccttaccccagttctcattatgtactttatagtatgttgttccctccaatgtggtgctggaattatagatgacagcactgacagctttgccatgcaagccttggaaccccacgcaggcctgcgtgagtacactcagacagttgcaatgaggttccagtcctcttatcttgaggtcagcacctacccctactacgccccaggtcatcaataaaaagttgtaacagtcttggcccttcttacatcttcattatccaacaccatgatttttgttttttgccaaaacaattgccaaatatagtcataatcataggataaataattttgctgaaatatatgtgttattattggtcttttgagatggaaagtccaagactggattatgctttcatgcatttttcataagaagtacttccactcttttgacaggaaacgcacagggggtgacatgtggctgcagaagctgatggcatatggtagaaatctgtccctgagtaaaggagagatggacggaggattgggtgaaacattcttaggtttctgtgctgtgcaaggaaggtgtaaaacatatttgagtctactacaagtcaacattacccaagggggaacccctgtgactccagcaatgactctgcctcagaatcactaaagagtccttcctttcattagagtggaccacaggatctgggccatagcatagacgtcagaaagcagcagcttgacacctgatccatgtgcattttcctgcctttaaagggagggagagaggtgtattctcagggtcaacacactctttgttgatttttacacagaacactggcatttactttatttcattgaaagatatatgaacagatgtgtgtctgcaaatgattgtaattttcacatttattccaattgcataatttttaaattctgcttgatgtcctggcacacagttgtgttttctataggtatttttcaataaatcaagaaaatacattttccactttcactggcttttctccatgtgcagaggccttgagtagatcatgtctgactattagtctgttttcatgctgctgataaagacataccagagacttggaagtttacaatagaaagagttttattggacttacacttccacatgactggaaaggcctcacaatcatggtggaaggtgaaaggcacatctgacatggtggcagacaagagaagagagcttgtgcagggatctccctttttacaatcatcagatctcgtgaaactcatgcagtattacatgaacagtgctggagaaacccgcagccataattcaatgacctaccactgggtccctaccatgacactgggaattatgggagttaaattcaagatgtgatttgagtggggacacagccaaaccatattattttgccccatggcccctcccaaatctcatgtcctcacattgcaaaaccaatcatgcctttcctacagtcccccagagtcaacttgtttcagcgttaactcaaaaatccacagtctaacatctcatctgagacaaggcaagtcccttccacctataaacctgtaaagtcaaaagcaagttacttcctagaaacaatgggggtactggcattggataaacacacccatccaaatgacagaaattgcccaaaacaaaggggccctctgcaagtccaaaatccagcagagcagtcaaatattaaagctccaaaatgatcccctatgactccatttcccaaatccaggtcatgctgatgcaacagatggtttcccttggtcttgggcagctccacccctgtggctttgcagggtacagcctccctcctggctgctttcacaggctggtgttgagtgaatgtgccttttccaggcacatggtgcaagctgtcagtggatctaccacactgggatctggaggatggcggccctcttctcacagctgcactatgcaataccccaatagggactctgtgttggagctctgaccccatatttacctttctcactggcctagcagcggttctccatgagggtcccactgctgcagcaaacttctgcctggacacccaggtgttttcatacatcttctgatacccaggcagaggttctcaaggaccagttcttgacttctgtgtactcactggctctacaccatgtggaagctgccaaggcttggggtttgcaccatctgaagccatggcctgagccctacattggcgtctttcagccatagctggagtggctggacacagggcaccaactccttaggctgcacacagcacgggcaccctgggcctggaccacaaaaccacttttgcctcttaggcctccaggcctgtgatgggaggggctgccgtgaagacttctgacattcacaggagacattttccccattgtcttgaggattaacatttggctcctcattacttatgcaaatttctgcagctggcttgaatttcacctcagaaaataagatttcttttctactgccttgccaggttgtaaattttctgaacttttatgctgtttcccctttaaaactgaatgcctttaatagcactcaagtgggctttttgaattctttgctgcttagaaatttcttctgccagacaccctaaatcatctctctcaagttcaaaattccacaatttgctccagttcccaatgagttcctcatctccatctgagaccacctcaagctagaccttattgttcatataactatcagcatttttggcaaagcaattcaacaagtctctaggaagttacaaactatcccatattttctggtctttttctgagccctgcaaactcttccaatctctgcccgttacccagttaaaaagtcacttccatatttttggttatcttttcagcaatgtctcactctactggtaccaatttactgtattagtctgttatcacgctggtcccaagactggacaattcataaaagaaaggtttattggacttacagttccacatggcttgggaggcctcacaattatggtggaaggtggaaatcaggtctcacatggtggcagactagagaagagtgcacatgaaggaaaactcccctttttaatccatcagatctcatgaaactcattcactatcacacgaatagctcaggagagacccatgcccataattcagtcacctcccatcaggttccttccatgacatgtgggaattgtggaagttacaattcaagatgaaatttgggtggggacacaaacaaaccatatcactgaccttctccgcatcatctctcatgaccccagagaaagagcagagatttgtctggggtaggagctgctcctgtggaacttagaggctgcagacgaccccagtgcagttttatggagtaagagagttttcccatgtctgggaacttctagcatacccactgccagagattgctggttggctgttattgaggggttcagaattagatcacctggtagcctatctcactgcagccccattgtgtaacttaccaccaatggccttcacgtgaggactcaatgttaactgttctgacctcattttcttacctcctttatttgtaagtttggttacagatttttttttactttaatttcagggatatgtgtgctgaatgcgcaggttttagtttcttattcaagccttataattgctcaactgatcaggaataatacaacatgtatgcagttttggggaaatataaatgaacatccatgcaaaattttttgtttggatatgtccgtcagttacacccctatgaacataatagccggtcctcaccagaaattgctggtcctcaccgatctcaaaagcatctagatcttcaacttcctagccttgagaattcagaaaacaatgtttatgatatttctgagccacccatttaatggagttctgttatagcagctgaaacagactaaaccatttaccaagtctcagtaagggcagtgaggatccaccatgcttgagagacaagcattactctctcatttgcagctcaggatgacagaagcatgatcatgagctgatctgaaaagaagatgtggctttctctccctcggatctcagttgaagccatggtgtcacatctctatggtggagactaaattccagtctgtgatgtaatggatgcctgcctcctcccaccctcacttacgagacagagtttccatgccatgcgttattgaccaagaaccaagaaggactccaattattctcacccctgctcacttgtatggcagaggttctggggatattcctgggagaggcataatgagactatttaagtccacgattcccaaacagttttatgctcttaaagcaggagtatcactttgagatatatgaataatttcatgtgcactaaggtggaggctgttatatttttataggtaaagatgcatggcataaagacagagatacagcactctggaaattgtgtgactatgtttgcagttgactgtgaataatttttaccatgaagttatcctaaaacacataatatatttttactgtaagtaattaatgaaaagctgacagctccacaagagcaatatccacttggtttagcagagagaatgagaaatagcataatttaagaataatcagttagacactgtgccatgtgcctgtattttcaactagtgaggatgctaatgtgggaagatcacccaagcccaggatttcaaggccagcctgcaagatattgctagacccattttcttaaaaaaaaaaaaataacattctgggtcatgacaaacctcaaaaactgaccctctaaataggaacaaatttaattgcattaaaatgtggatgaatttttgacacaaaacagtgacagcatgccagcaatgagtacagaataacatccagttgttatgttaagagatacagactccgaaaaagagacatcaggtagaggctgtcaaaggcctcactgcctaatgactgcttttccattgatactgtgtgtatatcccggaatgcacctgtgaatgaggacatcatgtctttcatagtgtgagagaaagagacattactacccatctgacaaaggattgatcagaatataccaggatctcagacaactctataggaaaaatatctagtaatccgaataaaaagcaggcgatatttatttcttaaaataagactttcaaattgcaaacaggcatataaaatgtgctgtgtaacactgatcatcagaacaatgcaaaacaaaactacagtgaaatatcatctcatctgattttaaaatgatttcatccgaaagccagacagaaacaaatgctgggaaggatatggagaaatgagaacactcataacctgttggtgggcacttaagtttataaaaccactatggagaacagtttagagtttcctccaaacctaatagtagtgttgtcatataatccagcaatcctgctgctggcatgtactccctcccacaaaaaaaaaatgttgtttgcactaccatgtttgttatagcactgttcgtaatagccaaaatttgaaagcatcctaactgcccattaacagatgatggataaataaaatgtggtacatatagcatatggattaatattatgccataaagagaatgagattttttcatttgcaacaacgtggatgaaactggagttcattatattaattgaaataatcccagaaccgaaagacaaacttcacatattctcatatatttgtggaagttaaaaattaagacaactgaactcgtggagatagagagtgaaaggatggtcaccagaggctgggaaggtctatggtagatggggattattggggatgctcaatggatgaaaaaagtggttagaaataacaaataatacatagtatttgataacacaacagactaagtataatccttaataacataattatagattgtaaaataactaaaagtgtataaatggaatgttggtaactcaaagaattaatacttgaaaggatgtaggaaccattcatcataatgtgagtattatgcagttcatgctatatcaaagtcaggtaccccataaatatacacatataccatttacccacaaaaattcaaaattaaagtatttatgtatctcatcttctgtatctatattacattaaacctaagaagatactggtttcttcacactaccaagatccacatagacatccgtagcttctttctttgcctgtccataatctgacattgaaaaatgaggaaacctttcctatcatatgacattaatttacttagtgcacaatttcaaaatacacaaattgtgttagaattattaaactgacccttgttgaaaatatgtttatcgactagaataccgtgcttatatgcagcttatttatattttacaatcacaacatcaaattatttccaaagatacttgtttctgatattcatgcccccctttctgcagtgaaattagtacaaacctgtttatcattgttagatatttttatacagctttcattttattctgtgtttcatgaccagctaaatacttttgaagttgtatgcatttaggttaacactttgtctcaaaaaattatgagttttcacaaattatttatgccatgtgtttatcattgaacaccatgaaaatagtttcattgtgattaaaaagtgtgtgtttcacctaatccacacaccttttccccagattcctggaaaaccacaaaggtttactggatctatatttttgtctttggcaaaatagcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgtgagagacacagtgagggacatatgggtgagtctagacgcaaacttccctgcaggaagacaagaggggactttgtggtaaatggtgctcagaaccactaggggacactcagaaccactaggagacactcaggatagcagaaggtgctcaggatgccgcagggtgctcaaaacactaggggtgctcaagaccagcagggggcactcaggacaccaggagacacttaggacatcagggggcgctcaggacaccagggggcgctcagcacaagcaggggccacagaatgacaagggtgcattccagaccaccaggaaacactcaggaccaacaagagattctcagaaaccaccaggtgtaacaggaccacctaaaggcccacaagacaaccaggagacactcatggccactgaagaacattgaggacaccaggggttcagggccaacagggagtgctcggggccaccatggggctttcagtaaccacgagggaatcaatcactcaggacaccacggttttcttaggaggcagctccacatcaggtgcctggggaaggtgacgtttgcttttagacctagctgattcctgagctggtcaagcaaaagtcttcccacgatctctcactatttcttccttgtaacccatggtttctttcacatacaaatcattaacttaggataggaattcaattcaacttttaaccttgcatatttttagaataataatagcaatagtaattcaatgtgttttgataataagaaattgtgtatgcctaattcaaactctggttccacgcatgggtttttgtttcttgtgctgtgccagtcacactacagtcaatgcttttctaataataactcaacaatgtcacggtgttaagtttcctttcattttgtctgccatttgtggagatgaaacaccactttcacgggtcagttcctccactttggttgggttctggtcttctgctcttcacactgtttctccaccttcccttctgtcaaatccttttgtcttcctcagtctcctggcaaagaagcaacaaatctatttattttgtctcctccacgtctggtgaatctgttcacttctcttcatgatcattgaacccaaccatgtttagaaggataacagttcaccttacaatatgctcatgtaggtcaggtgcagtggctcactcctgtaatcccagcactttgggaggccaagacgggtggatcatctgaggtcgagtttgagatcagcgtggccaacatggcaaaaccctgtctctactaaaaatagaaaaattagccaggcatggtgtcgggcacctgtaatcccagctactcgggaggctgaggcaggagaatcacttgaacccagggtgagaggctgcagtgagctgagataatgccacttaactccagcctgggcgacagagagaaactccatctcaaaaaaaaaagcatatgttcatctatccgcagactctctgacatcgtcacccttttctagggtcctgcagacatcaccccacaacatccagtccttttcctaagtaccacagagtgggctctgcagctcctgctgctctctgtgtgctcagcgctgaggctcaccagtgctttgatgatgaagttcaaatccctaatgtgtttgcaattctcagacaaccctctagcaagctgccattgtgagtgcattctggggatcctgggctgatttcaggtccatattgctggatgttctctagcatccaggcgtgttggcaaataaacatctagaatttgtattgaaaatttgtggaaaatcaatggtagaaaacaatcctaatttctaaataagaacattttatcctgactttataaaaacacaatgttaatttaaccaataatgtaataaaatgtgtttaaagtgatgtttatcttgttattagatgtattaataattggtattttaaagtatactaacagcataaatgacaaacaaaccaacacagcgattatacataaataccattgtacattaattaatttggcaagaatggcatttattttcatttctaccaaaccttgcctttaaatatgtttgttaattggcattaggatagtgaaacaatcacacagagcaacaacattttggaatattacattatactataaaatagtacattcgattcaattatataattaaaataacattaaataaattcatgttttggtttgatatttggatatgtgttcatttttgtattttctttttttgtatcttttgtagagatggggtttcaccatgttggacaggctggtctcgacttcctgacctcaggtgatttatcgggggaacccacccccaatatttcaatgtagggtctttctattttctgtaagtgtcggctggtctgagaaataaagagaaagagtacaaagaaaggaatgttacagctgggccaccgggggtgacatcacatattgataggtccgtgatgccccctgagccgcaacaccagcaagtttttattagggattttaaaaggagagggggtgtacgaacagggagtaggtcacaaagatcacatgctttaaggggcaaaaagcagggcaaagatcacatattccttccccagggtattaattactaatattccttgctgggaaagaatttagtgatatcttccctacttgcacatcagtttataagctctctgcaagaagaaaaatatggctctattctgcccgaccccgcaggcagtcagaccttatggttatcttcccttgtttcctaaaatcgctgttgttctgttctttttcaaggtgcactgatttcatattgttcaaacacacatgttttacaatcagatttcatattgttcaaacacacatgttttacaatcaatttgtacagttaatgcaatcatcacagggtcctgaggtgacttacatcctcagcttacaaagataacaggattatgagattaaagaaattatgaaagtattgattttgggaactgataaatgtccatattaaaatgaaatcttcacaatttatgtttagagattccagtaaagacaggtgtaagaaattataaaagtattaattttgggaactgataaatgtccatattaaaatgcaatgcctagggccaacaaaggagtcatattaatatgaaaaataatagctgaatattttggaaatgacacatgcagtaacaaatgtctatatgaaattaagaagatattgacacaaaattgagaaaaaattaacataattatgctcactactggtttataaaatgcctataataacactttttaaatcatattatagaaaataaaataactatataaatagcactctctttgcttgattttagtatttggtgcttcaaatgttttttatacaaataaacattggtcattttttgatggtaatttcaatattttcttccagaatacatgttcataaatgtaattgaaattgtataattttcagaaacttattttatcagttgtgacttgtatttttatgatagactttttacatttatatacttttgattcagaataattatagataaaaaaattataaagttaatacagtgtgttcccatctccaagtatctcctaagatgaatatcctctatcatcataagacatggtgttaacacatttacattgataagtgtaaatatattcaataccagaccttattttatttatcatttttccaataatttctattgtaaatgaaaaataaaattctaagcttcctcaagcaactaaatgaactcaaccctcagccaagggaatttcaaagtaaattctaaaacttgttccagcaatgatgggaaagtgagaggtcagacatgcctcattacatgctcctctctttggaattaaggcaccagtggccagcattagtactacaacaaagatcttaagacgggcaaaactatatttttgctgtaaacactttctatagcaaaaagacatcaaattacaacttgattctagtatagcatcacatgacaaatagcaaaacctaatgatttattctgtatgaaatctgctacctggaggcttcatctacataataagaactatgatctccaggaccccttatcttaatccagacactcagttgtaatgattgtattaccttacatttcaaccaattgccaatcagaaaatctttgaattctcctatgtcctggaaccctgtgcataaactttcctgcctttctagactgcataaatggtatagctcacatgtgttgattaatatctgcctgtaacttctgacccactaaagtatataaaatcaagctgtaatcaagccattttggacatgtgttctcaggaattcctggggtcgtgtcatgggccttggtaactcatatatatctcagaatgagccattttaaatatttcatagtttgtcccttttagtggatatcttcttttcttttttttgggacagaatctctctttgctgttgctttcgtatatttgtttgtttccagattccatcaaggccatcagtttgaattcagttgtcttgttcctttattctcttctggtaaatgacagtttgtatttctgaagttttctagttgaatattttatagataaaaatttatcaagtaggttgatagtgccatttgggactcttatatctttacctatttaatcattgcttgttttctcaatcacaatgagtgttgatttctccatgttctatacatgttagtctattttctgttccaaatccatttattaggtcttttaaaatggattttggaaaagttgatcctattattttatgcaatatttcacttgagttgcaaaggtattctttttatgattattttgtctgaaattaacatagctattcaagttttctttggtttatattttcatggtctatatttttccatcttatttcttctctttgtgaatatgttaagaagttttcttggagaaagataattgctgggtcttttttttttttagtcaactatgaggaattattttttaatgatattacccttttgtccaataatggttgttttgtctttttacaataatatgtattgtttctattaatttattatttaattattattgatgaatatcttattggttaccataaggataacaataagacatttctataattgaattctaattcaaaaatgtagtacttctttctctttcttatttctttgagacggagtctcactctgtcgcccaggctggagtgcagtgggacaatctcagatcactgtaagctctgcctcctgggttctcgccattctcctgcctcagcctcccaagtagctgggactacaggcacctgccaccatgcccggataattttttgtatctttagtagagacaggctttcaccgtgttagccaggatggtctctatcttctgacttgtgatctgcctgacctggcctcccaaagtactgggattacaggcatgagccaccgtgcccagcctacccctttatatatagaacagagatattataactatatatgtctaattcctcttttctatcccttttttattttatcagtttgtaattacataagctataaaaatgtaatattgacatttttataattgctttacacatttatgtaataaagaaaacacaaatgcaaaaactaaatttaaacctcatttttttcattgttgacaatctttatcttttggatacattcaggtattggatgtatatcatatggctgctcatctagaaactctgctaaaacgtctatggcaagattaatatgctgggaatagattttctcaggatttgtttgtccgacagagtatttatttgtctttgatttatcatctcaagagacaatgtcaagaagatgctgtttctgcaaatgggcaatctgcaaaccaaggacacgtcactacattactgtgcaagagaagcacatgaggaaaggccggtgtgagacacaaacctccaggaacacctgggctaatgagctgcagggggcgctcaggacccactgatcagtcaaccacagaggggagtgcaaaggttaggactgctttcctgcaagcattgaaaaaagaagaaaaaaactccgtctgacagtttctccaaggaacttctgtaattttagaattctgtgcctaccaatgacatctccaaatatttttttaaaatattgtgtttggaggacatactctcacatggacaaaacacaaattgacacagagatgaaaagccctcaaccatagtcaccaaaattggagacatgtagaagctcactgggacctgttgagtcttctccaatcacactcagaacagagaccttagtgggtctcccttagagtagtcattaaggatggtgataacagcctaaagatggtagaccatggtcagtgtcatatagaatatggggaccctcacaagttttttgtctgacccttctcctgacactaaattatgcaaattaataacactgatctggtgcttcttttgattctaatttattttatttttagttgtcgttctcacttttcctttggattttcctgctccctggaaaaggtaaatgtggtctccgtgacctcaattcaagggctgaagccctttccctgtagctcagctggggctcaggctgtggctactgcagccatgtggaagaggctgaagggactttcttcactctccttgctcaggaccatccactgtattgtgtataggcttctctggaaatgcaagtggccatttgtagtgaaagaaatatgtttgtctggttaaaatgggaggtggatgtagagttaattggctgctacataaactgtccttctccaccagtgcttttaggatgagattgtgaaatttgtaagaatcaaaatggagtcacatatgttaaaaccctgacaaatggattcaggaagtgtagggagaattcttacacacatatccctgacaacaagaactatcataaaatagttcttgcaaaaagaccaacatgacctcataatcatgacttctgcaaagacttctactcagaatctacttgcccagccttagattaatgccatctgaattacactgatcatgttactatcactggtcctcaccacagatgcaacaccctcctgagtcctgaaacctgactccatcccatagagtagggcacagatgaggggaatgcaaatctccaccagctccaccctcctctgggttgaaaaagccgagcacaggtcccagctcagtgactcctgtgccccaccatggacacactttgctccacgctcctgctgctgaccatcccttcatgtgagtgctgtggtcagggactccttcacgggtgaaacatcagttttcttgtttgtgggcttcatcttcttatgctttctccacaggggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagaccacaaagacacagcccagggcacctcctgtacaaaaacccaggctgcttctcattggtgctccctccccacctctgcagaacaggaaagtgcagctgagatacgttttcctgccagggcctgcatttcccatccccattagactcagagccctgtcttcctccttcttctttaataataaatggcatgactcctgttaatagttcatagaagcagaagctgagtcctgtttgtcaaacattcagcatgaaatgttcatgttacctgggccagatgcatcactggtatgtggccgccagtttaatgggctcatactactccaagcggccgaatacaaaacagcagaacatatgcctttattaaactgcaggaaatgacactggagaaaaatgtggggataagggagcaggaggaattgtgaaaattcagataatagcttttctcgtagagagaaaggtgcgttaataaaataattttataaaacaataaaacagatggaatgtgtccccatcacggagtgtctcacagtaacagtgcagaaataaatttctaaaaatgtcgtagggtaggtgtgatagacaaggcttatttccacacagggagcccataaatacccatgtaattaaaaatccagctcttagaaagggagtgcctcaacttgacatcagaaacccacgtcagtgagtctgaggagcaatgtggaaaagaaatggaaaattcaacaatacctttcttatgaaaatcctagctcacgtttcaacatgaaacataactgtctacaattttaggaaaaccatcccatggcaacaagtcactacactcaaaaggtactgagctaacagagttccagcagtgagcaggtcagtgctgaaatccccggagaatcaaggctctcaggtacgttgtacaaaacccagaactgagccacacaatctatggtcaagtgatctttgacaaagtcaacaaaaatatgcacggggaagaggccacgctcttcatgccatgttgctgggacaattggactgccatatgcagaagaatgaaactggacaccaacctgtcgacatatacataaccataagaaaatggactgaaggcttgattataggacttcaaaatataaatgtactcgaagaaaacaccaggagaactcctctggacattgggcttagtaaataatttaccacaaaaacctcaaaagcacaagcaataacatcaaaaatagatgaatggaatttagttaaactaaagagcttccacacagcaacagagtgaacagacaaattgcagaatgctaaaaaatatttgcacacattgcatctggcaggggactgataggcagaatttacacggaactgaaacaaccccaccacaacaacagctatgaaaaaacaaataacctcattaaaaattggcaaaggacacgagtaggaatttttttaaagaacacatataactggacaagtgctaaacatcactgattatcagggatatgcaaattaaaactgcaaagaggtatcttacaccagtcagaatggctactataaaagaagcaaaaatagcagacatcggtggcgatcaaaggcaaagggaagtctcagtcattgttggtgaggatgtagatgagcacagcctctatggaaaacaatgtggagatttttcaaagaaataaaagcagaactacctttgattcaatgaccccaccattgggtaactacccaaaggaaaaataaatcatcatatcagaatgataaccaaacttttgttttcctgcagaactattcacagtagcatagatatcaacctaaggaattaacctgtgtcttacaacagataattttatttaaaaagtcacatatatatacaattaaatactatccagccatattaaggaatggaatcatgtattttgcagctacatggatggaactctgggtcattattttaagtctaataaacgagaagtagaacagcacacaccacactttttcacttataaatgggagctaagtaatatgtgcacaggcccatagagaaaggaatgatggacattgcagactcagaaacatgggagagcagaagttgggagaatggtgagaaattacttaaagggtatgatgtacattatttggatcatggatacattaaagccaagacgactatgcaatatatatatgtaacaaaattgcagtcactccccgtaaatgtatacgaataaaataaaaaaaaatacaattgaaatgtgaaattattaacagttgatcaacaatcctgaaaattaaaacgtgtgatgcaataaatgaaaataattttagttgaacttcatcaaattttaaaacattttctattcaaccgactatcaagaaactgaaggacaagcttcaggggagaaagtatttgcaaatcatacatctaacaatgtaattataataagaaccctcaaaactcaacagtaaaaagaagcaatctgtttataaaataggcaaaggtttgtgcaaactttctatcaaagaagatgtacagatgacacatcagcatatgaatgtaattttccagtagagaaattcaaatcaagaccaaaaggagacacgactttaggctttagaatgaggaaaaataaagaagaaatactgacagtaccagtgtcagtgagcatgccaggccccgagagactaaaatattgctagtgcaaaatgaaagagtttctgggagaactgtttacagtttcttataaaattaaacatgtccttaatccatgacctagaactctcatccctgagtatgtcctacaaaggattaaaatcatgtgttcacacacacacgtattcagatgtttaacattgtgtgtgtgtgtgtgtggtgtgtgtgtgtgtgtgttagaaactaaaaacaacatgaacatctttgaaaatttgacacaaaccattacaggtgaactccagactttcttctgagtgacagaaggcctgcctgaaagatccccagagacacagtcatggatttcactgtcaccctcacatgtcactggcttgggctgggctctctctggctcttccctgaccaggaccagatgttgagctccactacctgcagttggaagtttatattttcaacaatgcactgagggctaagttgctctacagactgaaccaaacaaacatgggcgcctttgaacaaacagtgcctgacatttgtactgaccccaggagaactcttcccgctctctttcttcttggttctctcctgcaggccagcagccctgcagtttagcctggacctctcatgcatctacccatctcctcccaagtgcattttaccacagcctccactgtttttgtaattctccacactctgttgtaaatgaagtcaggtccttcgagaccagattcgggactctattttatgaccaaatttcagcctcacccccactcctgagacagagctcctaaataagattctgcaggtggagattaagagcgtttttcttcctcaatgtaggagatgagtgctcagtggagggatggggaggagctttccactttaccagcatgcagatcctgctggggtggaccctctgccataggagcagggctgggaaccaggcagccaatgtcctcctccttggtgctgcactcagggcagagcctgcatccatgagtggggctgtgtggaagaagtgagtctctggttctcagtaagtcttgtctagaactgagcctcagcagcatgacctgtgggcaaggtcggagggccaatgtcctggcccctggggaagagtgtgctctgctgggagctgggcagaaggaatcctgtctacttggctgcagccatctgtggtggaatttacatcatgctgagctcgggcatagaaggaaggaagagaatctttgatcaaatatcaatatcatgtctgaccttactgaggttttgtagattatctcgaataaatgttccttcactttctgtatgttgacagggcctttccagacccgttaatttttcaaaattaatctcaccagtttcatggaggcatggatatatcgagctccttataccgtcatgtgagatgtggaactgtttccttcactggttataaaataatgggttgacttttttcccaacactttacagataccatcaattgtcctattgcttatatggttataaccaaagcaatgctgatattattcatttctattctattgcaaggtatgccccctctactcgtctccaattgctggcatgtatttccatttgtctgtatgttttagtaatttgaatatgattcacctaagagtgtttgtgtgtgtgtgggtatgtgtgtgtcgtgtgtgtgtgtgttaagggcttatcctgctatttggtgttctctgacctgcactgatccatgacttacaatttctctaatttggaggaaaaaatagagggaaagtgagtttgagtccagacacaaacctcactgaagtgagcacaggattctaaccccaggggtgctcaggacacgctgatcacaagagccagcctcaggggcaggtgcagatggaggctgagctcttctttcccgtcagcactgtggcttcttctccataaaacatcttcccttgaggaatttatctgaattcatgattttttgcttatctccaaagtctctgaaatgaaaatgtttgttttaataaaagaaaaatcttctcacatgtgtaaaagacagtttcctacagtcgcttaatcttgtctttaaatgtcaattatcaatgcttctgaagtaaatcagctaaatctataaaagacactttgtttaactcaacactgcagcccagcatgacagcactgaaagggccagcaagcagcaggcaggatacggtgcatgccagacactggggcggaaggagttagtatccagtgcaagagaagaaagtgcccgtggtggtcactgtcaggacccaagctcacagctccaattgcaggtgaccccatgcaaaggaagagataccctcaccaatgtttagtgtggatgtcgagtctgatggtgccacattcacacaccacgtgaatatggaaagatttaccaactccattattgaggcgtctgctgagggctgcacaggcctctcaataaagtccaaactggctcaatagagcaggaaagaagctgcctcagggtttttatgatggtttggtgttgaaggaatggtggggcttcctactaaggggaaggagcttgtataatttgaacctaatactggcatccagtgaggacacttccatgattttctactaaatttcccatgtgtgggggacaaaagtgaaggaaaaggattaatcctgtcatcagtaatgaggcatcaaaatagagtctgatgacttattctacttagcaacttaagcaaatgagtgaaaaatgaggtaagtgttcactctgggtggacagcaaataggtctgcagaaaatagagtttttttaagtgtaagcacataacaaaaagaaagagaagaacaaattgaacagggatcttggaccaatgtcctgggtggaagctcttcactctgtgagatcatcagcttgctctgagggtctcgggtcaagtccttcttcaatatatctcaggccttacaggatacatgggaatgctcagcttggtgtccttcactagggaaaagaaagagaaatcagactgtcactgtgtctatatagaaagggaagacataagagactccattttgaaaaagacctgtactttaaacaattgctttgctgagatgttgttaatttgtagctttgccccagccattttgacccagccactttgagccaacctggagctcacaaaaacatgtgttgtataaaatcaaggtttaagggatctagggctgtgcaggacgtgccttgttaacaaaatgtttacaagcagtatacttgataaaggtcatccgcattgtctactctcaataaaccaggggcacagtgcactgtggaaagccgcagggacctctgcccttgaaggcggggtattgtccaaggtttctccccatgtgatagtctgagatatggcctcgtgggatgagaaagacctgaccgtcccccagcctgactcccgtaaagggtctgtgctgaggagggttagtaaaagaggaaagcctcttgcagttgagatagaggaaggccactgtctcctgcctgcccctgggaactgaatgtcttggtataaaacccgattgtacatttgttcaattttgagataggagaaaaaccaccttatggtgggaggcgagacatatttgcagtaatgctgccttgttattctttatgccgctgagatgtttgggcggagagaaacataaatctggcctacgtgcatgtccaggcatagtaccttcccttgaacttaattacgacatagattcttttgctcacatgttttttgctgaccttctccttattatcaccctggtctcctactacattcctttttgctgaaataatgaaaataataatcaataaaaactgagggaactcagagaccagtgctggtgcaggtccttggtatgctgagtgccggttccctgggcccactgttgtttctctatactttgtttctgtgtcttatttcttttctcagtctctcatcccacctgacgaggaatacccacaggtgtggaggggcaggtctccccttcgtacttgagcagccttacaactgggtgggtttatgaattaattcctcggttgcattacatgaaaaatcacacaatctacaaattttaaaaaataagcctttactttttataaaagattacagccatttcacaggctgggaagcacagccattggtgaagacgagagacaggcactcccaaggaggagcggtggggcagaaactttatgctgaacgtgttggctaaacagacataatcaacggattacaggaggggctatgcgtgttcataaaggtggtcatgacacatgaatatgggagcaaacatacacgtcacatgtgacccacttagcagtggggacttagcatttaaatgtgttacagttaggccctaagtgccaaaagctggagcaggggcacaaagaccctcagagcgcagcctccataaatggccagaaccaggccatggtcagtggtctctgatcaggagaaaattcctgaaatcaatctggtgtcccatccaagctggggttatggctgtggaatggggggtcagttagtcaggggatgagctgcagttggttaaatcgtgcttatctcaggatcagtgcttattttgctgctacagaagaaaataacagtttattctttaagagttggggtgagggatgtaacccctgcctggcatggccttaggtcttgtttataacggggcatcttattgccccggagaatctgttctgtcagtcttatgatctccattttaatgttagtgttggtccatgttgtctctgaaccacaaaagggagtgggtataatgaggtgtgtctgatctcttgttctgcccagctgggaactcagtttttaggtgtttttggtgcctccttggccaagagggggaaccactcaatctcatggggtgactgaaattttacttttagtttaaagtttataaatatggacctaagtattgacattctaaaagtcactcctttgttttggctaaaagtacttggcaagagtccttgaaatgaggttcaagagcagtattttctcatgactttatttgcaatagacacatgagagactgttgaaaagatgaagtaccaaagtagccttaatctgttggtgaatggagttggtataatacagaaatcactttcaatattttgtaacacatgcatgcatgcaataagacagcggtgagcactgagtgtaaagtctctaaaggtacgatctttcagccaccaaataatagtgtaataacggacatactctggaggagctgactataataccgtaacaccacggggagaaactttggccaaggaagtccaagattttcttttccttttcctttttttttttttttttttttttttttgttgttgttgtttgagacagagtctcactctgttgcccaggctagagtgcggtggtgcgatctcgactcactgtgacctctgtctccctgattcaagcgattcctgcctcggcctcccaaaagctgatattacaggcatgtgccaccacacccagctaagtttttcatatttttagtagagacggggttttgccatgctggccaggatgatctcgcactcctgacctcaagtggtcctcctgccttggcctcccgaagtgctggtattacagcgtgagccaccacacccagccgagattttcttaaagttttgaaaattttaatttaagggttacaattttttcaacatttccagaaagctgtagacagtattattctgtgttatatgagtgattgtagttccttccatttttagatagtattacaaacaattttagggctgcttgctttaaatagatagatgatagatggctacatacatacatacatacgtacctcgatagagatatagttgcaaacataaatacatagatagatagagttacagatgtattttagttattatgctacttttttctttgccttttcttcctatgttatgttagtcaggtctccaggacttaggagtgcatttacaatcccttcccttgtccattttgacgtgttctagacaatgcgagaatcctttgtgtgtggatcacttccaagtcatgcactacccttgcaataaatgtgtttgtgtatgtctttgccttactgacaagctctgctgagtgcagttatttctgccgtctgagctaactttacacttggtagagaaatatattctagatggaggcttccactattaatttaaattactaattcataacctccagcttaattattgaggtataatctatcagagatggtattagaacaaaggtttccaatgaaatctaacagaagggatgtcaaaaaattttcctaacttaggtaaaataaccctgagcccattcttagtatccagccatgtctcctatctatcacactgaatcccacactaactttgacctgacttgggacttgtaagcttcaaatatgaccttttgattgcaatgcctctaattcaggacgtgtggttattttagccaagagtaaagaaaaccaaatttaactcgctaaaaatgacaaagattaaaacctaatgaaatggaaactgggatatgagtggctccagacttggctattttaagagtctatgtgcccaggtgatttcttttctccattttacacacaggcaaacccaaaacgtcagcttcatctcccgttgactctcatcatctcgttcttcatcagcttgcttagaatgttgacttccagctgcatccatgttgccacaaaagacatgattttattctttttctgtgaatgcatagtgttccattgtatacatgtaccatattttcttgatcaaattcaccatgaatggacacataggttggatttatgtcttaggtattaagagtagcatagcaatgaacatgtaagtgggtgtattttttggtagactgatttattttcttttgtgcatatacccacatatgagatggccgggccaagtggcagctctgcttcaaatacttttcaaatctccagactgctttccacagtgcttggactaattcacattccacccaacactgtacaagtgtttcctgttctccgcagcctctctccagactgctttccaagattcctctcctccactttgacactttggtatatccatgtgtgtcctctctggttcagccagggacagagaaccaggaagacatcatgcattttctagagggagctggcttggggaatcaacgaccggagtagaaagtgcctttgtccatgcatcacaggcctgagggccctgggcaggaggtcaggaagagaggatgaccagacagctggggaaaccgggatgaataaagccagtttccttcctggtgaggaggggcaggtcgaagcctcgtgtccctgtagggatgaagcacactcacctgccactgctacctgccaatcaggtgacctgcagagcagcagctcctgagtcactgatggtgacttcctcctcctccaaaccctctaggatctgtgcttctcagagtgggaaccccagcaggtccccaagttttcaatggattcacctagctagtgtctctcctcagccccatccccaggctcctgccctggtgctgtgtacagtgtcacaacaggggtgacagtaacagctggtgcctgcactttccaggccaagaagtttgaaagaagcaagtcacagggccagccgggatatggggtaatcacacaaatttccttcttggaggaagtgctgggaaacatccttgagtcctcctcagctcacgtgcagctgctgctgttcatcccagtgcgggggacacatgagccctccccatgcccaggatggagctgtttcaatcacagcaggatgggaatgtgtcttctctatgggggcttttgaagcacagctctcctgttcctgagatttgagatttataaagacaagtcccacagagtggacctgcacaaataagacagtacaggatccccaggagagacatcccataagagaagggacaggcgggtcccatcacagacactcatcctcagaaaccctgaccggctactcaccttcacaggtccccagttcctgatcagtgcctgtgtctgctcctgagaagagatgaaaactcaagacaaatacttctcatgatcataggcttaaaaattctcaacgtaggaaatcaaatccagtagtttatcaaaaagttaacacactgcaatcaagtaggctacattctgcaaaagcaaggctgctttaactgctttccacagtgcttggactaattcacattccatccagcactgtacaagtgctttaacctatgcaaagcaataaatgtgatgctctactaaacagaatcaaaagcaaaaaccatgtgagtattccagcagatgcaggaaaaaagctttcaatagaatctaacaacgcttcatgataaaaaccctcaaaattatagacattgaaggagcacacctcaatctgatgagccgtctatgacaaacccatggccaacatcatactgaatgggcaaacactggaagcattttccttaagaacagaaacaagaaaaggatgcccgctctcaccacttctattcagcctagtactggaagtattcaccagatcaggcaagagaaagaaataaaaggcatccaaataaaagaaaaagaagaatgcaaaccctctgttttcactgataatatgattctatatgtagaaaatattgaaggctctgccaaaagtctcctagtattgatacattcgtttaggaatgtttcaggatataaaatcaatgtacgaaaatcacagtaacatttctagtcaccaacaacgttctggctgagagtggaatcaagaacatgctctcccaatagccaccaagacagtggaatacctaggaatagagttaagccaatgagatgaaatatctctaccagaaaaacagcaaaacacatgtgaaaaaaatcagagataaaacaaataaatggaaaaataaacattccatgcttatgaatttaaacaataaatatatgaaaaagttttaaaatttgtgattaattctacgtagcaatgccatttttttcaacatttacagaatattgttgctggtaatagcagtttagcatttgagtaatggaaacaccttacagaatcactttataacagttgcttcctgtagtgggttgcttcagttacctgatgaaaacatctgcatgtcacaggttgaaaacataaaatatgtctatcaactgagaaggttgtaggcttttgtcaaggaattacttcaagtcattcagaaaaacagcagacagtaaacgaaacttgttcaaattccatggagagtcaaagctgaagaaaatccaactagaagtgtccaaaggcccccaaggctcagttcctcggcaagtcccaccttctcaggttttccagaattttgtttttaactgatttacactgagtgaagtagattaccaggagttttccattattttaacataaaatcgggggctaagtgttgttattttataaagacatctttgaatctctcaggaaatttacctcctgagggttcagataagatcctactctaggttaagattacatgtttggcgcaatgaactggtacaaatcttactttagctttcatgttatctatttttccgcactgacttccacctttttattagtcaagtatatgggatggaagagtgcttctaagaggtccttaacttgcccatttcaatggattttcaagaagacatgagaaaccactttgtttgcaaagcatcccaaagccatgtcctgctccagaaacgtgatctcatttcctggtcgtttcttaactgacacgctctaatcagtgcatctgggccaatttgaaatgaggtgaagaaatgtgtcctaaagtaaagctaacattgtaataggaattcgtgtttaaaaacatttagttttattattgggcaggatccatcaacatataacagttgaagtttctcaacaggagtttaataaatataaggaatgtacagaagtgtttcctaatttaaataaaatgtagtgattacctaggctgtgagtgcaatcttggtaatcttctatgtccatgcccatcactctgtgcaccgcaaactaattttgacctcagcagaaacgggattaattttcaaattagtaatttttttccaatttaatttatttagatgattatgaatgactattttagcagaaagagaatcaaggaaacttgaactaaataaccagaatttaaaatgacaaacaattcaacaagatgccaggatgtgagtggctccaggcccaattaattcaaaactttatgtgcccaggttctgtattttcccaaaattacacatctccattccagcttcatgccacagttgactcccaccgtgtaagacatggcgacaccattcccaaaggtcgtgtgcaattctgaaaatggaataagcaaggagaggagatgatagtttatattctcctctgaggaggaagaattgcctcaacagaccacttctcctgcatctgtgactagaactatgtcacaggcacacatggagcaaaatccctcaaggggataatacggtaacattaatcagggtgatcatttttaatactataaaattcatagatgacactgcattccagcctgagggacagagcaagaccctgtctctaagaaaaaaagaacaaatcaatagatactgataccaacattttagataatgaaattttcataatgtaattttaaatacactcacatcattacataaatcttcccagaaatattcctagtcatgttgagtttcatcaacttttccagtgttcaaatctagaaatccaatagactcttgaggataaatcaaaatgagggcagtgaaactggtatctgctcagcacctgttaactcaggaggactcaatacacccttgcacactgctgcttctctgaatggctcacaaggactccagctcactctccatcctcctcaaacatctggcccccacttgccctaagttgactctctgctcttagtctgtgctctgaagtcttcccagaggtgaaagtgagctgtcagatggaacttccctctcacctcagcgtggaatttactgctacatttaactatcactctttccataatggttgatttcttggtctgttcattacagatcaaaggcatctgatttgaatctttatttctttgcatttgtctccatgacaattttgggaggttttaccgccagcactatgacacgatgtagtaacatgacacatttgtggttaacaacacctacaaattcagaagctcttcggttgtcttcccagcaaatatagctgcttcttttctgtgtatgaacacatcctggaaacacgtacacacccacatagatatatacatgcctatgacattttcttctctgtaagtgaaaattaacctcaatttcatacgaagttcatcatttccctgaaggtgaaggtaggtcgtttttcatctgttctaacaaatgctcagacaccagctagtaagtgaggagctaccctgcttctggatgttggatctgtctcttcccctttgctttaccacagaagattggccacttgtccaggtcccaagaagagagtccaggtttgtcctgataatatgactcatccaacttctgataactctactgttacacacattcatggaggtagcctattaattacataattcactaaacaaataccaaatacccacattgcaataccccatacccaagggtatgttcatgcattcagtgaaggaaaaggcttttcagagacagatagatcaggctagattggtcaatatatgggtgaaaacactggacttgaatgtatctgttttcccccatgtcacatgtgagacctgtcagacaggaccagggttccttgtgcactcagaggtgagggctcacagaattcctctctggtttccaggaaaggtaactgcagtaatcttggtaatgagaatatcctccagtgctgacctattatagagtttacatatgaaattttcactgcaattcacaatctactctttcacacagaagtgtacagaggtcaggacacatcctcagggtcacacattgagaatgatgaagatatgtcccacgagtttttcctaaggtctcagaaagaattccaggactcaaaaggtctcagagggcagctcccagtgccttagttaaaatggtggctcaggcctgtaatcccagcattttgggaggccaaggcaggtggatcacctgaggtcgggacattgagactagcttggccaacatggtgaaaccttatctctactaaaaatataaaaattagacggggggggttgtgcatgcctgtactcccagctactcgggaggctgaggcaggagaatcacttgaacccaggaggcggaggttgcggtgagccgagatcaggacactgcactctagcctgggcaaaggagcaaaagttcatctaaaaaatttattttaatttaaaaatttttaaaaaatggcccactccctagaacagagagattccctctaaacatgatggaggtcccgaactatacattaagtgaatcctggtgtgtctgaactcacatgattattacgttaagctgctgttccaatctacttcctcacctgggaaaagaggagccagggcatggctagttgaggccccaggaagagaactgagttctcaaagggcaaagcaagcatcctcatcccagggtgagcctaaaagactggggcctccctcatcccttttcacctctttatacaaaggcaccacctacatgcaaatcctcactcaggcacccacaggaaaccaccacacatttccttaaattcagggtccagctcacatgggaaatactttctgagactcatggacctcctgcacaagaacatgaaacacctgtggttcttcctcctgctggtggcagctcccagatgtgagtgtctcaaggctgcagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagacacagtgaggggaggtgagtgtgagcccagacacaaacctccctgcagggaggcggaggggaccggcgcaggtgctgctcaagaccagcagggggcgcgcggggcccacagagcaagaggccgggtcaggagcaggtgcagggagggcggggcttcctcatcagctcagtgctctccctcctcgccaggacctcagctgtccccaggcctcctctttctttattatctgtggttctgcttcctcacatcctcgctgcaggcaagaaagaagggagaaatttctctgtttaccattaaggttttaacagtcactggcacctttttttcaacaaattcccacaaggcccattttaccttcttgacaaagtatttcaaggcttctcaccatctcttgattggcgtcatcggctgcatcgtgtcctgctcttaaattcatgtgatgaaaccccaatcccagtggctctgtatttggagagagggattttaagaaggcaaataagttaactgtggccataaatgtgggaccctaatccactaggactcttgtccttatgggaagtggaagacatcagaggcctctctctccacatgcacacagaggagaggccatgtggggacgcgctgcatgagaaggtggccctttgcaagcctggaagtggcctctcaaaaaactaaccctttcttcacccagatcttggacgtcaaggctccagaacaataagaaaattaatatttgttatttgaaacaacctagtctgtggtatcttctgatggaaagccaagcagattcacagatacaattgtgttagctccgtctcctggagggagaagcagcccaccgaggctgacacatctctcagattatttttataaagaaaaatagatccaagatgaaaaccccaccacatttctgctgagtcattcacttagcaggcttctctgagatcagccctggggggctgtgttctaggtcatgtctctcactttccactatgagaatccatgtagatcatgagaaccagccagatggagtcctgatcccggcccaccttctgctgctccccaagtatcccaaagaaaaccactccagcgtcacccctgtgtcttctactctctaaaatcccactaaagctgaccttaaaccaggagatatttggggccgggctcttgttctcttcttcttagtcttccataaggtccaggtgctgagtaaagcctcagtaaagattgagcttcagttcccctaacccacatcattcccttacatccttgtcatgcatctgtcctctgtgggcactcagggcaggttacacaggaattgcctgaagctggcctcaactgatgtgctgagaccacgggtcatgcacatgtatgattccgggtcatgcacatgtatgattccaggtcatgcaggctctactgcaggacagacctgtgtcctgtggggcacagacagctgctgaccccgggtctcctctaataactcacacacctggtgtttgtgtgtgtccagatggccccatgagcacagcacactagggtggccaaccttacaggtggggccgtcagatggaatggacaggctggtcactcccatcatcagtgatttcccagtgaattttaaataaattaaacaaaattaacaacaaaggggaaggatatgtacctgtctctgggaggtatacagggtcccagaactgtgctgggagtgggtgtgaaacgcccttttgtgtggaaagccctccagcatgagtgaaagctgaaggaatgatcactgtgcaggtggaggatgataggcagctggcagggtacatttcctgaagctgttcctgggtgcatgatggttggatggcccatggtgttgagggctggactcacataggaacaaggaaattatcccatgggaatggcagaaaagaaaatggagatggacacccctggagacagcttattagatttggtggaggaaaaatagaaatttattccaatgaccccagcattttcagctaaataagagttgcattaatagacagaattatgaaaggaagggagaaggagtttatggagggaaaaaaaaagaagataaattaaaatttaaaactatgcaaatctatcaattggcagataacagagtggagctgatgcagctacttccttgttctggaaacctgccagagacacttagcattcctgtaaggccagtctagtggtgatgaacttgtccactttttacttttttggggaacttctcaaacctcctgcattattgaagaaaagctttaatccatgtaacgtatttatttggaagtttcttggctttgtttttattttcagcaacttgaacagaatcatgcacatcatgatatttcggtgaacaacaggccacctacaggacaaaggtctcattagattataatactgtattttcaccgcatttttccatgcttagatatgttcatctgtataaacatctaccatggtgattcagctgcccacagtattcactacacttacatgacatacagatttgttacctaggagcactatgctatcccacgcagcctgggtgtagcaaggtatttcatgtaggtttgtgtaaacacactctatgatccttgcacaatgacaaattgcctaaggacacattgttcagatgtattcctactgtttttcatttttttttagatggagtctcactctgtcacccaggctggagtgcagtggcacaatcttggctcactgcaacctccgcctcccaggctcaagcgattctcctgcctcagccttccgagtagctgggattacaggcatgaaccaccacgcccagctaattctttttttctattttttagtagagatgggatttcaccatgttgccctggctggtcttgagctcgtgacctacatgatccacccactttgccctcccaaagtgctgggattacaagcgtgagccactgcgcctggccaatgtatccctactgttaagccacaaatcatcgtatctcatttctctcccttttttgtccctgttaatattttcatgttgtgcgtgcattcttctcctagctcagtgaacatatttataaggtttactttgaattttctgctaggtaatcaatgtatctccttttaatttgtgtcagtttctagtgctttttttgttaaataatttggaccacttttttctgttttgtgattattgttattattattattttttactttctctgttgctttctcctcattagaagaaaaagctaccgtaatcactcttcacagaatatgcccagggaaaatgccatcacctatcaacccaggctgtcattgtggcatctcttaaaacttcataatggttgaaattttttgttgttgttgttattagtggcactcagacctacagaggattttaagttttgctcctactctaaattaggtggcattgaaattcatcctgcaggcagtctctgataaagtggaggaattgggcagttttgttatgcatatggttcataaaaataatatgagtttaaggttttctcagccaagtgctatatcctgatattttataatcacttctttgaatctctcttgggtttatcttttgaaaatttagatcagaatataaaccaggtttgaggctttttgtttggtgtaaacatctcctataggtcattgcgtgaaaaggcacagagtctatctgaggaggagaactcagggaagcctcacaacaacaggggagacaaaaccgaggtcactaaaaaaatatgaagcttctggctcctgcagcctccagacatgccccacaccctctcattgcacagaaatgaattcctttctctttcctgagtgatctttgccaagattcctctcctccactttgacactttggtatatccatgtgtgtccattctggttcagccagggacacagaaccaggaagacatcgtggcttttctagagggagctggcttggggaatcaatggttggagtagaaagtgtctttgtccatgtgtcacagccctgagggacacgggaagaaggtcaggaagacaggatgaccagacggctggagcaaccagtatgaacaaagccactttctttcctggtgaagaggggcatttggaagcctggtgtccctgtaggggatgaaccacactcacctgcccactgttacttgccaacgaggtgacccgcagagcagcagatcctgagtcaccgacagtggctgcttcctcctccaaaccctccaagatctgtccttccaggagtgtgaacctcagcagatccgcacgttttcaatgggtccacttagctagtgtctgtcctcagccccatccctgggatcctgtcctggtgctgtgtacactgtcacaatagtggtgacagtgacagctggtgcctgcactttccaggccaagaagtttgaaagaagcaagtcacagggccagcctggatttggggcaaacacacaaatttcactctgtggggaagtgctgggaagcagccttgagtcctcctcagctcacgtgtggctgctgctgctcatcccaggtgggacacatgagccctccccatgcccaggatggagctgtttcagtcacagcaggatgggaatgtgtcttctctatgggggcttttgaagcacagctctcctgttcctgagatttgagatttataaagacaagtcccacagagtgaacctgcacaaataagacagtgcaggatccccaggagagacatcccatatgagaagggacaggcaggtcccatcactgacgctggtcctcagaaaccctgaccagctactgaccttcccaggtcccctgttcctggaacagttcgtgtgtctgctcctgaaaagatgcccatcaagagtccccagggttctgcccccttccttgatgtgcctctgggagtggggctggctgggctgtgggtctggcgtgaccctctccacaggtcagcggctcagtgcaggctgcaccgactcggtggggctgggctgtggctgaccctcccagggggagcctggactcttcttaggggtatctgcaggatcccaggttctgggagaacagggaagccacagtgtgtgcagggccccatctccagtaaagtgtttgctgtcgctctgttgacaagggcatatccccaggcctaggggcactgtgggcgcacgaccaatgcgcgagacacagggagtaaggcacagttccctcccattactgtgaggacactagacacagtgtgtgtgtgtgtgtgtgtgtgtgtgtgtgtgtgtgtgtgtgtgtgtccattactgtggggactctaaccaccgtgtgtgtgtgtgtgtgtgtgtgtgtgtgtgtgtgtgtattaggagttttgcagtggcctctgagacccatgatcttgcaggtttagaaattatctgatgagatgttcatccacaggaaccgacaagagattaggtgttctcccaaagcccctggaagctcctggactcactgtgagtgtggactgatccagtgcttccagagctccacagaaggggctccctggtggtttcatagaatccttgcttggggtgtttctgcagagttcactggctttcctacgaccaatttaccattgcaagcgatggcgtcagcagcacatggtgtcacgtgtcactaaaggagcattctgagccaggacacagccacttcatactggggggaaaatgctctgggagcccagacaggagcctctctgcagtgcaagggctgggctgcagggggcgctcaaggcccacccagcacaggctccagccccagagcaggtgcacaggaggctgcggatggagtccccttaagatctgtgtcattcttctaaaaaaatctaaaataagtatttgacaaaaactgctgaagagtccataaatatcctattcaactgcaagaatttatcaatttacactggagatttctaaccctgctacatatcttaatagtaagcatctggaggtcaattaagcttttattttatataaataagtgcaacttttggagaaacacactcatcccccaaataacacattcatgtattaaagcctagaaatattttaaattacctctgagctattcaagtgtgggttcccagtgaagtcctgttctagggaaaattgttctccagtgggagaagctctgtcaacatacagtttagggatatggcagggcacacatggcctctaaggggattatagcttgaacccttagcatcctcctgttgggtaatccatgtgtcatctctccactctttctcatgctgtgttaggtatgaaatagcatcgctcatgaatatgcaaataactgagatgactatagatatctttgtgccctgagagcatcacccaacaaccacatccctcctcagaagcccccagagcacaactcctcaccatggactggacctggaggatcctctttttggtggcagcagccacaggtaaggggctgccaaatcccagtgaggaggaagggatcgaagccagtcaagggggcttccatccactcctgtgtcttctctacaggtgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagacacagtgtgaaaacccacatcctgagagtgtcagaaaccccaggggggaagcagctgtgctggcatggaggaaatgacaaagattattagattgaagactttctcagaaaatgatattaagtcattaaggaaaaggaacaatataaacgtgtatttgagaaattttaattatttgagagatttttcatacaatatttattctgcaagcaaatttcagggattgaattaataaaactgatacagaacttcctctgtaggtatctgtgtaaacatcaatttctgaatcagtgttgtaaatattttggaacacacacacaaatcacattttatctctacttttatctctatttttaaaaatgccaaaaaaactcattttgtgcatgtagcattttgaattcccaccatcaatgcatgatagttcttggttttccacattcatattgccatttatcattatgagaattgtgtgttttaaccattctaataggtgagtaatggtatctaatttttagttaaatgcacatttccctaataaaaattcacatttaacaattttcatataatttttgccaagatgcctcttctcatatttggttcatttttaactgcattgttttcttttgattagttgtaagtttacttgcatattgattataaaatcatttaacaaattaaaagaattcatttaacaaatatgtgacttggaagtattttctccaagtctgcggctgtcttttactcccttatcagtatgtattgcagaaaagtgtgtgtgtgtgtgtgtgtgtgtgtttatacaaatttagatttaaaaaatgtaaaatgttattcatccacagatcatgtctttggtattatatctgaaatctcattataaaatacagtaatagcaattactttttccacgtctctaatctcaggctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagactaccacatatgttcttacatttactctttcctcagaaaacagacatttcctcatgtggactcttgtctcagacaagcaaacatgtctccatgtgaactcttcactcacataagtacacatatgtccacattgactgtttccttacacaagtacatatatccaatgtcgaattgttctgtggcaaaatgatctcaagataatgataatcataaaccccctccctgacaaggcatagatctgtatttttttcattgcaacctaactttgccttattgtcaagaacagtagtttgcagctctaaatataccaattagagacaggtgtccattttctctggaaacgtatttttatgttcttactggacatatttgttgataatgtttgctattatgaagataccccaacagtgtccacattagagaataaaaaatagtaatgggcagattaactctgtgcatccagacccagaaatcctttgaccttgacttccctgaaatgtagacacagaggatggatgagcaatgctgagcagtgcacccatgaccacaaaaagaaagacgtggaaatgtgtcccctccacttctcatgaaaggcagctcatcccctgttccctcaggccctggcgaggagccaccccatgtctgtgcccttcctcagtgtccacaccgtggggtctgcattgatctggattctcttctcatccccgtcaatattagtgtccttcgtaaatcaggtccagctgtggcttctcctcacggggctgttctcagtctgtttgctgtgttcacggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtgacacagtgagggaaaccctgtgtgagcccagacacaaagctcaccgcagggagacaggaggggactatgtggtagatgctgctcagaaccaccagggggcatcaggaccatcagggagggtgcacagaaccaccaggaggggctcaggacaccagggggcgctcagaaccaccagggggccctcaggacaccagagggtgctcagaaccaccaggaggcgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcgctcaggacactagggggcgctcagaaccaccaggaggcactcaggaccatcagggagggtgcacagaaccaccaggaggtgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggatgtgaccaagacaccaaggggcactcagaactgccagggggtgctcaggacaccagaggattctcagaaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactagtaggcactgaggaaccaccagggggcgctcaggacactagtaggcactgaggaaccaccagggggggctcaggacactagtaggcactgaggaaccaccagggggcgctcaggacactagtaggcactgaggaaccaccagggggggctcaggacaccagaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatatttaaaaagtaaatactggctgggcgcagtggctcacgcctgtaatctcagcactttgggagggtgaggtgggtggatcacctgaggtcgggaattcgagaccagcctgaccaacatggagaaaccccctctctactaaaaatacaaaattagctgggcgtggcggggaagctgaggcaggagaatcgcttgaacctgggaggcggaggttgcggtgagccgagaacacgccattgcactccagcctgggcgacaagaccaaaactctgtctcaaaaaaaaaaaaaagtaaataccattgtacacttaagtaatatatttggcaagaatggcatttacattcattcaaaaatgaaactgcaaatacgagttacattcaattaaataattaaaataatatagaaaaaaatgggtgtgttgttttggtgtttaatatacattcatttttgcatggacgggtatatgtgtcattgctgggctgttgtgtatgtgtgcgtgtgtgtgtgtgtctgtgtgtacaactatgaagtttaaaatatattattaaattacgtagttatattaatccaaatttatcatgttaaaatattaggaaaaaaacaccagtagagaaattacagagaacatcagcaatgcctacagcatttacaagagtcacattaataacaaacaaactagttcaaatgtttagatatgacacatgcagtagaaaacgttcacatggtattaacacaaaaatggtgcacaactgaggaaattataatacgttcatgatattggctacataaatgcttatgatagtaatgcttttcatccatcaaatgcttatgataatgcttttcatccatcatattatagatgataaaacaactctataaacacttccatcactagcgtttaatatgagatgcctcacatctttttctgaaataaataaacatctgtccaccacttcgatgatcatttcaggattatcctctgaaataattatccataataattttagtaacaatattattttcagaagcctattttataaggtctttgaactattatttttatgattgttactttatattttacacactttttatttggaataattataggttatcagaacaattgtaaggaaaatacagtgtgttcacatccatctccaagttttcactaaagttaatatgtcaaaaaaaacatgggacatgggactaatatatttacattgataagtttctgtttattcagctctgggatttatttgaattttgccaatttttaacagtttccttttttcctttttcttttctttttgagataaggtgtcactttcctattgctttttgtttgtttctttgttcaacccacgtaaccacatcaaattcagtcaccatgttcctctcatatcttctggttaatcacagtttgggttcctgctgtcttcccattgaatattctataaatgaaactagtcaaataagttgattctggtcacttatatatttacctattttatcacgtttgttttgtcaatcacagtaagtgtcgaattcgctatctgttatagatgttagcctattttctatcccagatccattggttaaatctttggtgatgccttttagaaaactgatccctttaccctatgtaatatgccccttgattcctgaaagtcttatgtctaccttgtctgaatttaacatagctaagcacgctttcttttcgttcatattttcatggtccatgttttcctgtatttaacttttctatgtagagcaaatttctgtacagagctagtagttgggtcttgctttttaaatcaactataataattctattttaaaactggtattactatttttctgttaatttctgttttaatttggcattttatgatcatgtttatttctctattaacttattgtttagttcatcttttatgaatattgtattggccctaagatatacaataagaattgtgtataatcagattctaattcaaataacgtaaaacctcttcataggttgtagagctattataacttattcttctaaacactctttctcatccgttgtcttagtttattctcagtttgcacttatatgtgctataaaatataatatgtgcatttttatcattacatagacatatattagaacaattaaaaatataaaaactacatttcaacttcattttttcattcttgaccacatgttttatttggatagattcatgtttcggatgtatatcatatggctactcaccctggcagaaaatttgccaaagcacctactgaaggatgaatgcactagcaataaattttctcagaatcgatttgtcttacagggtattcatttgactttcgctttaaatgaaatttttaatatatatagaattccagtttgactttaatttgtaatttattttcttgtactcatgtattcattattttcttcctgaagatggtcacacattccattctgctgggccttcattatagatatttgtgtgtatctattcagggctatatttgcaatttatggatgccacaattatcagagttgaagtcagcttctgctgtccacagagatttcaagttcctcccatgatacttgcttttgtgtccctgtttgatcctgggtctttatatttagttttccccagggaggctgtctgtttcagctgtggaaagtgcaccctactgacagtttaaattgatgactgtgtggtgaaggaggttggacaaagcgggacttcctccaaccttctgactgagtctccttcttatgcaggagtagtaagcatagttctggggagtggccttccacattgtcctgtccttaactctttccccagggctggaacgtcttttcccagacacaactgtttttcaccagtgtccccagctttttacccactatccttaccctaaagagtaaggatttctttcctgaggaaggagatgggaggtgtttctggatcaagtttccttggtgtcgtctgtttccttttgtttctgttgacttcaccacagctcatatgacacatgctttggtggatttcccctggaggtagtggaggtgcattcaggcattccacaggagctgctgttcttttccccagtcaacaccacaagacaccagatgaggaagttgtccgtggatttttcaagttctctaggaaaagcttgcaagcactaggccaatctaacaccattagtacatgcatactaaaaaaaaaaaagtcattaagtatttctaggttagtctgtttctatctcaaatgccatccagtggcacctgccctacgtacactagcaggtaggtcctggttctctctgcaggctcctatcttctcagatttcagttttcttgtttgcttggtgaaatcaactcagatatgttgaatgttttttctctcttttatttgtagctgttcagcttcgttgttaatgaggtcagaataaaatcacagttttctcatttttttcacattcccacactgaatagctgctttccgtataaaagccagaaactgagagaacacattgaatatccattacaggtgaatgttaaacaatttgagatatgtttgtgtactggaataaaatgctgcattacaatcaagtcatcactcattcacataaaacatggccacattctcaaataatgtagggacctgagtgcccctccatctactggcctctcctggggccctagcctggccacaccttcttgcagggcagtcttggacgccctgggatcccgcaccaaaatttctgccctggcagaacatgcctgactggtggagagctccaatcgggcagccctcatgtgcacacaccagcttacacacttcctccgaatactgtaggttcacccaggcccacgtaacttcccacatcactttgcagtcacatgtctgtataggtgggttttgcttttcttgtcccaccattgcgtggagtgcagtcccctccccccaccccaaccaccatggcagaggaagctttggtggggaaaaagccagggccgctcctgtcagcgtcccgcacttgcgctaattctgcacagagaatagcagatcatctcacacattcagaaatcactcctgcttgtggggcatgaatacggcacccgggcctgtgcccacaagtgtcccatccctgagccaacacctcctccagtgtgaccttgaacacagtcaccaacagggccccacagacgcaatgcctctgccactgtggcgaacacctgcagggaggcaggcacccagacacccactagcactctgccacagctgccacacctccaacagcccaggacagtggattcctaaccttaaggagccggagaaccaagtcagggactagtataacttcccccagagtcagagcacacagtctaggtgttgggagctgagcactggccacctaaatttttccagaaatgaagccagttggctgaatccaccttataccacaatcaaaccctcaaggtcatccaatagggtaaaagaaaataaaaatgtatccaaaggtcagcaacttcaaagattgaaggtggataagcccacaaagatgagaaagaaccagtgcaaaagtcctgaaaacaaaaagggcgccctctttcctccaaacaaccacagcacctcttcaacagcagttctgaatggggctgagatggctgaaatgacagaaacagaactcagaatatggagagtgaaaatgtagatgaatacagctatttatggagaatactataaatgttcctcaaaaaataaagaaacaaaatctactgtagaatccagcagtctcactgctggctatgtatccaaaggaaatgaaatcaacatgtcaaagagatatctgcactccatgttcacgttcattgcagcattatttaaaatagtaaagatatggaaacatcctaaattcccatgaatggatgaatgaataaagaaaatgcatacagacacaacagagtaatgttcatccttaaataagaaggaaaccctgcctctgtgacagcatgcatgaatctagaggaccttatgccaagtgaaacaagccaggaacagaggaagagtcattcatgatttcactgtatatattaaagcagtagacttgcagaggtagagtagaatgttggttaccagggcctagaggggtggactgggaaagggagatgtgggttaaagtgcacaacgttccagttagaccggaggtataagttatgcctttctaatgcacagcatgtcaactatagctgataaggtagtatatatttcaaaattactaaaaaaataaacattagaatttccccactaagaaatgataaatttgtgaggtgatgaatataagcggcttgagttacccagttcataatgtatacatgtatcataactaaacaacatatgtcataaatatatgcaaaaattatttgtaatttataataaaataagtttcatatttaaataattacattaagaaaatgaacagaaactttcagatttcaagaatattttatatatatatatatatatcttaaaacaaacttgcaacagaatatagaaataagttttacgactcaatggaaaagaacagaattcaataaaaactggctaaaagaaacaacagctgcatcattatagaaaattctggaataatcagccatataaagattctcactctcttagaactagaattccgtaggacttgtaattcctcctgacctgggtgggaggcaaaaggaagaacagctaatggtgattcagtgagttttatacctgtgtgtacttctgtgctcactcagcagaaagaaaagaagaaaagaaagaaagagagaaagaaagaaacagaaagaaagaaagaaagaagaaagaaagaaagaaagaaagaaagaaagaaagaaagaaagaaagaaagagaaagaaagaagaaggaagaaggaaggaaagaaaagaaagaaagaaagagagagagggagagagggaaggaagggacagcagaagtcattgtggtgtgtgtgaaagcacaatccttgggctcccccacatccatctctactccagtcccatcaatgtccagcaaatacattttctaagatgaagtattttaaactttctaaatcctgctagaaaacccctcagctctttcagttttgctctatcacttgaattattgaattaaatctagtttttgtgggcctatcaataccataagccaaaataacacatgaagaaattgcactgagacacatgaaaaccttctgaaagctccataatttcagatctgcattcttatttccccgaacctaaatcactgaatagagactcagaacgagttgatcttgttcctgaacgtgcacagagccaaggacatcctgtctgtctggaacagctcaggtttgttcctgtttctcctagaggatataaaatcttgagttagggaaaaacagccagggacaccctgggctttgttcttctctcccctggaggcaggatgtccttcagagctttgtcccagtgggtaacacagctgctgaggtgtacaacccacgtggcctcgttttggtcacttttgcatggtgagcctgctttgcaccatggcctacaatatgcgtgtgtaactaatctgtctccatcttcaaaatgacattattccacatcaaatctagtgcaggtgcctcacacagaacattctcaattacctccatcattcataaaattgatgccattaatttcaagtatacatacatcagactcatttaacgtattgttattctcattgtttgaaacataacttttagatcaaataattaacaataataaaaatataaattttgaagtcaggtaatgtgatttctctagttgtgttctctttgctcagaatggcttgggctgttctgcatcttttgtttttccacatatattttaggattttttaaaaatttctgtgaagaatatcattgttgttttcatagggattgtactgagtctgtagattgctttaagtattatggacattttaacaatattgaatctttgaattcataaacatggaatattgttccatcttgtgtcctctttatttcctcaatgttttatagatttattgtagtttttttttactttgttcattacacattgtatgcctgtaccaaaacatcacatatacccaacaaatagaaatatatatactattatgtgcttataacaattaaaaattatgtatgtatattgaatctattcaaaatcagaaactatttctttttactgtttgtaaggtcttgtctctaggctataaaaagaatttgtaaaactcaacagaaagcataatataaacagaattctaaaatgagtgaaaatctgaacaaacacctcaccaagaaaaaatgttatctgaaaataagaatatataaaattgttcagtatcaattgtcataaactgatactcatatttaccaaatacaaaagtaaacatgatgtatttcaacagaattgattctcaaatatttgtatactcatacagtggaatactatcagtcataaaaactatgggttattaattcagaagacaacattttaacattttttctaagtgaaggaagatggacaaaagagactaagtattgtacaattccattcatgagacctgctaaatacagtaaaattaaaaggattttaaaaacaggtttgtgataggcagggcttttggggaaagacaagagactgacttggcaaagctcaggggatatttttagggtaaaacaaactgtgtgccattgtgatatgcctaatttcttattatatttgttcagagttaatagtgtacgtttcaaccaactcggtgattttatattttctatttgctgatagagacatgttcatttttgtcaatcactttgctaaatgtggctgagaggctgttgaaatgaacgctgagcaaatgtattcaccaaatctacaagagcaaattatttgccaattgctgattgagtggggtctataatgtatttgagattgggtgtggggatgttattgtgtgagatcatgatgtttagaccatgacactctctggtgagggatcactcattcattgcacatttaatgaaaggcaggtaggaggagcagaaggggatgagtcacactcctgaccacagccacaggttattgaaggcagaactgatgtaatcccctaaggtagaccactgcccctccaaggtgaccttatcctagagttgacacacatcctgggacaccagagacaactccttctctcccctttctctgcacttcagctggaagcaactgtctcaccgagcaccttgtgttaaggaatgagagttcctgttccaggtgtgagggcccaggtgcatccacttgatccagcacaagagcaagaacagccttccagaaaatgacatcgcctgaggtataaccagctctcacctgctgcagcttcctctgaataaaaaggaaactgttgaaacttcctcataagtgtcctgctgtgccattccctttgtccccacatgttcagttgtgtctgtccagatgtcacttttgtgtagggagattagggttctgcttccagtaccagaacacacatgacctcttaggggacttcagggttttgctgacatatgtgatgatcttaaaagtcattagctccatttctacatcaaaaaacatctgaaccaaaggagcacataggctcaggcctgtaatcccagcactttgggaagccaaggcagaggaatcacttgaggtcaggaatttgagaccagcctggtgaacatggtgaaaccccgtctctactaaaaaatatatacaaaaattagccaggcgtggtggcactagcctgtaatcccagctacttgaaaggctgaggcaggagaattgcttgaacccaggaggtggagattgaagtgagctgagatcgcaccacttcactccagcctgggcgacagagtgagcctccatctaaaaaaaaaaaaaatttatatatatatatatatatatatatatataataaatatatattatatatcatatatatattttatataatatatatgtatatttttatatattatacatacatatcaatatatgatatataatatgtatatataatatataatatgtatattcatatattatataatatgtatattgatatatattacacatatatattttgatatatatatatctccaaaccatctaaatatcaagtattttttaatccatctaagagctgaaattgctgaaaaaactactccctccaaaagctgtagagacaggcacatccacagtcacagcagagacttgctgacttggaagagaagctcctggagacacattggtgagaacatttacctggtgattatgctgaatgtctggaggacaaatgtggactagggggagggtgagcactcctagaggctgtacaccccacacttgtgtggacttgccctccagggccttcaggttctcgtggaagcaattaaaatagattccctatagccatgaactggggaggagtaatcacggagaaaagatgcacaaaaagacttttctagaaagctcatccaagggaaggtattctccaaaatcttagtttatgtgggggaaggaaatacttccaaattacagacccctcctcctcagccttcctctatcacgcaaatgataaaattagccaagaggagtcagattcaaggcggtagccctgggtgcagcatctgcagaagggaggaaagagagaaaatcagctgtatcactggagattccttgtgaaggtcactgctcaggagaagagggcaaccaaaccagggagagtcaactgtaagaacataccatgctcccctgccccacacattacctcctcaacagcatcattaatatggattaaagagggcagtgtgattgctttagatctgtttgagaaagaaagtcacatactgaggcctagggtcagggtcggcggcacttcccgtgagtaagatactacgaagaaggaaaaattaggggtccataactgtgaaaatcagccacagtgtgtgtgagaatgtttgtgtttgtgtttctgtgtgtttgagtaggagttattggaacagcggacgtggagtgagctttaatccacatccatctgcagcttcaggtattctcagatgcagtattcatctgcaagagccgaaatgagaaaagagccacctccaacccccccagagttttagcctccctttgtttccagtgatccagtgcatctagacctccaggaagtggactccctggtgattttagcgattcttctcttggagccaccctgaagaggacattgggtttccaaaggcccattcactatttcaagaagtggtgccatcagctcatgttgtcactgaaggagcattctgagccagggcacagtcacttcctagtgagctacagaggctgagagaaaaatgctctgtgagacccaatgggaagctccctgcagtgcaaggtctgggtggcagggagcgctagggcctcgcccagcacaggctgcagccctggagcaggtgcaagggaggctggggaggggttcctcccagggtctgatgtcttccttttctcggacaaacatgctttaataagttaaacaagactttagtaaagactattgatgtgtctttgtgtctttcagtatacagttctatttgtaggatttatctaacctaacaagtcaatgagaatcacatgtaaaaggagaaatttctaggattttcagatatcttaataggtaggagatggagaaaagggatggttttattaattcagtgcttgccaatcttaacagagacagtagtaagacatgcagaaagcaaagcccagaaaagtatgaaggtgtcaaagtgccatttaagtatgggttcacttggaggaccatgttctgcgggaacttgttttcagcagacaatctattttagcagagttctgggcatacaaggggacacacatcattaaacaaggattgggacagggacttcagcgtcccactgttgcatggcccataaattatgtgtgttctctttctcatcttggatcaagtctagagctatgaaatagtatccctcatgaatatgcaaataacctgagatttactgaagtaaatacagatctgtcctgtgccctgagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacacagtgtgaaaacccacatcctgagggtgtcagaaacccaagggaggaggcagctgtgctggggctgagaaatgaaagggattattatttttaatgttgtttacagtatgtcattaataaattgaaaaaaagtaacaatagaagtatatactctaattatatgggaactttgttttttcagttttttcatttttttttttttttttggtttgtttgtgacagagtctcactctgccacccaggctggagtgtaacggcacaatctcagctcactacaacctccacctcccaggttcaagcaattctcctgcctcggcctccagagtagttgggattacaggcacccgccaccatgcccggtgaatttttgtatttttagtagagacggggtttcaccatgttagctaggctggtctcaaactgctgatctcaggtgatctaccctcctcagcctcccaaagtcctgggattacaggcgtgagccactgcgcctggcccaattatatgggaattgtttatataattatcaccctataagcaaaattcatggaggaggaaaagctctactgaagaaagctgataccggcattcccatgaaagtatctgtgtagaagtaagtattaaaatcagttgaataggcaaggcatggtggctcacgcctataatcccagcactttgggagaccgaggcaggtggatcacaaggtaaggagttcaagatcagcctgcccaagatggtgaaaccccttctctactaaaaatacaaagaattagctgggcgtggtggtgggtgcctgtaatcgcagctattcgggaggctgaggcagagaattgcttgaacctgggaggtgaaggttgcagtgagccgagatcacgccactgcactccagcctgggcgacagagtgaaactccatctcaaaacaaaacaaaacaaaacaaaacaaaaaaacagttgaataaagtaccttagagtcatctgttcaattaacatgtttaactccaaagaaatactgaaaatattttccaaaaaggaagtgccattttacgttcctaccaacagtgaataagattttcttttctggagccttgtcagtattcactaatgctttgctgtgcagccgttgtaatattatagtaaatgagtagcagtatttaatggttgttttaaatatacatattcttaatacaaagtcttgatgaacacttttttatacattgttttatgaggtgtgtgttcagatctatgtatgccagaaatgcctggcagcgttaatttaagcacactgtgagaatgaccctatagtttatgaagaatgtatgttcagagctctgagctaagaaatccaggagctgtcaacccagaagtttattccttgtctgtgaaggacatctgaatccctggcctatcccttggaacacaggatgtccaggtgattgatgctctttgttaaatctggaggttgctaggtagagggtgctaagtgaaaatcataatataaactacacgtgttttacaaatggtagtggttttcctgtccaacacacttttcctgggccacattgtatgcaagtcctcaatacaccctaggtcttgttcatgggctccaggtctcctcttcagccttttggacatggtgccatgcctattacagtcaataggggtctagcatgacaactggtaggcccagaacaaggtcaaagaaaatcctgcaagctcttagacaacagtgtcaaggaaggggagacctgtggggaaatcccaggcaggccatgcacatctctgtgggcccaacagctgcaatccttgatggatggggcccgctgcatgtgtacggggatgcctccaaaatgccaaaagttctggaggacctgttgcctgaggtggatgtgacaatgtgacaaagtgacagtcagattcctgagctgtggcagctgttggccactcctgactgcactctgagcaaccactgaggcagagctcattgcacaggctagggtgtgtcagccacgagaacagttgtaactataatgagatgccgcctgtagggataggatagcaaattggagaccattgtttatttggtaggccatttaaagtgttgctgactgccacaccaatgcattaggactactatgactacgtcatcctgggagcctaagtcctggcgtccgatgtagagctccagtgggaaggagatgaaggttaggatgagtccataaaggttcttgctctgcagcccctgctttgctgtctcacttggtgaacagagaatgggaggtcaatgcggacaaagtccagggtccaggcttatcagtcaaatacttggtgtcatctggttacataagactatagttattccatatttcatcatagataagataagatgcaggtctactcatgtcccaccacaccaaagcagttggaaacctcccaaggcctcctgggacattggcgatcctttattccccatttcggcaaaccccttgggcccccatggcacttagacaagaaggtgccccactgcgactgttccaaaagggaggatgagggctctgaagaagctgaagtcacagtgaaatgaatacaaaccttgggagttctagtgcagggacagccctgtgaattggatgtagtcagttaccctgaggggtttaggtggggactgtgttaaaggcaaggacataagtgtgtgtccctaagaccctggtctcaaagacagaaggaagctgaagtgagatatactgtttaggagtagcaactgcactacatgtcatgccttacgagtgtaggatgtgacaaagagggccactccacatccggaacaacctttagcaggctggctaaaggatgccttccagacacaaaagccttggaatgccaggacacagtctgtagccaaatggtacttgtggtggtcaccaccaacataaaagtgggccaactgtgccagcagaagttagccccacagaactttcccccacctaagagaaggcagtgcaccacaatgcggaattccaccactgtggaattgggggagcttagaattggattcagacacaaggggagagagtggatcacagggtggcttctctatgggatagggggtggagagtattatactctctggactcaagatgagtaaaatgacacccatcacaaaccatccagccctatgatggcacctttatggtaagtggttgcaggctccaagggggccgggtccaatgaggaagatgcccccacagctcgttctcaatggcagactatagaagagttgcaggatatcttctgggagtcgagatgaggcatgctaattatgctgagaattattgaagtcccaacaatgaattgtttactgcaaaataaaagctacagttatgtattcagtgcctacccaatggcatggtgcactgatttccacgttaagccccctgggagggcagccaacatttcatgtgccccaggtagttgctgacttaggagaaaagaagaaactgagtaagcaagggatgcaccctactgtgatgaagaacaatggcaccaaaggaagagagacagccaaggagccagtcagggtggccagacaacgaatgtgctctaactggcaacacctaccagttctctgggcccatagcggcaataggtggttatggaagggccacggaagtcagaccggttgaactagtgatacgacctgggggactgccacccagaccctgtgtagtatacacagcttccatcctagaacacatgagaatggatatcttcttaggcgtgaccctccaaacaacggccagggaattccaacggagagttagagtggtgatatgtgtgaccaagcagaaggcaaactggatgccagtagagctgccaacccatggggagtcccacagctggagcaacaccacccgccctgggaggggaagatgatccaatcatgaagattgttaaggagctagcccaggtaggcattaggaggccactgcatggttcctacaacagacctgcatggcccatgcagaggccagttgagacatggagaatgacagtagattactgggagttaaataaggtggtctcccgagtgaatgcagctgttcctaatatctcctccagtctgacgagaataggagaggtgttagccacgtagcatttccttatcagtttagtcaataccttcttcagcatttctgttgccccagagtcaagatcaatttgcattaacctaaaaagaacaatggacttttactgtcttgttccagggatatttacacagcccaaatctcacagcctagtgacctccaacctcagtcgatgggctgacccaaaggggatacatgttttccactacattggtgttatcatgataacctctgagtcttttttcagcttataaattacagcccctgtcttgctgtctcacttgctgaatagaggatgggaggttaatacagacaaaatccagggtccaggcttatcagtcaaatagttggtgtcatctggttgggtaaaactaaagtcattccatctgccatcatagataaggtgcaggcctacccacgtcccaccacaacaaagcagctgcaaactctcaaggccttctggagcatcagtgtccttttattccttttatttgacatccctgaaggaggctgctaggggagactgtgtccctcctaaattcatgtgctgaagtcccaacccttggtccttcagaatgaaatcatacttggattagtgtcctttaaagaggtgaataagttaaagtgagattcctggagtggggccctaatgcaatctgactgttgttataagaagaggaagcaggagggagggtgcacaggccccgagggacggccatgttaccacagaacagtgagaaggcgccatctgcatgccagggagcgagacctcagaggaaacccacccagctggcagcttgatcttaggctttcatcctccataagtgtgaggaaattggttttgtattgtaagccatccgatctgtggtatttcgttataaaagccctataaaatgaatacagtaggtaataggagagcttctatacattgaaaaagtcggatggccagaaaaacctagacactcctgttcagacctgagcagggtgatggacctgctttgggacaggagaggggaagagatgaacccagcacccagacccagctgagcccattcctcagcaggccgtccctgggccggagcttgcacaggtgtgaaagagcctgtcttggtcttcaggggctcatggagttggacggagaatggtgtagactcaagaacacgtcatcggtgtgcccgtgtttatctgaatgggatgtgtttctagggtgtgctcatccccaaagaagaattaatcaggtctcttgggctaaaaagaggttgtggcatttgtgtgtattaataactgtggtcggacagtaaattatgttaaactgcttatgggaaggcacaatggaaagaaacactttgttacagaaggaaaaaaaaggtgattatttaaatgaggtgcctttgaaggtcaccatgccaagaggagcccatcacatgatagtgctggctttcatgttcaggagatcaggagggtccgtccgctggcttttatgacaccctagacagagctgagagtgtaatgtatgaatggaggggaagtggagagaggggaggccaaatgtttggtgggaatggagggtcactattggagccattaggaaatacacaagcatgaattatgctggaggacagaacagtgttcctggggaatattgtgttgctttgggagctgctgaacatacaggagtttcactgttcctagttctcaaattctctagactctctggacaacccagttttaaatattgggaatataggtaagacacattcgttattaaaaattattaagagaagatgtaggaagaaatttaaagtaatccatttggttatgaaaatttagttacagcgaactgtgatgtccgtttcttacttggaataatggaatgtaagtcattagtcatctcaacggttcatttttccataaccatcaattacaaaactgctgagtaatttcctgaattgcccaccatagaaactgacctcacatttcctcaatgagaaactgccagtcccgttgatccagcctcgttcttcccatcagggattttgtatctctgtggacgtgtggcacagtgctgcatatccatcggcatatggcctcaggaaaggcgccagcctatccatgcatgatgaagcttacttaggggatgaagcccgcatgctgggtgagccagtgccaacagctgaaagaatcaactgcctggtgtatgatgcttttatgaaaacaagcccagggcctcttgcattcttctgtattagattctctggtgaagatttttattcatttctgcctgaaattgccacatataattacctggaagcattacaataaactgatttggaagttaactgacttcctggtgaggttaaaatgagtgtcaggtgcatagtgagacagaccggagacatggatgcatagcaaacttgtgctcaccatggtttctatcttagttagggaaacttctgtaccttccttagatgttcaggcactccattgaggaccctggcataacattatttattgacagaccatagctcaaagtatagaactggatactaccaaggaggatatactattactattttatctttatcttaaaatatactcttccatctgaggtgaaaattaatccagatggtagaacttattgcagttactacagcattttagcaaatcaaaagccgcagaacaaacatatggacagatggcaggtatgttttcggaatcgtaaacaagttcgtgatgactgtaaaaccaaggggtgtctcacgagggctggaaacctctcacaatgaaacaacacaatgaggatctttgaaaagtactctgacctcctggtgagctggctgatatggaggctgagctccatgtagaaagccaaaggaatttctgcaggacgtcatcatgccaagcacagccgtaacctgggtcccagcccttttcacacgctcaatggttagatcttgggagggaatcaaagaagccatagtaaaatatcaaaatttaaaccccgattttgaatttaaaaagtgttaaaatatggttgtggcctacactcagaaaatctgtgtccttcagatggtttctcagtggcaccagatggtttcaagtggctattcattaagtttctcagtgaaattaccagacatagaataaataaattgtcactgtcttaaatcaacccatgggaaaggaaaactgtgtaaatacagcagagaggaaacattgctcaagggaaaaacaatctccagaaagtattgttaaagaaacagaggccctctttccagccagcgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgttcccaaaaaaaaaaaagaaagaaaaagaaacagaggcatcacacttactagaaaaacatattctatttcatatattatggggatatgacgtgatgttttgacatatgcgggcattgtgaaattattaaatcaagtaaataaacatgtccatcacctcacatacttattttttatggtgtaaacgtgtaaaatctactctcttatcagttttcaagtatatagtacattagtatcatggaagtcaccatgctgtgcaatagatcttcaaacgaattccttctatctaaccaaaactctgtaccctttcaccaacgtctcagctttcacatgcccctgacgccagcccctggtaggcaccattctactctctactctgagttcaacatttttagattgcatgtgtaagtgagatcatggagtaattttttatacctggcttatttcactcaacataaagagtcaaatgctcaacatcactaatcatcagggaaatgcaaattaaaaccacgataagatatcacctcacacatgttacaatggcttagtctcagtctgtctttttgttactataaccgaataccagagactgggcaatttctaaagaaaaggaatttatgctttatggtgcttgagtcagagaagtctaatatcaaggcactggcatctcacaagggccttctcactgcctcatctcacagcagaggtgggtgagcaagagaccatttgtccacgagagaaaagagaccatcttttattagaaattcactcctataataactaacccactccattgatagtgacagtaatccattcatgaggacagagccttcatgacttgatcacataataaaggtcccacctctcaacactgttgcattaaagattatttccagatcctaaactttgggagacacatttaaaccatagcattccattcctaatatcaaaatttatgtccttatcacaatgcaaattacattcattccatcccaattgtctccaaagtcttatccagcatcagtgcaaaagtctgaagtccaaagtctcatctaaatcagatatgagtgtgactcgaggcacaatttagcctgatataaattgtttccatctgcgagcctataaagtcaaaacaagttatctactttcaaatacagtgaacaatggggcaggtatgggatagaaattcccattccaaagctcagagagaggcaaggagaaagcggtgcctagttcaaaacccaacagggaaaaaaacattaagtcttatagctggaaaatcatcctctttaacggcatcttgtgcacactggggagggggatgggcccccaaggcctccggcagtcttgcctctatatattttctgggttcagtccactcagccgctctcacaggtgggactctcaggcctctagctctcctaggctgactggaaactctttgtggtacctccaaacccacatttctgcttggcattgtgctaagggcccagtgtggtgactctgtctctgcaacaagtcactgcccgagaccttaggctgtccttaggctgcccgagaccttaggccgtccacagcattctttgaaatctaggtggagaaagccatgccctcgtggttcttgtattctgcacacctgcagaattaacaacacatggatgccatggaagttgatgacttgtaccattaaagtgatggcttgagccacacctaggtcctcctgagccacagcatgggcagccaaggagtgctgtgcctggacaccgggaacagagtcctaaagtgcctgctagaagtcaggccatagatttccttcaaatttctcccaccatataacctcgttcatggctctgaacttccaccttacagaaggacctagggatgaacacaattcagccacgttctttgccactttatggcaaggatggcctttgctccattttccgatgagctattcttctttttctcctgagacctcatcagaacggcctttattgtccacggttctactgacattctaatggtcatcacctaaataatctctaagaagtttcagaatttcctcacagctctcttcttctgagtcctcaaaagaatcacctctagtgttctattcagggcaatccagactttttatagtctgatcctccaaattattccagtctttgtgcattactacatccacttctacattttggggtatttgttatcgcaacagccccacctcttgatactgatttttcgtcttagtccactttgtggtgcaatgagtgaataccacacactggctaaagtataaggaaaagaaatttattttctcgcagctctagaggctgggaagtcaatatcaaggtgttagcatctggcaagagccttcttgctgtgatgtccatgtggaaggcaggagagcaggtgcgaaggatggaaaggggtttaaactcattttttaatgaggaacccaggcctgtagtaactaatctgctaccacaatgagtaacctactctgacgataatggcattcattgcttcatgagggcagagccctcatgacctaatcatttcttaacattcccacctctggacactatggaatttgggattaagtttccaatacacatcctttctaaacagcaggggctttttaataggttgaccacccaaggctgcaggaggctctgaagcagtggcctgaggttggctgtcctttgtgagaatggagagaagtgaactgactcatggagacacaagtagatgaggtaaaggcattcattgcttcattacatggatggtgaggtcgattgaaggcattaacggattaaagatggtggcaaaaccgtctgaggtggagaccacggggagtccatcagaaatggaggacacgtcccaataaatggtgcttcatttccctgcaaagcagaagaaagcaaagaacaaaacacaacatcatagtgtacactgagcagtggattgagagaagagtttcctaaggcataactgacagagtggagaagacacacaaatctttgcatgatgctaacatttggactgtggcttcattatttcttattaatattttactgaaatatcgctagaaggagactgaaaatgaagtgtgaaaagttaaatgggatttctgctctatgtccttttcagatgagaggaactagggaattccagggaagaaacaataatagctgctgagcaaggcttttgcagggcaggacaaggaatccccaaagagaaaacggaaacctcagcttcactttgcatctgctcctgagccaggtcctgagcgacccctgtaggtcctgagtgcccctccgtaggttctgagcatcccttggttgctgggcgccctctggtggtgtctgagcccctctggtggtttctgagccccccgccttatgtctgatcctccctggtggtgtccgagtgcccctgctagtgtctgagccccctggtggtgtctgagtccccttcttagtgtctgagccaccctattagtgtctgaggacccctgatggtgtctgagcccccagttagtgtctgagccaccctattagtgtctgagcccccctggtggtgtctgagcacaggagagctcctctgaaggaagggtctacatggggacaggcgtgcttgtctcagggaagggtccatgtggggacaggtgtgcttgtctgaaggaaggttccacatggagacaggtgtgcttgtctcagggaagggtccacatggggacaggtgagcctgtctgaggggacagaagtgcttgtctcaaggaagggtcctcatgtggacaggtgagctcttttgagggaagggttgacctggggacaggcatgcttgtctgaggtaagggtcctcctggggacaggtgtgcttctctcagggaagggtccacgtggggacagaggtgcttgtctaaggcaagaatccaagtagggacaggtgagctcgtctcagggaagggtccaggtggggacagttgtgctcatctgagagaagcgttgaagtggggacaggtgtgcttgtctcaaggaagggtccatgtggggacaggtgtgctagtatcaagaaagggtccacatagggacaggtgtgcttctctcagggaagggtgcatgtggggacaggtgtgcacatcggagagaatggtccacctggggacaggtgttcttgcctcagggaagagtccaccttctcagggaagaagtgtgctcctctgagggaagggtgcacatggggacaggtgtgcttgtctcagggaagggtccatgtgggaacaggtgagctcatctgagggaagagtccacgtggggacaggtgagctcatctgagggaagggtccacatggggacaagtgacctcgtctgagggaagggtccacgtggggacaggtgagctcgtctgaaggaagggtccacttggggaccggtgtgctcctctgagggaagggtccacgtggggacaggtgtgctcctctggagggaagggtccacgtggggacaggtgagttcatctgaaggaagggtccacatggggacagttatgctcctctgagggaagggtccatgtggggacaggtgtgcttgtctcagggaaaggtccacgtggggacaggtgtgctcaccttggggaagaggacagatgagctcatctcagggaaggggccatgtggggacaggaccaagggttgggacttcagcacaagaatttaggaggaacacagtcttccctagcagcctccttcagggatgtcaaatattttccttctgttccctgtgaaagccttaaaggggtagggaaagggcgttcaacctgcacactcgtagaggggaaaccagcttcattagtaatcgttcatctgtggtaaaaaggcaggatttgaagcgatggaagatgggagtacggggcgttggaagacaaagtgccacacagcgcagccttcgaaacacaccacggtcacgttaagtttaaatggagtgaccacattcgccaggaaagggaaatatttacacttttgaagaaacagtaatttgtgtttctgattatgatctggccttggattttccctcccctcataagcaatgacagaattggcagaaatatgtgaaacgttagttctcagacatgagacacccacagagggccccctgtgcccttccctgagagctgatcagctcctgcatctgaagaaatgaccaaagaccaggagagaaccacacagaagcatcggagggacagcacctggggctctgatggggtcaggaatagcatctgttcccaatagatggactaagtaaaaagtatcataattcacaagagttttacatagcacagaagaaaaagttaccctatatcaactgttgatcttgtgaatccaggaactctggattcaaggtggtcgggcacatcttgatttacgcatttcagggacacatgagacatcagtcaatataagtaagaaggacattagttccatccagaaaggctgagacaactcaaagcaagtcctccccacttagggcttccaggtcacaggtaggtgagagacagatggttgcattcttttgagtttctgataagtgtttgcaaaggaggccatgaggatatgcacctgtctctgtgagcagagggacaactttaaatagactgggaggcagatttgtcctgagtggtttccagcttgacggggcccaagatattttcctttcacaatctggtaacttcaaacaaaacttcaaagccacaacaaaacaacacaacaacaaaaagaataagacatgggtacttattaagagtagaaaaacattcagtccccaaggaaaatattggcagtgtctacctccacatgacaaaggagtaagcagtgtgagccacagaaaggagcactattaacccacagagcaaccgagaataacacgggtgatgcgagggcattggacgcacatcattgcattttgtagattcagaaagaaacggaaaagattgacggtggtaaaagagacagccctgcttccctctcccttttccctccccgatgaggcctcacagccatgaccctcagcctcatcccgcagtgcagcagctgccgtcctgtccaggcccaccccctgccccgccctgggactgttacctcattccctcccggagtccaggtgccccccggggtgtggtgcgggagcctggggaggccctttgttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgcccgtgcaagaccaccacgcttggcacggccccacctcgtgtcagggcctgtgtcccctgccccaccccctaaacagatgggaaccactgggactctgctcagggcagggggcggaggtatgtgtgaaaggaaggcaaatgtgcactctgttggagaaatattataggtagtttgagcaaaaaatctaatgccatgggaacttttagaatgatacgtattttaacaaagaacatgaccaatagagtttgtattgaagccaggaaaacactatttagagcaacagcaatatcaaaaacacaagccaacagttcaccaagaaaaaccaccattaaccccatggaaatggtcttccaagagcatcggcacttaaatcctggaaatctgcctgcctcagcacctgttgtcctgacctgccctcctgtgtgtcctaatcactcccaaacacggggcctgcactgtgggagattcacactgtgccaggtggagggagcaggacaactgctaacaggttgttggtgtggatgccgaggccacccaagcaggtgtaaactcccacctgtggggcagggaagagtgcacgggagacatgtcccgggcatagggtgagggagagctgtgggggctctgggttctgaagtgggttctgaagagggttctggcctggcagggataagaccaaccagcatgtgaggccaggctggagtctggacctctgaagctgcaagggtcatgggctgcttggccccaggggctgtcctggttctctatggagtactttcaaacattctttcttcttccaatccccctccttctctcccaaagcctgcatctcccaaatcctctttgtcggatcctcggcttcactctgcatccgtcctgagcatcgatcttccaattccatcctcttctcttctgctatgtctaagctgctgtgaagccacctgctgtaatttactgctttatatttaatattgtaccgtacatctgttctgtttccctcatcataaatgcttcatttcatgctcagcatctgagaacacaaggccttgtcagctgtcacctccttccgttctctgtttccttcctcctatccccatattgctcatcatgtccagtctcctgccatcctgaatgcttctgatggaaggtctgagatgtctcatgagcactgtgaagattctttgtaatgtgagcttgttccaggcaggaattctccttcacccagccctggaagccaagtataggcagatggccatgctcaatcaaagactgagctaacttaacagtggctttggttttaaggtttctccaatccccagggcacaggatttcagggaattcaggtgagagtctgggtgttacccttcaggaggctgtaaactccatttcacctagtctacaccacagactatggaaactatatatatatatagttctgtccctctagagaaacctaatatgtatatatacaatatataatacgtattatatattatatataatacgtattatatattatatatattatatatatattagagtttattgaggagtattaaactcacaatcacaaggtcccacagtaggccatctgcaagctgaggagcaaggaagccagtccgagtcccaaagctgaagaatttgaagtctgatgttcgacggcaggaagcatccagcacaggagaaagatgtaggctgggaggctaagccagtctagtcttttcacgtttttctgcctgctttatatcctggccacactggcagctgattagatggtgcccacctagattaagggtgggtctgcctttcccagtttactggctcaaatgttaatctcctttggcaacaccctcacagacacacccaggatcaatactttgcatgcttcaatccaatcaagttgacactcagtatcaaccatcacaagtccaccccttgtcaacttgaacccatacaaatctcctgagatcatacataatcttcaaataaagacaataataaggtcataattacacctaatgtaatacaactatcttttgtacaaccagaaatgcaccaatccccaacccaaatgctattatgtaaagttaagaacacttaaatgctgatatgaagtcaataaattttatgtcacatgataaaggaaaaaagaaatgaaggaattttcttagtacaagtgtgtacatgcacaaacatgtttttaacaaaagaagaaggaaatactgatgacaattacagtcctcatttctgcaactgatcacgtggttgtagctggtattgatgactaccttcttctactacccattctgtattccctttgccttcagcaagcatcacagcaggtagagttttttctcctagtggagtgatgcaaaccttcattcctgaagggtctgggccatttgtagtcctgcctggattgggctgttgtagtttcccgttgaccttaatgacagggcatggtaatgttaagagacgccctaatggatctcctgtattccatacatattcttccttacctccattgtggagtaatagactgattgcatcttgatagtccaggtcaatcagcccagccaacactgtaactcccctcttagcctgtggacttaaaggtaggaggggcccaaagtggccaggtggaaatctttacttccagtttaatggaattgttgttgtttctcctgatggcagcattattcccactggaactaagacctctaggccaacagaatgtaatgtcatgggaccaggaagcaaaaattttgctagtggatcactaggggtgatggtgaatggtgccatttccacttccaccccttgattcctggatccatgaattatggctatgggagaaagagtaccatatattggatgctgatttggagcatacatggccttttggagagctttgccccagccctgcaaagtattggagcctagttgacattgtaattgtgactttgaaaggccattccattcttctatcaatccagctgcttcaggatgatggggaaaatggtaagacaagtgaatcccatgagcatgagcccactgccacacttctttagccgtaaagggagtgccttggtcagaggcaatgctatgtggaatactgtgacagtggataaggcattccatgactccacagatggtagtcttggcagaagcattgcatgcatatctgcagtaagtgtctatttcagtgaggacaaacctctgccctttccaggatggaagaggtccaatataatccaacctgccatcaggtagctcactgatcaccctgaggaatggtgtcatttgggtagagacccagagccaaaccagatcacgccacccaacccctcccaaatctcatgtcctctttgcatttcaaaaccaatcatgccttcccaacagtcccccaacatcttaactcatttcagtattaactcaaaagtccaaatccaaagtcacattggagacaaggcaagtccctttcatctatgaacctgtaaaatgaaaaacaagtcagttacttccaagacaaaatgggggtacaggcattagatacatgctcccatttcagttgggagaaatgagccagaataaaggggcttcaggtcacatgcaagcccaaactccagtggggcagtcattaaatcttaaagcttcaaaataatctcctttgactccattcctcacattcagggcatgcttatgcaaagtgggggctcctacaaccttgggaagctctcaccctgtggctttgcagctctgaccccatggctgctctcatgggctttgcagagttcagccctcctggctgctctcattgagtgcatgcagcttttccaggtgcacagtgcaagccgttaatggatctaccattctggggtctgaaagatggtggccctcttctcacagccccattagtcactgtctccagtggggactctgtgtgggggctccaaccccacatttcccttctgcactgccctagcagaggctctccatgaaggctttgcccctggcgcagacttctggctggacatccagtcatttctataaatcctctgagatctgggtggaggatcacaaagctgaactcttctcttccgcacatccctaggcccaacatcatgtagaagccaccaatgattggggctttctgaagcaatggcctgagctgtacattggacttttttagccacagctagacctggagcagctgggacacagggcaccaagtcccaaggctccaaagagaagctgggccctggacccagcccatgaaaacatttttccctgataggcctccaggcctgtgattggaagggctgctgcaaagatctccgacatgccctggaaacattttccccattgtcttgattattaatattcatctcttcattacttatgcaaatttctgcagccaacttgaatttctccctagcaaatgtgtttttctttactaccacatggccaggctgcaaattttccaaacttttatgctctgtttcccttttaaaaataagttcctatttcagatcatctctctcaagggcaaagttccacagatttctagggcagggacaaaattccatcaagcttggttttatacattttagagaggcatgagacatcaatcaaatacatttaagagacacattggtttggtccagaaaggtggaacaactcaaagctagggcttccaggctataggtgaatttaaatattttctggttgacaattggttgagtttgtctaaagacctgggatagatagaaaggtaatgttcaggttaagataaagattgtagagtccaaagttcttttgaagtcttatagtggctgcccttagagataataggtgacaaatgtttcctattcaaatcttagttgaactctttaggattgggaggttctagaagaaaaagatctagctatgttaatagagattctttacagatgcaaattttcccccacaaagaacagctttgcagggccctttctttctttctttctttctttctttctttctttctttctttctttctttctttctttcttttttagatggagttttgctcttgttgcccaggctagagtataatggcacgatcttgtctcaccacaacctccacctcctgggttcaagtaattctcctgcctcagtctcccgagtagctatgattacaggcatgcaccaccacacccggctaattctgtatttttagtagacacagggtttctccatgttggtgaggctggtctcgaactcccaacctcaggtgatccgcccacctcagcctcccaaagtgctgggattacaggcatgagccaccatgcccggcctgcagggccatctcagagtatggcaaagaaacatgttttggggtaaaatattttgattttcttatttgtctcataatgttatgccagagtcagtttggaaagtaaatcatgatatataggtttaaataaaacccatctgatgagaatttatgatttgtagagcatgcctccccagactctttagataggaatttgggcaagatgaaaaaaaaatcagagtttagtcctcactacctaagaccagctcagcttggacttcactgttcatgtcactatcagcattttagtcaaaaccactcaataagtctctaggaagttccaaactttcccacatcttcccttctcctttcaagttctccaaactgttccaaccgctgccaggaggtacccagttccaaagttgcttccagattttgagttatctttatagcagttccccactcctggtaccaatttactatattagtctgtttccacagtgctataaagaactgcccgaaagtggttaatttgtaaagaaaagaggtttaattgactcacagtgctgtgtggttagggtcggaggctcaggaaacttgcaatcatggtggaagtggaagcaggcatgtgacacatggcagcaggtgagagagagaaagagagagagagggaatgaaggaggaaccaccatacatggataaaaccatcagatctcatgagaactcactcactatcaggagaacatgaggacagcatgggggaaaccacccctatgacccagtcacctcccaccaggtccaccccttgacacataaggattactatttgagatgagatttgtttaatgacacagagccaaaccacatcagcatgtgacaaaggtctaatatcaagaatctatgagggggcagttccaaaatggctgaataggaacagctccagtctacagctcccagcatgagctacacagaagacaggtgatttctgcatttccaactgaggtactgggttcatctcacgggggcttgttggacagtgggggcaggacagtgggtgcagcccaccaagagtgagctgaagcagggcgaggcattgcctaacccaggaagtgcaaggggtcagggaattcccgttcctagccaagggaagcggtgatggacggcacctggaaaatccggtcactcccaccctaatactgcacttttccaacggtcttagcaaatggcacaccaggagattatatcctatgcctggcttggaggttcccatgcccacggaacctcgcttattgctagcacagcagtctgagatcaaactgcaaggtggcagtgaggctgggggaggggtgcccacaattgctgaggcttgagtaagtaaacaaagtggctgggaagctcaaactgggtggagtccactgcagctcaaggagacctgtctgcctctgtagactccacctctgggggcagggcatagctgaacaaaaggcagcagaaacctctgcagacttaaatgtccctgtctgacagctttgaagagagtagtgtttctcccacatggactttgagatctgagaatggacagactgcctcctcaagtgggtccctgacccccgagtagcctaactgggaggcaccctccagtaggggcagactgacaccttacacggctgggtgcccctctgagatgaagcttccagaggaattatcaggcagcaacatttgctgttcagcaatattcgctgttctgcagcctctgctgctgatacccaggaaaatagggtctgcagtagacctccagcaaactccaacagacctgcagctgagggtcctgactgtcagaaggaaaactaacaaacagaaaggacatccacatgaaaaccccatctgtacatcaccattatcaaagacaaaaggtagataaaaccacaaagatggggaaaaaacagggcagaaaagctgaaaattctaaaaatcaaagtgcctctccccctccaaaggaatgcagctcctcgccagcaatggaacaaagctggatggagaatgactttgatgagttgagagaaggtttcagatgatcaaacttctccgagctaaaggaggaagttggaacccattgcaaagaagctaaaaaccttgaaaaaagatcagatgagtagctaactagaataatcagtgtagagaagtccttaaatgacctgatggagctgaaaaccatggtatgagaactacgtgatgaatgcacaagcttcagtagccgattcgatcaactggaagaaagggtatcagtgattgaagatcaaatgaaagaaatgaagggagaagagaagtttagaggaaaaaaaagtaaaaagaaagaaacaaaccctccaagaaatatcagactatgtgaaaagaccaaatctatgtctgattggtgcacctgaaagtgacagggagaatggaaccaagttggaaaacaccctgcagtatattatccagcagaacttccccaacctagcaagacaggccaacattcaaattcaggaaatacagagaaccccacaaagatactcctcgagaagagcaactccaagacacataattgttagattcaccaaagttgaaatgaaggaaaaaatattaagggcagccagagagaaaggtcgggttaccctcaaagggaagcccatcagactaacagctgatctctcagcagaaactctacaagccagaagagagtgggggccaatattcaacattcttaaagaaaagaaatttcaacccagaatttcatatccatccaaactaagcttcataagtgaaggagaaataaaatcctttacagacaaacaaatgctgatagattttgtcatcaccaggcctgccctacaggagctcctgaaggaagcactaaacatggaaaggaacaactggtaccagccactgcaaaaacatgccaaatcataaagaccaccaaagcgaggaagaaactgcatcaactaacgagccaaataaccagctaacatcataatgacaggatcaaattcacacataacaatattaacctttaatgtaaatgggctaaatgctccaattaaaagacacagactggcaaattggataaagagtcaagacccatcagtgtgctgtattcaggagacccatctcacatgcagagacacacataggctcaaaataaaggcatggaggaagatctaccaagcaactggaaaacaaaaaaaggcaggagttgcaatcctagtctctgataaaagagactttaaaccaacaaagatcaaaagagacgaagaagaccattacataatggtaaagggatcaattcaacaagaagagctaactatcctaaatatatatgcatccaatacaggagcacccagattcataaagcaagtccttggagacctacaaagagacttagattcccacacaataataatgggagactttaacaccccactgtcaacattagacagatcaacgagacagaaagttaataaggatatccagcaactgaactcggctctgcaccaagcagacctaatagacatctacagaactctccaccccaaatcaacagaatatacattcttttcagcaccacaccacacctattccaaaattgaccacatagatggaagtaaagcactcctcagcaaatgtaaaagaacagaaattataacaaactgtctctcagagcacagtgcaatcaaactagaactcaggattaagaaactcactcaaaaccactcaactacatggaaactgaacaacctgctcctgaatgactactgggtacataatgaaacgaaggcagaaataaagatgttctttgaaaccagtgagaacaaagacacaacataccagaatctctgggacacattcaaagcagagtgtagagggaaatttatagcactaaatgcccacaagagaaagcaggaaaaatctaaaattgacaccctaacatcacaattaaaagagctagagaagcaagtgcaaacacattcaaaagccagcagaaggcaagacataactaagatcagagcagaactgaaggaaacagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaactagaaaatctagaagaaatggataaatttctcgacacatacaccatcccaagactaaaccaggaagaagttgaatctctgaatagaccaataacaggctctgaaattgaggcaataattaatagcttaacaaccaaaaaaagtccaggaacagatggattcacagccgaattctaccagagctacaaggaggagctggtaccattccttctgaaactattccaatctatagaaaaagagggaatcctccctaactcattttatgaggccagcatcatcctaataccaaagcctggcagagacacaacaaaaaaaaagagaattttaggccaataaccctgatgaacatcaatgcaaaaatcctcaataaaatactggcaaaccgaatccagcagcacatcaaaaagcttatccaccatgatcaagtgggcttcatccctgggatgcaagtctggttcaacatacgcaaatcaataaacgtaatccagcatataaacagaaccaacgacaaaaaacacatgattatctcaatagatgcagaaaaggcctttgacaaaattcaacaacacttcatgctaaaaactctcaataaattagatattgatgggacgtatctcaaaataataagagctatctatgacaaacccacagccaatatcatactgaatgggcaaaaactacaagcattccctttgaaagctggcacaagacagagacaccctctctcaccactcctattcaacatagtgttggaagttctggccagggcaatcaggcaggagaaggaaataaagggtattcaattaggaaaagaggaagtcaaattgtcgctgtttgcagatgacatgattgtatatctagaaaaccccatcgtctcagcccaaaatctccttaagctgataagcaacttcagcaaagtctcaagatacaaaatcaatgtgcaaaaatcacacgcatttctataacccaataacagacaaacagagagccaaatcatgagtgaactcccattcacaattgcttcaaagagaataaaataccttggaatccaacttacaagggacgtgaaggacctcttcaaggagaactacaaaccactgctcaatgaaataaaagaggatacaaacaaatggaaaaacattccatgctcatgggtaggaaggatcaatatcctgaaaatggccatactgcccaaggtaatttatagattcaatgacatccccatcaagctaccaatgactttcttcacagaattgggaaaaactgctttaaagttcatatggaaccaaaaaagagcctgcaatgtcaagtcaatcctaagccaaaagaacaaagctggaggcatcacgctacctgacttcaaactatactacgaggttacagtaaccaaaacagcatggtactggtaccaaaacagagatacagaccaatggaacagaacagagccctcagaaataatgccgcatatctacaactatctgatttttggcaaacctgacaaaaacaagaaatgggaaaacgattccctatttaataaatggtgctgggaaaactggctagccatatgtagaaagctgaaactggatcccttccttacacattatacaaaaattaattcaagaggattaaagacttaaatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtaaacaggcaacctacagaatgggagaaaatttttgcaatctacttatctgacaaagggctaatatccagaatctacaatgaactcaaacaaatttacaagaaaaacaaacaaccccatcaaaaagtgggcaaaggatatgaatagacacttctcaaaagaagacatttatggagccaaaagacacatgaaaaaatgctcatcatcactagccatcagagaaatgcaaatcaaaaccacaatgagataccatctcacaccagttagaacggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgcggcactattcacaatagcaaagacttggaaccaacccatatgtccaacaatgatagactggattaagaaaatgtggcacatatacaccatggaatactctgcagccataaaaaaggatgagttcatgtcctttgtagggacatggatgaagctggaaaccatcattctcagcaaactatcacaaggacaaaaagacaaacactgcatgttctcattcataggtgggaattgaacaatgagaacacttggacacaggaaggggaacatcacacaccagggcctgttgtggggtggggggagtggggagggatagcattaggagatatacctaatgttaattgatgagtttatgggtgcagcacaccaacatggcacatatatacatatgtaacaaacctgcacgttgtgcacatgtaccctaaaacttaaagtataataaaaaaatttttaaaaaaagaaacacctgcttttttctgttttccatttgcttagtagatttttctccatccttttactttgagcctggggatgtcattgcatgtgagatgggtctcttgaagacagcatacatttgggtcttgcttctttctccaacttggcaattctctgccctttaattggggcatttagcccatttacattcaaggttaatattgatatgtgcatatttcatcctgttatcatgttgttagctgctcaatatgcagatttgattgtatagttgatttatagtggcaatcgttatgtacttaagtgtgtttttgtggtggccagtaacgttcttccattatcatatttagcaatcccttaagggcctcttgtaaggcaatctagtggtgatgaatacccttagcatttgcttgtctgaaaaggatcttatttctccttcacttgtgaagcttcatttggctagatatgaaattcttgcttggaatttcttttctttaagaatgctgaatataggcccccaatctcttctggattgtacagtttctgctgaaacctccattgttagcctcattgggttccctttgtatgtgacctgaaccttctttctagctgcctctaatattttttttcctttcaacctttaagagtctgatgtctgatggctatatgtcttagggatggttgtcatgtataatatcatgcagaggttatttgcatttcttgaatttgaatgttggcctctctggtgaggttggagaaattttcatggaggatagcctgaaatgtttttcaagtttctttttttctctttctcttcttaagggataccaatgtgtcatagatctggtctttttacataattgcacatttctctgaggttttatgccttcttttttattctttgttctttatttttgtctgactgagttaattcagagaatcagtttttaagctctgtgattctttcctcagcttggtctattctgctgttaatacttgtaattgtattctgaaattcttgaagtgagttttttagctctatcaaatcagtttggttctttcttaaaatggccatttcatctttcagcttctgtatcattttactttatttcttagctcccttggattgggtttcaacattctcctgaatctcagtgatcttctttcctgtgcatattctgaattctatgtctgtcatttcagccatttcagtcaggttaagaaccattgctgggaaaccagtgtgattatttggaggtaagaagacactctggattttagagttgcagagtttcttgcattaattctttctcatctttgtgggctgtttctttaatctttgaagtggctgtcctttggatgtttttgtcttttttgttgttttttggtgtgtgtttttgtttgtttgttcatttgtttgttttttgctcttatcttctttgatactcttgcaggtttgattgtggtataaagtggattcagttagctgtgtttcttgaaaatcttagagggtccaggctcacctcagcactcttgtggtgtgttctctgctctgggactgggcccctggctttattctctggccccttgagtttagaaacttgctgcattggaggggctgaggtgttcccagtccattggccacaacactatagtagggggtgccggccaaagcacttcattagagtggtggcagtgggatccattcttactcatgggtgccagcagttgtggagtcatggcagggtgcacatgcatctgctggggtgggggtactggcaggagcagagtggcagcatccctacataggttcctgctggcagtcacagcgcagtgaggtgcccgtgtgttggcagggacagggtggtggggcacacatgcacatgcttgctggtggtagagggagttgtgatctgctgtgcactcatgccagcaaagcagttgggaggtactatgggtggactggtgcacatcagcagaggctggcctgctggaggtctccaatggttaggcatggtctgctggcaaaggagctatgatgagggcccccaggaaacaccctggttgggcttccaaggctgtactgcaagcaggcacagccagcctggggccccaggagaggccagaaggcaaggaaattctcatttcagatgggccctgtcccatggacaagaccaccctgctttattcaggtcccatagtcactctaaggttaaaatctcctagaggaggttggtgagccttgggggatgggtgtcccctggctgtgctccactacagccattctcatgtcaaacactctgggctttacacagactggagtcctgcccctggcatctctctaagcagctgtcccttccagcacaagtgtccatgggggtcatggggtctcctgctgctaggattctggaggcccatggcaacagcaggccactcctcacctgttcaactcaacctttccccaggagttgctgggagccaggaatgagtcctggtgcttggcatccccatgcagggttcccatcttcctccaccttcagctcagcatctgtgtcctcccccgtctactctcaatccactctcaatgcctccccttcaaagatctgcttggaaagcacccgtcttcctgatgtctcactccctccatggcagatattcctcctggctgcatctagtcagccatcttgactcgcctccaaagtctttttaattaccacttcggttaaattagtaactatcattttacaatggcctgtgattctgttttgatcaaatattttgagccttttagcatctataacaaatgttctcaaaaatcaaaatcctaaatcaagtctctgccttagtcttatttctggggcttattaaggctataaaaattaatcaccataaggttgtacaagctttttacagcttccagtcaggctatgaactccagtatcaccacctccagcctgataattacatatattggaagaaaatcagttaaaggactccctctagacccttgaaagggtgtgagagacaacatggtttcgcctgccttcatgtgtcccagtccatccctgtggctgcctctgtccacctcagcttgcccactgtctttccttcccaactgtctgccctgctgacttctggcctcagtgacagatgcaaagacaaggcgacagccccacatagaccgtttaaccagtcccacatttgcataagctaaatggtcatgtcacagtctgttgcccaggctggtctcaaactcctgggctcaagtgatccacccaccttgacccccaaggtgctgggattacaggcttgagccacagtgcccagccaagaacccgtttttgagtgggcaccttggcacacacctgtaaacgcaacactttgggaggccaaggtgggagtgtggcttgaggccaggaggttgaggttgcagtgagctatgatggcaccacctcactccagcgtgggtggcagagtgagatcctttagaaaaaaaaaaaaaaaaaacttgttttctctgcagccgggctccgtgaccaaacacaaacacaaacttcccctccagagggtccaggaggggctgggctgcaggaggtgcttagggcctcttagggaatggtaagtgaccacccaacgcaggcactcagccccaggggcatatgcagagagagggtccaggaggagctgggctgcaggaggtgcttagggcctcttagggaatggtaagtgaccacccaacgcaggcactcagccccaggggcatatgcagagagagggtccaggaggagctgggctgcaggaggtgattagggcctcttagggaatggtaagtgaccatccaacgcaggcactcagccccaggggcatatgcagagagaggctgggaggacactttcagtgactggggttacaaaccccaaccataagacattgctggctctgtgagccgccacctccagaaatctcccacttagttcttagcacttatccactcttcccttttcctactctcaattcctggaggatgccctcctttctcaggctcagaccaacctaccagctccactctagacctgaacacatgactcctccctctgtctccacctggaaatctcatcagtgcctcacatttacactcctgaaaatcaggtcctgcctacccaccctcttgctccacctgattcctgccctgtttcagccagagaccttgcagtctcctttaactctcaaacccacccatgtcgtgtgagcatactgactgtgttctatgcaagaaagagcagtttcttggtggtcctgcggttttattagtccagaggcaaagcgttggcagagctggtttcttctgaaccctgggagggagattctgttttcatgccttttccagattctagaacccatattccttgctctgtgtccccttcttccatcttcaaaggccatcctctcatctctgtgtccatcatcacatcacccttcccctgactctggttctcctgcttccacttataagcacccttgtgattacatcatacccacccagacaatgcagggccatattctcccctctcgagattaatttaatcacatctacaaagttcctcgtgccatatgaggtcactaaaccacatgttctgggggtttgaatgtaaacatttgggggatgcattattcagccacccacaagcactgctccccactggccacacactatgcacagccgagatcatgcaagtgaggcacgttcatcaacagcagcttcagcaggaaactatatgctccactttcctgccatttgtatctggatttttttttcgctatcattgtagaaagagtggtattgtaaaattaaagatggattattttctttctagaacactttggcaatctatccaacattatttatccccttctgagtgtcaagtgtgaggtcattctttcattgagagctcaatgcctacaattatgataatgcatattgggtactttcacacatcagaaagttcttctttcttaaaatctgttcttgaattattcattcttctctagctttttgttgatctattttataattttagaaaaatcagaaagtaacttgaagtatctgtcatctctacaggtttacctccctctttgtggccttcagaatgtcatgacacgcttttcccttgctcatcacatggtttctatgtatgagacctcatcacaggagctgtggtcccccgggagcaggcatctgtggatggtgccttgctcctggctgctgggacctgtgtgctgccagtggcactccacgacagtgatttcccagctcagttttgcagctccagatggtgggtgagacactaggaccactttgtgaacagcgagggcttggggtttgcttttctaccatgtccagggctgctgttcatgagggaatgtttctaacctgacatcatggctgaagccaacttagaacctctctagccgtatggggagtaggtgagtgatacagatgttaattagctcagtggagccactcccctatgtagacatgttacaaaacattatgctgtacagaataaatataggtcatttttatgtgtcaatcaaaagagaaactaattatttaaaaaaaaaaaaaaaacctctctactcaagccgaaacctcagctccagtcccacaagtcacacaaggctgctcccgtcctgtgtatgttaaacctacctcagaaatgcaagggggcattcaggtttcattctcaattcaaatgccctttttaattttgtctattcctagcacctggcaacttccagctctttttttcggggctcattcattatttaaagcacgtataatttttcacccacattctaacacatgtagtactgtagagaatccttccctaggaggatctacagcattagaaaagaattaagaactccaatatttacaagaaggaaaaagcaaaaagagatcaaaaaatgggcaacttctagaaatagaaaaccctcatgagtatgatgataaatcgctggcacacatgtgaatagttacttgatgcttatagtgatgtctgggaaaataacatgaaatacttataatctgtttctcacacatgtaattcaaaagaatagagagaagatgatttgaaatattcttaagtttgtaggaaaaaagctacttccatatgcataattgcatgtattttgatactgccattattaagaactatctaagagggtccattaaaaataaaatttcttggctgggcacagtggctcatgcctgtatcccagcactttggaaggccgaggcaggtggctcacctgaggtcagaagttcaaaaccagcctggccaacatggtgaaacgctgtatctaccaaaaatacaaaaattagctgggcatggtggcatgcacctgtagtctgagctacttggggggctgaggcaggataatcgtttgaacccaagaggtgtaggttgcagtgagctaagatcataccaccgcactccagcctgacagacaaagcaagactctgtctcaaaaatattaaaataaaatttctcattcctattacagagtaatttaattcattaatgccctgccctgttacaaaactcatttgtaaaatactaattgtaattgtgaaaaaatggcaattgatactaattttaaattctaaaaacagggcacccatattaaagattattctgcagtaagagaattagctataacattttgtaataaggtggagaaaacattctccaacttacaatggttggtgagaagaaagtttccagcacggtagatggaccctaagagcccttgttgaaataataagacaaaaagatatacagagagatgagccagatgaagggagacagagagagagagagagagagagagagaggcacagaaatgagagatacaaagtgaaagagggcaacctgtggggtcatcagatatttgttttctgttttgtttattctaacataaaggcagtggtgggtcatcgatgtatttagagtttgcacaatcactgtggaacacagacagacacaggggaagaggagaaacacagggcggtggcttgcccttggactgttcttagttcctcaaaacgtaacagctttgcccaacctaagggaactttcagcagctgctcttctgccataggcctctttcctgccttgttttcatgtggctgactgtttctgttcctgcaggtcttagctcatcagacaggcatttattacctctgtgtcaacagtgggagcttccattactctctagcatgacactccccttcctcttttaggaaatttaacatggaagtgagtttgccatcggccttctccccacagtgttaacagtggtgaggaagccagcctgttccaccttgcccctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaccgcggatcctctccctatagtgagtcgtattagcggcc

SEQ ID NO: 10 - DNA, 202662 bp, Artificial Sequence
  Description of Artificial Sequence: Synthetic polynucleotide
  Annabel
  modified_base (151214)..(151343): a, c, g, or t
  modified_base (183232)..(183281): a, c, g, or t
  modified_base (194855)..(195259): a, c, g, or t
  modified_base (198416)..(198423): a, c, g, or t
ggccgcctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaacttggctgagggcttgcaaaacctgtggaattctcctgttgcaagggctgtagatgtttgcagtggcagtgggtgctggcgggaaatctgcttaccttttccctacatgggaagtccctcctgtgtccagaccaatccgatctgggtggggaagacaaggctgcaaaggccaggtgcctccatgctgccctccgatcaccacgggtgcgtttccacacctccactgcactccgtcagtctcccttcaacactccagtcaaaccttagctgtttcttctttgccttattccttcctcatggggagggtgtgggtgaacaccaggcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccaggttgggaggcattggtttgggtggtggtcaggaagggcagagtgatttgagtagggtctgagtggataatagctcatcagtttggaatttataaatgaccagggatgatttaaggagattcctgccagacacctatgccatggccatgccctatctggatctccagccgtgagatgagaacccagccatgcgggggagtctgttcgttctgctcaatgttgtaagtggcacatgctattggataatgtagaattgaatggatatcattttattattataatttacaaacttcctacaataaacttatcacctttatacatagaaacaaatataagtacattttccctcccctatgtcattttgagccctctctccaaaccatcctcccactctgcgactcactgtcctgcatttggctatgctctggcaagtcctgcttagacaagcactcaccagaccacctactcagcctcccttcagcgcccacctggcccacctgctcaaatacatgttgagtggtcacacacatggactgaacaccatctattccatgcactgccccagtgaccgcactgagcagcaagagagaaatgatcgcattagctatcaattatgccaattcaaatgctggagtctttctcagatacttttcaatgttcaagaattgttgattgtgaattctatacccaatgaaactatccttcagaaatgagcagaaaatggataccttctcaaataaacaaaaactaaaagaattcttgctacaagatgtactcttaaagactggctaaaggaagttcttcaaacagcaaggaaattgaattgatcttatgtcctgcacacttgctaaatttcctctcaattttagcagcactgtttagattccataggattttccatacaaacagtcatgtggtctatatatagagacagattttcctcttttccagtggggataaatttatgtctttttctttctgtgttacagcaggtaggacctccagtacaatgttaaacagaagtggtgaaaacagacattcttgcctgtttcctaacgttggagtttggtcttttactatggtgtcagatgttagctgtagggtttttataaatgcccttcatcacattgaggaagtttgctcctatgcctaattttctgagagtcttttaatgtgacactcatgctagaatttattaaatgctttctgtctactaagatgattatgcagttcttatattaacatgaataattacatttatttattctttaatatcaaggcaattttgcattcctgagacaaaccccatttagtcatcatgtgttgttattgttacatattgttggattcaatttcctcaaaatttgttaagaattgttacatctatgtttacaaggaagattagtctgtagggtattttttcttataataactttgcctagttttgcaatcagggtaatgctggactcacagaatgagttgggaagctatttcctcctcttcatttttctgaaagaatttgtataaaattggaattatatcttccttaaaggtttgcaagatttcataatgaagtcattggcctagagttttctttgtgggaaagtctttgtttgtttgttttgtggtttgggtttttttttaagagacacagtctcactctgttgcccaggctggaatgcagtggtgtaatcatagctcacagcagcctcaacctcctgggctcaagcaatcctcctacctcagccttcagagtagctgggactacgggcatgtaccaccacacccagctgtttgtttgtttgtttatcgctttgtcttgtttttgaggtcttattatgttgcccaggctggtcttgaactcctggcctcaagtaatcctcatgcctcagcctcccacagtgctggaattacaggcatgagccactgcacacagactgtgggaaagtttttaactaaaaattcaattttctcttccttttccagtgagctttccagtgtctttcaattaatgtatctattttatctaagttgttgaatttattgtcaaaatttttttaaacaatattcctctcttagaggttgaacatctgtagaatctgtagtgatggcacctcttaaatccctgatcttgctcatctgtgtcgtctctctttctctaatcagtatgcctaaagtttaatttcattgattttcttaaaaaactggttttggttttattgatttttttccctagttttttgtgttacatttcattgacttctgctctgatatttactatttcctttctactgcctacagtaagtttaatttgctattttcttagtttcctaaagtggaagctaagtttattgacttgaggcctttcctctgtctggatgcggatatttgctgctaaacatttccctccaacaccatgctgtgagttttagttacagcgggcttggagttggcctgagaaattctacttaaacagctgcacctatcatgtaagtgataaatgatgtacctgcctggccctcacccctggtcaaagaatgggatgtactaatgagcaatgttgctgcgtagctgtggatttcaaggtattttctgtgtggttttatcatcagcattgtttgttgatgactgcaagactgatgatttgcacctggcctcggtgagatccccgaaagaccctgcagatgggctggttacttagcagaaaatatgacaacgtggccagcaggaaacaggaaggtacaatcggctgcaggtgagctgttggaagtaagttccaattttcctattttgtatttgcattttaatagtgagactgcgcttatgttatttgtgtgaaacagctttattcatagcactgtaatttaaagagaaaacccattcatgggaacaacaaacgacctagacaccaaggtagctcatgccatccaaggctatactgtgcagtgattgggaaaatgggcactggtcccagaagtctgatcgacactctgccactggctagtcccgtgctggggggcgaggatccacactctgccactggttagtcccatgctggggacaagtatccacactctgccactggctagtcccgtgctggggggcgaggatccacactctgccactggttagtcccatgctggggacaagtatccacactctgccactggctagtcccgtgctggggggcaaggatccacactctgccactgattagtgttgtgaagatttaaataaagaacccacaccatattctttgacttgtgctttccgtatactgagagatagtaagagtacattattattatttataaagtaaactagaaagcacatgggaagacaagaagaaaacctgaataaacatgaattaccccattttcctcaggagaaaactttcacactctgaaggtacacaaattagcctacaaatttaatgtaaagcaaatagactgttgtaggtaccaattctcaatgtcacagtgttacatggaaagtaaaatacacaagaacagcccaaaagatggaaacaatggacgtggtcaaatgacatcagtacaacatccatatggtcctaagtagccatctttaaaatgggttagaaatgccttcaatcattcacacagacacatgcattgaacaaactctaagaagtgttcttacacgggaaaagcaagttacagatgcatgggcatgatatggatgtagatgtgtgtatgtgcatcccactcatacacaaaatacccagcatcgcccacatgcctgctgtgtgcgtaagtgtgagcgagtgcacagacaacagcgtgcagaaattcaaaccaagctgtgggtacttgttaccactgggaagggagtcggtcacagagggaaagagaaacaggacatcagcctttgacttcagaactgttcctgccttttcacatcctgtgctgttttcagcatcatcggagcccttaacacacatcacgggagtaagagtgtgttagagggagcattcggtgggacagatattgccatggcttgtggatagagttcacagtccttaataatccccgagatggcagccaagagctacgttctcaatcacgcagcttcaccccagaaactgacagaaacccaacaaccaaaaggtgtccattctgacagcctcagcctgtgctggctcagatgagcaaaaatgtacagatattaataatgatgttgatttgaagagcacagaggggggtatgcatgataagggtccaaatttttaccttaaaaaagaatacatttacttctcaatcacctacataacgatcattttttaaaaaactgatcaaatttggtgttacaagggcacgttgcaaattcttctggctacttttctctgactattctaattacgttaccgtgttttctcctgtatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatttctggctacttttctctgactattctaattacgttaccatggtttctcctatatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatccaggcagatttcccaaatccggcttcctgtaaccaagggctgaaagagggaacggtttcctgggaatcctttttgcagtttattttacccggaggcagaagcccacggttccgtgaagagtctattgctctcccctctctccttttgtgtctctatttttaattgacaaaaaagcaaatgtgaagattcctggggtacaatgcaaagtgacaatgcctgtctatattgtgggatgattaaaacaaggtaagtggcatatccatcacctcacacacttatcattttgtggtgagaacatttaaaatctcatcttttagcaattttgaaatagtcattattgttaactatagtcaccatgctgtgcaacagatcaaaagaactgactcctcccatcagcagaaacttcatgccctttgaccagcatctctcctttccccgtccacgactaacccccagcccaagagaacagccaacacccacctcgctgctgccacacgacatgtcgggctttgatgggatggaggtgagggtggggaagacaattccaaagctggagcactggcctcacagctcagacactcttctacttatcctgagagaatgatgtgctgagaccaactaaacctcccctgctcttcccacatggcagaaaagaggcaacccagggaagccattgccaggacatcatggtcacccaacccttgtgcagaaaggaagcacctgcccaggatgccatagcacccaaccctcatccccaaggaaacacagcccagggcaccatggacacccaaccgtcatccccaggggaggacacagcccagggcaccatggacacccaaccctcatccccaggggaggacacagcccagggtatcttggacacccagccctcattcctaggggagtacacagcccagggcatcttggacatccaaccctcatccccagggaaggacacagcccagggcatcttggacacccaaccctcattcccataagagcacacagcccagggcatcgtggaggcccgaccctcatccctaggggaggacacagcccagggcaccatggacacccaaccctcatccccaggggaagacacaacccaggccaccattaacacccaatcatgtgcagggagggtgtccttggagcctgggactcttgccagtgaagcggtggacaagaaactgaggatgcgatcagcacacagaaatctcaggcagcctaggatacatgaggcctctcacccctgggaacactgagcagccaccaggagcccacaccttgaggtacagcaggagccatgcgctcttgctcttgctcactcacactcctgcacacagccactgacacacgccctcgtgcacgttgcagattaactccactggccttgcacttgcaacgctggaggctgagaggtatccccaggttcttttctcgtgagaggggcaggctgactttcactctcctccatgtgctagaggcagctccaccaacactggctgccctgagtggatgcacctggctctggaattcctgtcatttgctttggatccaggagcccctgcctcatgtagctacttaacagaaaggaggaatccacccaggacatgcccagacgggagcctcacaggatggacagtggtgtctggggtcacgggcagccctgacccagcagcgccagcaccagcacacccagtggggaaggcggggaggcccaaacgccacccacagtttgttactccactgggtgggacccggcacccctgccttcctgacaccctggagtccctgcctcctcctagagcccccaagcccatctgcctcagagcatccagagacagacctggggagccatttcctcaggccctggacaaggaaacagggaattccaggttatgggtgcctggggcaggtctcaggcaggtgctgggaaccagagagaggggtcaccgcgaggcctcaggcctggcaccagcactttgagcctcagtttaccagcccacgaggtgctgagtctggactggatgaccttcccacccccagtgacctctgccctttcccgagcatgtcagctctgctccagcatcctggtgtgagcgcaatgccactttttttctcaacaaatacgaaaggaggaaggtgcccccagggccctgtgccctgaggatgcctgtgtggaggggtccatttcatcactggtgtcactcacaggaagggacgaagccacctgccttgacggagcttactccacctccgccgaaggccggggaggtccctcacagagaacctgaggcccagcaggctgcagaggtgctggcatggaatgactgctcagacgcccggggccggcagagaggacggatgtgggggaggtgcacactgaggagcctctccttggaggtggagacacgtgcaccacatggaccaggacacagtccacgaagcctcgcatccccctgagctgcagctcaagggcctctctctgagcccagagtcccacccctgggaggcagctgccccagctctgagggaggagggcatccaccaggccctccatctcctgggggcaccagcccagcccagaggctctgcaggactctgcacctccaattcatggccaggactttctggatgtatcttaaggactgaggactccacatcagggaccacacaagaccggggtcccggacacgggggttgggggtgagcatgtcaccgggatgggctgtggcgtcactctggtacttcatccggacagccagggaccaaagccacgccctcagccccaccccacccctgcctcacatggcaacgcagggtctgcagatgcaggagagtgagaagcatggtagccaggcagactagaggacccgagctggggttgagcacctccctgtctacccagggcatggcctgtgagactgcaggtggcctagtgtgtgctgcaggctcaaggtcctgccccagggagcatgacattcaggcccagaaattgcatcgtgctgcacacagtccaaggggataaccctgtgaagttcaggtcaccagcaggcttggggtcaagaccgagctgcagaggacaggtttctggaaggcacagcatcatgggtggagggacttggagcaaggtccttagccccgggaccagtgaatgtgtgcccttatagggaaagggggtctgtgcagaagcaagttagctgaaaatcatgaagtggagaggctcccctggattaaaggggtgagccctaatgtaatcacaagtgtccttctaggaggttggcagagggagactgacatagacagaagccaggtgaggtgggaagcggaggcagaggccgagagagcagacgctacgccctggccctgaagacggaggaggagccgagagctcagggatggagagactggaggaggcagggaagttctccccgcaagcctggagggagcatggcctccagcacccccagaccttggccctgcaggattcatctggacctgtggtataaatggtgtttaagccactgggctgtgcaaattgtcatagcagccatggcgcattcctagagggagccctggtggggacccagcaggcagcgacggggccctcacaagcctgtgagccactcagagccgcgagagtggctaggcttggtgaggtgcaggccacgcgcacctccactaaggcagccttagggcccacacatcctctctctctctctctctctctctctctatctctctccctccctccttccctccctcccgctctcttggttggacagctctccatcatccccctggacacgaccacctcccaaggccgagctggggcgctttgctcgaggtgagcactgacatcctgggggtgtgaggggcacctgcccagcggccccgtgtgcaggatgggcggtgggccctagctggcactgggcatatggcccggctggtgcctgcaggctgcagcttttctggggtggctgggatcagtgaaggcctccagagtctgggcctgggatccctgcagtgctggctgaggacaggcggggctgggcagtgagggcactgggtcactatcaccacccacggtttattacttcactaggtgggacctggcacccctgccttcctgacaccctggaatccctgcctcctcctacagcccccaagcccatctccctcagagcctccagagacagacctggggaggcatttcttctgcccccagcagaagcccgggaggccgggaaggcacagtgggtctaaaggagaggatcccaggactgcctgaggggtgactccgacgaggcaagcatagagcccactgagaagcggggtgggagccccaccagggatgggctagttcctcatgaaggaccaggacccaggaaggacaagggggcctgctggggcagggtctgctatgccggagtccctgtgagcctggcccagacctgcctctctctttcctcattggtccccacaggtccgtggtggttgccgtatcgggaggccccatggtggcaggggtgggacacctggtatacgtcgccaggtgtgtccaataggctcatgctcacaccttctcctggcacctgggcaaagcctgagcacccaggcactgaagtgagggcaaggcctcggggccccacaggatggccgaggagacagctgcagggcgcctgggacccctgggctcaggaggtagaaggatacagcctgaaaacccacaccacaagctcaccggccagtgcaggcccacagagctcgaggaggcagccctgagcctcccagggagagatgctctgtgcacgccggcacaggccctgggttacaaaccctaggcacagcccaggagaggcccaggccccagtccagcaaggggttgcaggaagcaagaggtccccggccacagcatgagataagcccatcaagccagggccaggtgggcaatgggaggcaggcagggcttgggggtgagtccctgctgcagcgccgtccactgtcgaccggaggagtttcttccctgtgcggagtccacgggcctcctgtgagtgtgtgcatgggcacaagtgtgtgtgtggctctgctgtgtgtctgtacacacgtatgttttgggtttttttgtgtctcagaccacagagtctgcccctcccaccaaagcccaggcagaaggatgaacccacgcccctggggcccaggcctcagcagcctctgcaggatcattgttcccagttgtcacttgcctttgccacagccctatttctccacaattccttaaagtcctcaacatgcatttaaggcacaaaggtgaaactgcccagaaacatctgactccgccgtggaacccaggagcaagctgggttagctaaggagcggggccgttggcagaggctggggatccaggctgaactttggaggaggcatgtgccagcatgggctcctgactatgtcctcctgggacaaacccaaacccactctttgaatatgggagggactttgctggccccggccctgaccgcagcacttggaaactgaggagtggtcgcctcctccgtgtcacagctgcccgttcaccatcatagaagcaactctgtcacctccatgggcccctctgtggctgctgcctgggtccaagctgagcccagctgcccaggcccagaaggaaagcccaggccaggtgcccagcacagaggcagtcacataccccggggagagccacagcaagcagccaatgttgcccaggagaggagtagctgacaaggtagaacgtgagctgccatcggctcgagaggctttgctggtcctcctggggctctggacatgaccaggaggagcgagggaagaagtcgcatggtggtcccatcctgggtggggcctgatggcagctggccacccgtcccagagtggcagccagatgccagcgccattcccacagtcacatcattggtcacagaatgcaggacatagagtgtcttctttccatcacagtgctgtccagacccatagcctagggtagacctggaagattcaatgtccacacccggggctggagcgtagccatgagccacgccccctgcccgtgcatggaaagccagcccaagctctgctccatccctagccaaagtcagtgtcctttccccttctcccaagtgagctctagccacctgcctaccctgccatctgaggatgacagccttcattccattggaacctggctctgccaccagcaggcttgcagtcctgggcagactccgtcacctctctatgcctcagcctttccatctgcacaggaggaagatgatgatggtggtgatgatgatggcgatggtttccttttgcatctgaggcaaggactaattgagatgatacacatcaggcactgggtatggtgctggtccttcctgagcactcaatctatgtgagctgtccttgtgaaatgggtgtcaccacatttccccacgcagaacatcctttgtctgccatacttgaaacatctgccccaatattaacagttccttcatggaagatgtgcacacccacccaccctcatactcccaaaggtgcccgtgctttatcaagccaaagtccagccaggaactttacagcagcatccctttccctctccaagcaccaaggagcaaggcaaagcactacatcttccatctggaggcaatgccaccctcttctcccattttcactgccatccctaagaggcagtgcttccccaaaaggttccatagcagcctgcctacagcaactctgttcacacgagtttcagcatccttgcagtggctcccctgccatgctgtggctcttcattcaccctcttctcctgctccccgtgacaggcatagattctgagtgatctggatacattgctttgtttaataacattacagcttctgtgctgaaaaagatacagcagatagagaaggcaattgttgaacacaaaatagtgacagcagagatgacggcaagttggcatttttcttttctagcaataaaacttaaagctgactcaaggagaaatggaaatcataattggaacagtaatcctcaagaaagcattaagattattaaataattgccctcacagatgacttcaggccaagatggctttatgggtgaagtttagactttcacaaaactaatcagttcccataagaactgctccaggatttggaggaacatgggaaagtctattaaagggatcacaattcacagtccccagagtaaaacatgggctaacttgcattttggcaaagagccaaatgttataaatgacatcctagaaggccaaattctgtccatctcgttgaacaaggacttacaccaggaatttagaactatttatagctcatcccaccactcaggccaatgatgacccatgatcatctcaccagaaatggaaagactcagatgattaatagagtctcaatttctctgagacatctaagagcccagcccaagcccagacccaggagggcacccaggcctggacagagaacactgatatcacaccagccctccagagggaagcagagactccttcaagctctggaaacacaggcccagacagctgcctaaagttgggcaggcttcactgcaaacccaaatcatgaagctaggtaacacctttacagattctttacatttaaaaatcatcaaaacaagagtaaataataaactcaaataatattaatctaatatgtaaaggtcttgtaccattattatgcaaacaacatacataagctaataagaaaaagaacaaatcccttaagaaatcggcaaaaaggatataacacaatttctaaaagaaaacaaatggctagcacacataaggaaaacactttgtgaacagacattcttcagaacattatttataattataaaatagttgaaagcaagatagtgcctgaagaaattatggtgcatacattagtgggactattctgcaaacattcccaattatacttgtcacatatctgtgataacgtgacagccagcattcatggggtgacctcatttggtaaaagggtgcaaagctcaacacgcattgtgagatgactgtggtgtaaaattagtgggattattccgcaaacattcccaattatacttaccgcatatctgtgataacatgacagcattcatggggtgacctcatttggtaaaagggtgcaaagctcaacacgcattgtgagatgactggtgtaaatacaaagaccaaactgtgaaaaggagtccatcaattaatcgatgcttaccttcagttttgggctaatttttaaagtatgctataagcatatgctcctgttataacagaatggagggattatgagagatgatgcaggtgtgtcctgggcctcccctggcccactgggccctagagatgccttcccaggcatcgctgtcagggcttccctcagagggagtcctgtattgacctcaccaccaaggtctggagcaggggatccttagatattggttggggttatctcaccttaggtctgaatttggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccaccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggcgagggtctagtgcaggtgcccaggacaagaaagattgtgaatgcaggaatgactgggccacacccctcccgtgcacgccccctcctgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactccacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactctctcctggcccctgctggaggccgcgccagagaggggagcagccgccccgaacctaggtcctgctcagctcacacgacccccagcagccagagcacagtggagtccccactgaaccccactgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgccccggtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccctggtcctcactaggcctcagtcccggctgtgggaatgcagccaccacaggcacaccaggcagcccagacccagccagcctgcagtgcccaagcccacattctggagcagagcaggctgtgtctgggagagtctgggctccccaccgcccccggcacaccccacccacccctgtccaggccctatgcaggagggtcagagccccccatggggtatggacttagggtctcactcacgcggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgctcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccctgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctccaacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatgcccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcagaacatatgtttgtcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaagagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacctgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaacctgctgccacagccctccctgtggggcaccgccgcgtgccatgttaggattttgactgaggacacagcaccatgggtatggtggctaccgcagcagtgcagcctgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggccggcccacattaccatttgctgccatccggccaacagtcccagaagcccctccctcaaggctgggccacatgtgtggaccctgagagccccccatgtctgagtaggggcaccaggaaggtggggctggccctgtgcactgtcactgcccctgtggtccctggcctgcctggccctgacacctgggcctctcctgggtcatttccaagacagaagacattcccaggacagctggagctgggagtccatcatcctgcctggccatcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccgccagctgcaccagaccccgtcctgacagatgccccgattccaacagccaattcctggggccaggaatcgctgtagacaccagcctccttccaacacctcttgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaagaccactcatggagcccccagccccaggtacagccatagagagagtctctgaggcccctaagaagtagccatgcccagttctgccgggaccctcggccaggctgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccatgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccagggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtcctcgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcacccccaaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccatctgctctcctctcatcaccccatgggaatccagaatccccaggaagccatcaggaagggctgagggaggaagtggggccactgcaccaccaggcaggaggctccgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcccatctctctcacccacggactcacccacctcctctccaccctggccacacgtcgtccacaccatcctaagtcccacctacaccagagccggcacagccagtgcagacagaggctggggtgcaggggggccgccagggcagctttggggagggaaggatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggcaagacccaaaagcccctcagtgagccctccactgcagtcctgggcctgggtagcagcccctcccacagaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccatggcaccctgccatgtcctgcatttctggaagaacaagggcaggctgaagggggtccaggaccaggagatgggtcccctctacccagagaaggagccaggcaggacacaagccccctccccattgaggctgacctgcccagagggtcctgggcccaccccacacaccggggcggaatgtgtgcaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacagtgtccccactggatgggaggacaagggccgggggctccggcgggtcggggcaggggcttgatggcttccttctgccgtggctccagtgcccctggctggagttgacccttctgacaagtgtcctcagagagtcagggatcagtggcacctccctaacatcaaccccacgcagcgcaggcacaaaccccacatccagggccaactccaggaacagagacaccccaataccctgggggaccccaaccctgatgactcccgtcccatctctgtccctcacttggggcctgctgcggggcgagcacctgggagcaaactcaggattaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatggacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgtgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggccacatgtgtggacactgagagccctcatgtctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggccatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcctgccccagagcccaggaggctgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggccaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcaggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccctggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaagaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgcacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggcctggcggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacaattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcctgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcctgccccagagcccaggaggctgcagaggcctctccagggggacactgtgcatgtctggtccctgagcagccccccatgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggtcactgttgtctgtactctgccctctgtggggagggttctctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcaccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacacagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcagcaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggctcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtggctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccgccctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgccgagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccacgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcggcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccagaccatagggacagagaccagccgctaacatcccgagcccctcactggcggccccagaacaccccgtggaaacagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctggggctgaggggctgggggagcatctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctgagcagggccttttgctgtttctgctttcctgtgcagagagttccataaactggtattcaggatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggacaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgactggactcgcagggtttatgcacacttctcggctcggagctctccaggagcacaagagccaggcccgagggtttctgcccagaccctcggcctctagggacacccgggccatcttagccgatgggctggtgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctctcttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggccctctccttatggttcccccacctggctcctgccgggacccttggggtgtggacagaaaggacgcctgcctaattgtcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccactgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcatccaccgacccgcccacctcctctccaccctggccacacgtcgtccacaccatcctgagtcccacctacaccagagccggcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaatggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcttcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagccctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcgcttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaagacaaagaaatttgtttttttgaataaagacaaatttcatcacacgaagataaagatgcaaagctccagacaggaaggcacggacagcacagtgaagcctggagcgggcgctggggggccaggggcatggcgggggtgccagcgtctctcagtgcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgtcgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagagaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagcccagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttgtttttgtttttagacggagttttgctccagcccaggctggagtgcaatggcacaatctcagctcactgcaacttccacctcctgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaaggcatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactagcataaaaacagacacagagacaaacagaacaaaatttaaaaacccagaaataaatccacacacctacagcaaattcatttttgacaaagttgccaagaacatactctggggaatagataatgatatctcttcaataaataatgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttactacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataaaaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccaacctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcccccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagcgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcagggcacctcccctgcccccagacaccctgtgcccatcagttcatccccagcagaggccctcaccaggcacacccccatgctcacacctggccgcaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttctggggggaaataagggtgctgggtctcctgccaagagagccccggagcatcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcaggtaagaatggcctctccaggtctttatttttaatctttgcctatggagttttcagagtattgcatactaaccccggagatgtgtcaagctggccgggagaagctagggactaaactgcctaggggatctcagagccttggggataaactaagaatctctttgatggtgttggtagagtccctaaatgatggagcagggattttggagcctcatttgagggagatgctaaaaagattccatggctaaagggatagtttgggctgtggttggagattttcagtatttagagtaatagtgttagctgagaaatataattcaggaccctctgagacagcatctgtacagtatctgatgcacagggacaaagagtggagtgggacactttcttcagatttgtgaggaatgttctgagtagattgtttaaaacatcatttgttgaaaagagaacttttagtgaatcaatcaaggaaggaaggaaggctcagtctcaaaagggtagctgatatccagaggaatctggataagcctgcaaaagtctagctttcaaaggaatgcagaagtatgcatgtggaaaattagaagatttttttttacccttaaagtggttcctatgatagttagaatactgtgactttactatgtgagagagttttcaagtattcacttttttttttaaatgtccaagtacgaaaaaattttgtcagtttgaagtcaggtttgtacagaattgatattgttgaaagtttaaccaaagaatgggaatgaggctctttcacaccctattcagaactgacttttgacaataataaattaagtttaaaatgtttttaaacaaattgagcaatgttgagttgcagtcaagatggccgatcaggaccaggacacctgcagcagctggcaggaagcaggtcatgtggcaaggctattttgggaagggaaaataaaaccactaggtaaacttctagttgtggtttgaagaagtggttttgaaatgctctgtccagccacgcagaactgaaagtccaggctgagaaaaacaacacctggataatttgcatttctaaaataagttgaggattcagtcgaaactggaaaggtcctcttttaacttagtgagttcaatcttttaattttagcttgagaagttctagtttccctcaaacttaagtttatcgacttctaaaatatattcattttcaaaattaagttatgtaaaaaaattgaaggacttcagtgtctttaatttctaatgtatttagaaaactttttaaagttactttattattcttccctctgattattggtctctgttcaattcttttcccagtacccaaagcatttacagtgactttgttcataattttttttaagttagttgttttctgccttactattaagactttagcattctggtcgaagtggcttcataaatctttttcaaggccactttttaggagaaagacatcttttttttaatgaatgcaattatctagaattatttcagttaaacatgttagttggtggttgagaggacactcagtcagtgcagaaggtctgtaagccagtccacagagacattcctgggtgaactccctctggccctgcttcttgttggagaactggccagaggtctgagaccaggctgctgctgggaaggcctggactttggtctcccagtaccgcccagacctggggatgtatggttgtggcttctgccacccatccacctggctgctcatgaaccagccagtcttgatggctttgaaggaatgattccacacaaagactctggacctccctgaaaccaggcactgcaaacggtaagccagcggcagccacagctgtggccgctgtccttaaaccttgtaattgtttctgcttgattgagtcttaagtcattgctttaggaggagaaagagacatttgtgtcttttgagtaccattgtctgggtcactcgcatttaactttccttgaaaaacttataagagaaaaacgttgcctgttaaccattaactacagggctcgtgatactttgagaaaatcttagaaaaaaatgtatacagttgtctggaattatttcaatgaagtgtattagttggggtactggcgctgtctctacttcagttatacatgtggttttgaattttgaatctattttgtctcttcttaagcaccaagtatagatacagtggatacactcactggtttttaacggtggttttaatctagaaggaatttaaactggaggctaatttagaatcagtaaggagggacccaggctaagaaggcaatcctaggattctgaaagaaaagatggttttagtttttatagaaaacactactaccattcttgatctacaactcaagacggtctaatgaattttgaagttactggtaaatatacttcctggttgttaaggaatgattatcaaatggatcagtgcttggatctgaggtcagtgtgagaggacagggcctgggctgtggatatacagaaggaaggccacagctggatagaattgaaaaagaatggagacctgctgctgaggcaagcagatcagccggactctttccagccatagcaaagaaccagattaataaagagaaggccagattaataaagcttgctgagcaaaatttagtgaacaaggttgacagcctggctaggaagctaggctctagttaagcacagttggactgagatgtgtaggcttccctgagcccttcaaaaatgtgctaagctgagatgattactctgaggtagccaaagctggacttgagcaggaacgaggtagactgcaatgagctgaattgagctaggccggctaagctaaactaggctgacttaaccaagatagccaaattggaatgaattgtcttgatctgggctgattggagctaaactctactggactgctctgaactgagctgtgttgggctgtgttgtgctggggtgagctgagctagcatgagctactctgtggtagctggggtgagctgggatgagctgagctgggtgagctgagctgggtgagctgagctgggttagctgagctggggtgagctggggtaagctggggtgagctgagctgggtgagctgagctgggtgagctgagctgagctgggtgagctggggtaagctggggtgagctgggctgacctgaggtggttgagctgagctgggtgagcagagctgaggtgagctgagctgagctgggtgagcagagctggggtgagctgagctgagctgggctggggtgagctgagctgagctgggtgagctgagctgggtgagttgagctgagctgggtaagctgagctgagctgggtgagcagagctgggggtgagctgagctggatgagctgggctgaactggggtgagctggggtggggtgagctgggtgagctgagctgggctgagctgggctgagctggggtgagctgagctgggatgagctgggctgagctgggctgagctgagctgggctgggctgagctgagctgggctgagctgggctgggctgggctgggctgggctgggctgagctgggctgagctgggctgaactggggtgagctggggtggggtgagctgggtgagctgagctgggctgagctgggctgagctggggtgagctgggtgagctgagctgggctgagctgggctgagctgggctgagctgagctgggctgggctaagctgagctggactgagctgggctgagctgggctgagctgagctgggctgggctgggctgggctgagctgggctgagctgggctgagctgagctgggatgggctgggatgagctgaactgggtgagctgagctggggtgagatgagctgaacagggctgaactggggtgagctgagctgggatgagctggggtgagctgagctgggtgagatgagctgggtgagctgagctgagctgggctgagctgggtgagctgagctgggtgagatgagctggggtgagctgagctggggtgagctgagctgggtgagctgggctgagctgggctgggtgagctgagctgggttgagctgagctgggctgagctgggctgagctgggctgagctgggctgagctgggctgagctgagctgagctgggatgagcagggctgggatgagctgggctgagctgagctgggatgagctgggtgagctgagctggggtgagatgagctggggtgagctgagctggggtgagctgagctgggatgagctaggtgagctgagttggggtgagctgagctggggtgagctgggctgggtgaactaaactagggtgagctgggctgagctgatctggttgagctgggctgggtgagctgagctgggtgaactgagctggggtgagctgaactgagctgggtgagctggggtgagctgagctgagctgggtgaactgagctgagttgagttgggtgagctgagctgggtgagctgaactgagctggactgagctggggtgagctggggtgagctgggctggatgagctgagctgggtgagatgagctgaacagggctgaactggggtgagctgagctgggatgagctggggtgagctgagctgggtgagatgagttggggtgagctgaactgagctggactgagctggggtgagttgggctaggtgagctgaactggggtgagctgagctggggtgagatgagctgaacaggtctgaactgggatgagctgggatgagctggggtgagctggggtgagctgagttgggtgagctgagctgggtgagctgagctggggtgagctgagctgggattagctggctgagctgggatgagctgggtgagctgagttggggtgagctgagctggggtgagctgggctgggtgaactaaactagggtgagctgggctgagctgatctggttgagctgagctggggtgagctgggctgagctgggctgggtgagctgagctgggtgaactgagctggggtgagctgaactgagctgggtgagctggggtgagctggggtgagctgagctgagctgggtgaactgagctgagttgagttgggtgagctgagctgggtgagctgaactgagctggactgagctggggtgagctggggtgagctgggctgggtgagctgagctgggtgagctgagctgggctgagctggggtgagctgagctgagctgggctgggtgagctgagctgggtgagctgagctggggtgagctgagctgagctgggtgagctgggctgagctgagctgagctggggtgagctggggtgagctgggctgggtgagatgagctgtgctgggctgggtgagctgagctgggtgaactgagctgagctgagttgggtgagctgagctgggtgagctgagctgggctgagctggggtgagctgagctgagctggggtgagctggggtgagctgggctgggtgagctgagctgggtgagatgagctgtgctgggctgggtgagctgagctgggtgaactgagctgagctgagttgggtgagctgagttgagtgagctgagttgggtgagctgagctggggtgagctgaactgagctggactgagctggggtgagctgagctggctgagctgagctgggtgagctgagctgagctgagctgagctgagctgagctgggctgagctgggctgggtgagctgggctgagctgggctgggtgagctgggctgagctgggctgggtgagctaagctgggtgagctgggatgggtgagctggcctgagctgggtgagctgagctgaaaggatctgggttggagtcagctttgcttgggtgagctgagcagggtttagctgagctaggatgagttgagttggctgggctgagctgggatgaagtaggctaaataagctagcttgagctaaatagagctggggtgagctgtacttaaatgagctgtgattgaagtgggctgggatgagctcagctgaactgggctagctgatgtggatgatggtgaggctgagttaggatgagcatgactgagctggtttggacatgaatgagctggacccggctgacttgggctggttgagctttgcaagatgatgtggactaaactgggctagctggcaggatgagagaggttgaactaggctcagatgagctaggctgagcagggcttaggtgaggtggtttgggatgagctgggataagttgggctcagatgagctaccatgaactgggctgaggtggcctgggagaacatgaatcgagttgcactgagtacagccaggatgaactgggataaactgggctaaactgggttgggctaagaatggactgcctgagttatgctaagctgagctgggatgaattggggattgtcaagacttaaatgagccagactgaactggttggacttgggtgagctgaggggacctgctgcagggccggcatagctgagttgaatttagatgaggaagggtgagctagactgagcaaggctagactgcttatgctgagctacactaacctggcctgagttgggccaggctttgttggccatgtctaaactgagttaagatcaacagggagtctagaggggtaggggatgaactaagatgaattacactagctgagctgaattgagataaggtatggtaacctgagctgaactggaaagagatgtactggataaccttaactgggctgagatgagctaggtctacccaggcctggatcagcttaattagggtaggctagaccaaactgtagcagtatgtattagcctgtgccaagctgggctacattaaactaaactggacttagctaggctcagattagtttcgctactctagatggggtaagttgggccaaactgggatgaactaatttaactagcctgagatgggcagatctgaagtgtagcaaacacagccagggtgaactgaatgagtttgaccaggcctggaccagttaggctaaggaccttgtcctgggcagaccgtgtgctatggtggagtttcatgatgatgccataagagttcccccaccataacccacgtttctcctaccccatatacctgtctggtgtgtaaacctaatctttgtgtgctgatacagaagcctgagcccatcccccttccaccaccacctacctattgctttggaatgagcaaggttatctcagcgaatgtctcaaagggaagccgggacctaggcctgtccctgagagcagatgttcatgcccctggagtggctgccggtggctgaagggccagaaccacctactctagaggcatctctcgctgtctgtgaagtcttccaaagacattcctgtggttagaaggcagccctgctgtggctctgtcccatagaccaaacttacctactatctagtcctgccaaccttaagagcagcaacatggagacagcagagtgtagagagatctcctgactggcaggaggcaagaagatggattcttactcgtccatttctcttttatccctctctggtcctcagagagtcagtcctccccaactgtcttccccctcgtctcctgcgagagccccctgtctgatgagaatttggtggccatgggctgcctggcccgggacttcctgcccagctccatttccttctcctggaactaccagaacaacactgaagtcatgcagggtgtcagaaccttcccaacactgaggacaggggacaaatacacagctacctcgcaggtgttactgtccgccaaaaatgtccttgaaggttcagatgaatacttggtatgcaaaatccaccatggcaacaaaaacaaagatctgcatgtgccgattccaggtaagaaccaacccttcccgaggggatggggagagggggcaggcccaggcatggcccagagggagcagtggagtgggtcttaagccagcctgagctcacacctcaacctttcattccagctgtcgttgagatgaaccccaatgtgagtgtgttcattccaccacgtgatgccttctctggccctgcaccccgcaagtccagactcatctgcgaggccaccaacttcagtcccaaacagatcacagtatcctggctacaggatgggaagcctgtgaaatctggcttcaccacagagccagtgactgtcgaggccaaaggatccagaccccaaacctacaaggtcataagcacactgaccatcactgaaagcgactggctgaacctgaatgtgttcacctgccgcgtggatcacaggggtctcaccttctggaagaacgtgtcctccacatgcgctgccagtgagtagcctgtgctaagcccaatgcctagccctcccacattagagcagtcctcctacggttgtggccaatgccacccagacatggtcatttgcttcttgagccttggcttccaacagtggccaaggccaaggatgagcagtaggcagcagggggatgagagtcagatggagggaatcagcatcttcccttaagcagatttggaagatggagactgagcttttatccaacttcacaactagacacatcacaacctaacacagtgttctcttgactgcaggtccatctacagacatcctagccttccccatccccccctcctttgctgacatcttcctcaccaagtctgctaagctgtcctgtctggtcacaaacctggcaacctatgacaccctgaatatctcctggtcttccaaaagtggtgaaccactggagaccaacactaaaatcatggaaagtcaccccaatggcaccttcagtgctgtgggtgtggctagtgtttgtatggaagactgggataacaggaaggaatttgtatgcactgtgactcacagggacctgccttcaccacagaaaaaattcatctcaaaacccaatggtaggtatccccctttccttcccctccaattccagagcataccctgtacctcacagggagggcaggtccccttctaccctatcctcactattatctttgcttacagaggtggccaaacatccacctgctgtgtacctgctgccgccagcccgtgaacaactgatcctgagggagtcggccacagtcacctgcctggtgaagggtttctctcctgcagacatctttgtacagtggcttcagagagggcaacccttgtcctcagacaagtatgtgaccagtgccccaatgccagagcctggggctccaggcctgtacttcacccacagcatcctgactgtgacagaggaggaatggaactccggagagacctacacctgtgttgtaggccacgaggccctgccacacatggtgaccgagaggaccgtggacaagtccactggtaaacccacactgtacaatgtatcgctgatcatgtctgacacaggtggcacctgctattgaccatgctagcgctcaaccaggcaggccctgggggtcgagttgctctgtgtatgcaaactaaccatgtcagagtgagatgttgcattttataaaaattagaaataaaaaaaaatccattcaaatgtcactggttttgattgtccgatgctcatgcctgctggggcaactgttgtgttatgcttgtcctgcacacaccctgtatacttgcctccaccttggcccttcctctaccttgccagttacatccttgtgtgtgaactcagaaaggcttacaacagagtgtgagcatgccattcctccagctacttctagatatggctgaaagcttgcctaccttggtgcaggcagcattcaggcacatccacagacacacagagacagacatgcatttatacatagatctagagatggacatgtatagatacatgcacgaatatgtattcatagacacacagatagaggttccgcatgcgtgcatggacaaatacaaacaccttcagagacaaatatgcacagacacacaaccacacatggaaacaggcacaaacacacatgatcatgtgtgcaccaaaacagaatataggcaaatatagacaagtgaactacatagacatgaagacatgcatacacagacatgtaaagaaacatcttgaaatgtgtacactaacatgtggacagacatggcacacagttacacctggtctctgaccaggaccataatctccagggttcagggctcagagagtccatactaggctgggtggcactgatactcctcagggtcccactctatgattaggggaaatagcccgaggagcaaaatgtgcatttttggctcaacaccatggggcagaagataccccactaaccacccatgacagaaaattagccttggttgtgtctccattaatagaatacctcaggagatcaatgagagagcgcttgacccactcacttcccagtccagatgcagaagacacaatgcaattgtccaaaagaattgtacacacacacacacacacacacacacacacacacacacaccaacaaaggaacctctataaggagtcaccacccaataacattgcctctttggattcacatcctggacattcttcatattcatatccatttgggacctgggctttagaaatccccaagggctcatctttacagaggtcagagatcccaataaatgccctggtcccacagcctctctatctcttggtaccaagactcaacactgctggcaggggtagaacaatcaacacacaggaactctgatcaaagagaggcatgagatgcctgggtccttcaggaagtaaggagggataacctctgatatgcctactcttattcccaaagcccaggagaagggaaacctgctctgaattctcagtctaacagccccgatggtgccacctgctcagagaaagtccaaagaacacaaaaatcattatgccacatttcctgagtctgcctttacccatgtccgtatgttgcatctgccttgcttgctctgctgccccagagttcctgggacaaggccccaagttagtgcctcctccagtttgacctgtgctttgtctctgtctagcttgagctattaggggggccagtcaattctccagaaccagcagaacacccccaaccctgaggcaaatgttcaatcaccccaaggcttggcttgaccctccctctgtgtgtcccttcacagagggggaggtgaatgctgaggaggaaggctttgagaacctatggaccaccgcctctaccttcatcgtcctcttcctcttgagcctcttctacagcaccactgtcaccctgttcaaggtagtgtgtgtggtggggctgaggacacagggcagagacagggagtcaccactcctcactgcccctacctctactctgtaaaagggaacagcaattcacactgtctctgtcacctgcaggtgaaatgactctcagcatggaaggacatcagagagcaagagaccctcccacagggacactacctctgggcctggggttcctgcctgtatgactagtaaacttattcccacatctttcctgtgttgccctccagctttgatctctgagacgggcttctttctagactggccaaagactttgtccacttgtgcaacctggaacaatgtctggaaccacagacagctgtgctgtatacaaatgtcactttgaaataaatacttcaccttgcgaacccactctattgtgaaggaatttgttcttgttttcaaacttttcctgtggtgttgacatcccaaagactctctaaatagagcctgggaacttgaagtgaacagtctgatggggcttaagagtgaaagagggaaaggaggtgtggaagaagagagagagagagagagagagagagagagagagagagagagagagagagaaaccaccctgacagcaaagtatagcacaggcagccaatgggtagcagtctggtttatccaccctgatagaagaaagtagggcagagaaaactccaggcctgatctcacaaaagcaaccgaatctgaaaagtagcctctagcctggggtgtctgctccatccctcagcccaccctcttgggctggcgttgcttccagctagtgcaatactttggtgttagccaaacctttgtggtatgtggggtgtgccttgggagagttggctgagatctctaggatgtttgtatcccttctgcaacatgacaagccctaggggttagcccataacttgaggactcaaaccctctgtctataacaactgctgtggtcactggagaaggacagctaaaggcctgctcacacagcaggaaaggaaagggaggtaggtcatgtacttcagctcagaggaggaagcacagcagatacaaggtgagggcagtgctaggggttctgctgttcaccgtgtggatggctggaggaacctcacagaggtgggactagctggttacattgagagcaggacctgggagcagggcataagaaagaatatcagacagtgggagggaactgtgtagatgccagggtcctaaagagagtctttaaataagcatgtatggtagcaccttggtgatggcccctttctgagttgggtttctagtgggtagctgcaggagagcaacaagcatctattgagaaaacactgtaaagacgatagggcccaccaccaaattccagatatattttaggcattcacctcaataccctactttccataccagcatctgttttagtttccctgggctgcgggtgcaaagtgccacatgtggcagtttgagcaacagaactctgttctttcccagttctaaaggccaggattctgggcttcagcaggctggttcctctgtgcggcagggagaatgtgtcacagacttccagctctgaagccatagcatttgactaatacttgtctcctggcaccaacaccccagttactgtttcaaatgcatagcccatccccatgtgtgtttcctttgtacttactgccacgtttcacgaacccagttctgctgggtttgatgcccaccctcattcagcacaagttcatctcaggcagattccacccactacgacctcagagctagaagtctatgacacgttctccctgctgcacagaggacactagcctgctgtagcccagactcctggcctctagaactgtgaaagaacagagttctgttactcaaactgccacgtgttgcactttgccccagcagcccaagagagctacatagatgttagtatatgacgtaaggtgcagaggtgactttggaattgggcgatgaacctccaggcagtaaacagcctgctgacctttgcattagctgtgtgactgagatcacatcagttcccgacccccaagccccttcagacgtcacatcaatagagtcaaccgttagagtccatcgctataggaatgatgtcgcttgcactttagaaaggttttataaccaggactgtagttgtaccttaagctttgtgatatgtaaagaagtgagctaattatcaaaaggaaacattctgccaagtgatgttgtacttgaatgtgcccaaaacaaacatcccagcatcaaacgctagtatcttaaaccaacacaggtactgagtcatattaaactgaacgtacttcttgattcacacagacctacactgctgtctctgtttgcggagacccatgcagactaggtactggtgcacatagtcaacgagatgctgagggaggagagcacatactttaaggtagattaaaagggcactggacttggctattgacctccaggccacgctcaatgatgaggcaactaagagtctctgtacagccagaaatgtccccatatgctggccaggtataagatagatggtactagacacttggtgcaagagaaagagagtgtatatgacagacataggcacttgtagacttagtacacagcccactcagggccctaactgtctaaaaatgtgaaggagaatccataactcagtccatgagcattacatacacacctgtagctccacccacctcatcttcacaccttttaacatacagatcatcaggttatatcaggcctgtggcactctgaacccatctccatggctagtctatatccagaatgctgatggaccagcggtcaaggaagcctctctacctaccactctgatgccttttcctcctgagcttcatggtcaaagagaggatccatgagagcatccagggaccaaccacagccctatcagcacatggttctccagccatgtcgtcaactctgtctacccttggttattgctctttaataggtaccttgtctcactgtggcttataggttccatacgtgactatgatatgatagttcttcatctcaggtcctctgagtatcaacattctcacagacctagagcctgcctttgctctgaaagctgtatcttctcaacttggcactgacacagacagcaccctccattcctgtgtattgacccacatcctacccggagatattcctcaagaagcctcctccttaacctatgttcttccccggccagcacaagctcctaaatctgtgtcctgggtctgagccttggacctcataacgtggatcttctgtttacagaggttcaccccagcatcctacactacaattacccagcatgggcacctctgaccagacataaccttcctgattaacaatctgcttcttgttctccacattgcagtctttctgatgaggcccacataacctacaggctcctcacctctttctctgacacttcacaacacattcttccttcccttccattacatactgtcagtgtctctaaacccagagaaacacctggcttttcctagcagtcccaatcattcaagttaaggaccctcactttagtgaggatggccagtcccatgacccttcagaatttgttcccatctacatagttctgaggccctgaaggtcaccctctcccaatatctgtacctaactcctcctgcaaagacctgcaatgagctcctctactctgggggatccactaacctgtgtatcatgtgccagagcaggtttgattacttcattccgtattctcatgagcccctgagaccagaactggaatccctgattccacaatctaaaccatcaggttcccatggcagtccattttagagaccttctggtccgtgcctcttcttaatttatccaaggcattctcctgagtctcagcaatgcttctgtctgaagacataatttcctctacttggacactcaggcagagactcgagcctcttctttaaccgattcagtttggatggcacaccaggcttatcagtgttttcttgagatagcactagctagagacagggacagagaggtttagccaccaaagctggacttagatcacacatgaacaagaggcccagaggctatgaaccctctccaatgagctggtcaggaaagagtgggcataatcactcagcctcagccagctcagggacccagaaggcccaggtgcacagagtaggagcacatccaggcttcctaccttgtcccctgagtctcaagagtaccacatcaactactcccacacatccacatgaactaatctcagtcagctttggactccccctcatgtccagatacagaaacctccccagaataaaggggaacctcaggaaataccttatgccacccactgtcaatcatgttcttactcaatcatagggtggaaatagggtggcattcgcatctctggaacaaaggctgtgactctgggaaagacaagagaaagccaggaacaaatacatctgctttcacagcttccacatgtcaaaggggtcagcactaaatgaagctgcagaagaagaagacctcacagacagccagcatctgtagcccttccagatctttgagtcatcctatcacaggagattgagaaggagttgacggaccagcccaagcagaggaagcctgtgtgttcaacagtaaatgtgtttgccagcagcctgatgtcaactgagaagactgtggcgagtgcttgggagacaatcacgggcagctagagctgcacaaccccatagacaacaagcctgaaacacaaggagatgatgaaatatatccagaagactgcggaatcagtttggcctggaccacaggttgatagaaccaaggcagctgagccctgtggtaagtgaccaggagggcagagggagggagcttccaggagcatgcctgggaatgccttcaggccttctgagaagcagaaagtaggcaccctggggttccaggaaccatcccagcactcaagagttactaagggaatagaagcaaacctgagctgaaggagagaaagaaaagtggagggaagcccaagccactcaaagtaacaggcaggacaacttccagtgagctgagagaacaggagtgctggagaaggcagagcaagcccagcagatcaggagaacctgcataggagtctggatgactagagaaacccagaaggtgagagaacaggcttaacagctgtcatggacttagggatatgcaagcctggggcaccaagctgatctgcatagagggcaagggtaagtgggaatccaagagatctaagaatgaccagcgctgggcagagaggtggcctgggagaagatggctggtcttccccatgagtccaatagcaagattgtcggaataggttatcctatgacagatggcagtatcagtgaccaaatgaagacgctatggaagaattggaccatgtgggagttaagagttgaggacacaaggctgacctgcccatgggaactacagctgataaaagtgctgtgattcagggcatttctggaagctctgtgatccaggttgcagtacacaagtaaactgggacagacgggagttctgggggttcagttcagatactaggaacttaggaaactgggaaaagggaagttggggctgatggcagaactatgagaaggcactggaattctgaagaccagaccttctaatcaactatagaggaaatggagtgggtaggagtggtggatacagctgagcatcacaggggacctggggattggggacagctatactggggctagcagtgcaaacacagaaattgggggaccaaagggggaattgaggatgaccttgggtagatagaaatgctggatgcctaaggtacctccaggagcttagggaacctcgcagagcagctacaaagctggtggtgttagtgacactttcagaaccagatcgggcaggttggcatgtagaaatggggttaatggagacccaggacagtggcagattcagaataaaatacaaacaaccgaaagagttatgtgccctgtaagaagttgatctgacacccacagcagagacatctaaggtctcacagcccacatcaaacaggcttctgatctaaggacagcacaaaaggaaggaggcatcaaaccatcctggggaagacagtgcagtagtagccagaagtgtaagcccaacagcagtgggactggtgtagcagccagggacagggtccctgccaagatgagcctcaggggagctgagcagctgagaaactcaccagctgagaagctcaggggaatcagggtaagtggaggttccagagaatcaggggaagtcaagagctcagaacccaagaaggggcacctgcaaaagagctaaggcctatgagagtgtggggaacactttaagcagctttaggggagccaagacaggtagaagtgtggggacccaaacagggaagctccaggggagctaggaaaggtggaactgtgggaatccaggcagagcagcacctggggagcaaggaaagaagtgtggggatccaggcagagcaggtccaggggagccaaaaagtggaggtgtggagacacaagcagggcagcatctggggaaccaggacaggtggaagggtagggacccaggcagagcagcaccaggggagccaggacaggtggaactgtggggatccaggcagagtagcaccaggggaccaaggaaagaataagtgtggggatctaggcagaacaggtccagaggagtcaaaaagtagaagtgtggagagccaagcagggcagcatctggggagccaggacaggtggaagtgtggggatccaaccagagcagcaccaggggagccaggaaaggtggtagtgtagggtcacaggcagagtcgaaccagggaaccaaagaaagaagaagtggggggaccaggggagccaggacaggtagaagggtggggacccagacagagcagctccaggggagccaggacaggtggaagggtagggatccaggcagagcagcaccagggaagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaataccagggaagccaagacaggtagaagtgtggggacccagacagagcagctccaggggagccaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaagggtggggaccaaggcagagcagctccaggggagccaggacaggtggaagtgtagggacccaggcagagcagcaccaggaaagccaggacaggtggaagggtagggatccaggcagagcagcaccaggggagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaatgccagggaagccaagacaggtagaagtgtggggacccagacagagcagctccaggggagctaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaggtgtggggacccaggcagggcaccaccaatggccaacaaggtagaagtgtggggacccaggcagagcagctccatgggagccaggacaggtggaggtgtggggaccaaggcagagcagctccaggggaggcaggacaggtggaagggtggggacccaggcagagcagctccaggggagccaggacaggtggaagtgtggggacccaggcagagcagctccaggggagccaggacaggtggaagggtggggacccagacagagcagcaccaggagtgtcaggagaggtggaagttaagtagttataggggaacaggggcagaatagaatgagggatgcaggctgagaggatacaggggaaatgtggcaagtggaagggcaggaagagaggcagagtggctacagggaagttgaggcaggtaagactgtctgttccaggtcaaaaaacactgaagaccagtagaaaggaaactggtgcatgtggtagtgggggattcttagcttagcagtcacagggaaagtgagccaagtaggaatgcaggcatggggggcaggcacagctgagcaaacactaaagagctgtagctgaagggttataaggtaccaagctgagaagctgctgggaatctggagctaatggggtgtgggggagcaggctgagcaactacacaggatcagggataggtaactgtgtaaggaggcaggctgagcatctccatgacagctggagctactatgaatgttaagctccagactgagcatctgcagggaaacagaggcaagagggagtgtggggatccaggctgagtaggtccagggaagctgtagtaggtggaggtggaggcccaggctgaggagctacaggagagatgggacactagggagggcagggatcatggccaagcagatactcagtagctgagatagatgtggggaatcagcttaagcagcagacacaggggagcaggatctagtcagcttctagggatccaggctgtgtagacatggagggactgggggagctataagtaaatacactaggcataaaattacagggaaacggaggccagtgggaacgtgggcctcctactgaacaagtaacagagagccagaactgacgggttgaagaggaaccaggctgatgagctccaggaaatctgtggggactcggtcaatgggagaacagggtgagcagctatagaggatcagggataggcaaaaacgtatggagtcaggctgagcagttacatgagagctggagccctagttatgtggaggtccaggcagaggggctggagggtagctgagggaaatggtgctagagaatcaggctaggcagacacaggggagcaggttctagtctacatatgagtggggatccaggatgtgtagagaaaggatagcaaaggtcatggaggattccaggcttaggggtcactgggaaactaagactggtggaagtgggattgtcctaagtgaacaaattccatgaagctagagccagtgggtgtaaaggtagcagactgaaggactatagagtatctgggggtggatgggaatgtggggaatcgtgctgagccactacaaggacagtgtggctagcaggctgtaggagaccaagctgagtatctgaagggaaaccaagggaagtggaagtgtaggattccagaaatgagcaaatgcagggcacttgaggcaggtatcagtgtagggaacgagactgagcagttcacaggtcacccagggtaggtaagagttctggatcatcagagaagcctctggaagccctaagcacctacagtagacctaaggcaggtggggtgcagggaataagttgtgcagctcctgaggaggaggacaggttggagtagaggaggttctgactaaagagttgaatgggagcagggcaggtgggaatgtagaggaactagctagacagaagtccagatgagattgagggccacatgatgccctgagccgatgagctggccttagaaatcactctgctgggaccagggccaggggtttgaggaacaaggctgaggtgaaatggtagcatgacagggaggcaatggcagagaggaaggagaaggcatgcttaattcatggtggagtgcagggagggaaagagccaggaggtctaggctggagctgatccagctttctgcactgatgagaggggcgggactgagttcttttggctccaggagccagggcaacaagacaaaggcgcctagcatagcaaggacacatctggatctaagaccaggagaagagggcaagaccgaaagttcaggaggtcatgggagggagtgggaaatctacaagggactgtctttagaaaagagtaagtgcccagtggagggagtgcccaagcaacaagtccagtgttgggagagatcggggtgggcaaaggctgtatgtgcagtaggcaggcccaagtccccaggaaggaaagaagaagtgcataggaaaacgggtcaggtctagcaggagccaaccgaggtgctcaggactgagaggcagagcccaagacacaggaatcgctgagctcatgcaggtaccaagaataactgagagctaagagaaaaattatctagggaatagggggacatgaggaaggactgttggctgagaagggaaagggacagggagaatcctaagggttggcatagacaaaggaaacacacaggctttgggttgttagtccggggctctgcatatgatccaccgagattgtggaaacagaagagcaggaagatcaaatctgtcccaactatacagggacacacggtcaacctacaaaaggaaggagatgtgaggatcaggggctgagcagtgaggaggtgtgtggaggtgttagagctcaggtgcagcagagactagcatggccctggggatagagggaaggacccaagggacagtagggacaggagggcgaggtgaggtgatgaccagcattatacaaatggtggcgctgtccaacttctagggccctgtgctactgagaaaggaaagggacttccgaggtttggcaatacaagccccgtgcaaaggcagaacccagggcactgtgaagacaacactgcaagacaggagaagccaaggctgagttcaccgaggtcacattagtgagaatacactgcgaggagaggggaggcgctgagcacccagccacaccagacaggcccatgctgagtccctggacagtgggggaggggagcacctggtgacctgtaagaactgtgagactggaggagaaccaaggtaaaaggtgtgtcaaaggacacatgtttagcaggctgggccgacttaatgcaggacacacgtggtggcaaagccaagagggctgcgtatgagccacaagtgaatcctgacccaagaatagagagtgctaaacctacttacatcaaagccaactgaaaggacaaggccagcaaaacgaagctaaggccagagatcttggactatgaagagttcagagaacctaggatcaggaaccattagtgaacagacaaaggcaggtaaagcagcctaggagtggacaaagacaggagaatacagaagacggcagggatgacccgacttcagtttgggcttcactgttgtccaaactgtgtgcagattatggcccatgggtaagaggtttagcattagaacacagatacccacattggacaatggtgggggaacacagatacccatactgcaaggctcttcgggccctttcctaaaagtgtactaggagtgggactgggctcaaagggattaggtgtgatctggcctggtgaggctgacactgacaagcccaatggttgggtgttgcatcctccatttatacagccagggacttggggagggtacaaaatggaggacttgtaggagcttgggtccagacctgtcagacaaaatgatcacgcatactttttcttgtagctgaaacaacagccccatctgtctatccactggctcctggaactgctctcaaaagtaactccatggtgaccctgggatgcctggtcaagggctatttccctgagccagtcaccgtgacctggaactctggagccctgtccagcggtgtgcacaccttcccagctgtcctgcagtctgggctctacactctcaccagctcagtgactgtaccctccagcacctggcccagccagaccgtcacctgcaacgtagcccacccggccagcagcaccaaggtggacaagaaaattggtgagagaacaaccaggggacgaggggctcactagaggtgaggataaggcattagactgcctacaccaaccagggtgggcagacatcaccagggagggggcctcagcccgggagaccaaacattctcctttgtctcccttctggagatttctatgtcctttacacccatttattaatattctgggtaagatgcccttgcatcatgacatacagaggcagactagagtatcaacctgcaaaaggtcatacccaggaacaacctgccatgatcccacaccagaaccaacctggtgccttctaacctatagacaccaataacacacagccttctctctgcagtgcccagaaactgtggaggtgattgcaagccttgtatatgtacaggtaagttactaggccttaaattccagccccaggtccaacaaatgtcctctgaggcccatgttggaggatattggcatatttccacctttcttcttcatctacaggctcagaagtatcatctgtcttcatcttccccccaaagcccaaagatgtgctcaccatcactctgactcctaaggtcacgtgtgttgtggtagacattagccaggacgatcccgaggtccatttcagctggtttgtagatgacgtggaagtccacacagctcagactcgaccaccagaggagcagttcaacagcactttccgctcagtcagtgaactccccatcctgcaccaggactggctcaatggcaggacgttcagatgcaaggtcaccagtgcagctttcccatcccccatcgagaaaaccatctccaaacccgaaggtgggagctgcagggtgtgtggtgtagaagctgcagtaggccatagacagagcttgacttaactagacttctgccctcttactgacctccatgctgaccactctctgtatccacaggcagaacacaagttccgcatgtatacaccatgtcacctaccaaggaagagatgacccagaatgaagtcagtatcacctgcatggtaaaaggcttctatcccccagacatttatgtggagtggcagatgaacgggcagccacaggaaaactacaagaacactccacctacgatggacacagatgggagttacttcctctacagcaagctcaatgtgaagaaggaaaaatggcagcagggaaacacgttcacgtgttctgtgctgcatgaaggcctgcacaaccaccatactgagaagagtctctcccactctccgggtaaatgaccccagagtcagtggcccctcttggcctaaaggatgccaaaacctacctctaccacctttctctgtgtaaataaagcacccagctctgccttgggaccctgcaaaaatgtcctggttctttctgagatacagagtccagcgaggtcatgggctgaggggcgtccagggtttgaggcctgaggtttgactaaggaaaaagggtgatctacactgccagacacagcacttttgatttgctggcatgaacagaatttacctctcactgaaaagtggaggctttatcccgaggcaatccctcttgctttctcttcctctacctaatacatctatagtgggcacagaatatatcatgaaagtaaggacgacccaaactccacctccctagtccacctttacccctcttcctagccaaggatcccactgaaggcactcaatggacacatatggtcacagacagacccttgctattccaccactcaatgcaagaagcgttccagagactaagtctaatgtaacgatgcacatagctgtcactgctctctcactgcccatgagaatcaacatggacccattagacacaacctgatgagcaacactgagggcaaaaggcccatatgtatgcatgcacacacatcttcaaatgcacagcacagtgacacacacacacacacacacacacacacacacacacacacacactggaacctcacatgggcatcctgtgcagtactcccagatgaaaagaaaccaggtctacacacaggatcatcccaacattcacaagtgggccagctgagacagatacaacttttctctgccttggatgcccacagacatcttcatgcacacatgagtttcctggggtcaatctgtccctgaccctgggatggtgccccaacctcacacagttggcacccatccgaaactgtataacttactcacttcccactgtggatcttaactgcagtcctagcatcatggggaatcagctctgcaatccctctggccctcagttctcggtcatcagcagatacaggatcaggcagaccacacagacactacccatgagaggcacaggccctgactcagcctagccaggttcagaactcaaggctggagcacacacagaatgacctagtgtataggccaggccaccatcaggtccagggtgtctggtgagctcagggacaaaactacagcactttggggaactgaagtttctggtccagagagagatcagaaaggagagatggcctcagggagggtctgctggcccagtcaggctgtaactttctcctggaactccacacaacctcatctgacacagggaatggccctagtcacgccgtgttgggataaacaaacgctgacttccctctctgtccagggatggaagtggacgatgcctgtgctgaggcccaggacggggagctggacgggctctggacaaccatcaccatcttcatcagcctcttcctgctcagcgtgtgctacagtgcagctgtcacactcttcaaggtcagccacaccatctccacagtgtccacaccatcctcacactgttcctcatactgtctctgtgatcagctatgccccacactgtcccatgctattgacctgtcttacatgctgggcaatgccacctaaccttctctatgatacagtctcacagtgtcccatgcagtctccctaattccccaagatgtccgcactctattgctgtgttgcctcatgctgcccccacactgtccatccctccctggtatgctatcccaggctgttgtctctattttcatgctctcctcacactgtccctagtgtctcatactgccaatgttggctcccacattgtccccacactctgcacacaaccggacaataaaccctgctgtcccataatgttccctgtggtccccaactctatccctgcacatttgtctatgttccctgaattctcatgttgtttgcacactgttagtgtctaacgaactctctcccaggtgtaccttcttccatgctgtctcacctcatctcccattctgtccttgtactaaccccactctatcacgacactgtccctattcactgtccctatgaagtgcccatgctgtctgcattctgtcccatgttgtatcctcatcccggtctcatgcagttcagatctatctgacactattcccactctatgcacacatttccccctataccatccctgtctgatcaacatgcaatcctctagacacccatgtagcaggttagagactctagggatgggtacctgcctgactgagctacctctcttggtgggagaggaaacacaggtgagagtgcagtcctgatcttatcttattcaccctgtcccacaggtaaagtggatcttctcctcagtggtagggttgaagcagacgctggttcctgaatacaagaacatgattggacaagggccctaagccacctcctataatggcaaaggattccccacgccctagaggaccctgtccaatgtgccaagcagtctgactcagatcacactgtctgctcacttcactatcttctgtctatgagacccaacctccctcaattcttctctctctggaggactatgtggacattagatttccacaagccacagcctccaggacctaaaataccatcacagcagcagccaggacactagatagggtcagaaggaccatagtttcctgactagtttatccaatctgttgggacagaagaatcactgaaaaagtgacaagtgcccaagttgcctgtgttcagcttggaagggaccaaccttggaaccagtcctgtcagcatcatcttctaaaacacaagaattgagtatgtaaatggcagattttggatccccagggtaagacagacttcaaccaggccacgacctgggcaatcatggcccagctgaagttgactgaattattccagtggccttcacatcgtcttgccaggttccttcttaccacttccatgaaccctgggatacagaaaagaactgtgcttctcgggatcttgggacagaactgtctaattggtgggatccttaggtagatctttcttccagtcacgggtataatacaatacactagattctcacataaaggaaaaaattcacacacaactccggccagtcctgaggcctagacaccaccacctctctggaattctgagctctatgctggaggcacaagagaggaaggcctggacttcatggcctctgtgtagccctagtaggtgcagaggcccctaagccggggttgggtgaccagcaaggacctcctggagagggatctgatgagtagattccacctgggacagaaggaaaaagatgaaaagcaacagaggtggaagggcactggagagagccatggtatagcaggtttatcttgcagacctgacatctgtccatgactctgagacttagctaatgacagctggggcagcagtccaaggaattaccatgccccctaacaccaggctcctggagtgtggagtgggtctactccagagctccaatacctgtttctccatcacttctcagccaatgagaaatcggtttccagacaggaagaaaaatgaaggcaggaaggaaaagtgggcacctgttcttctgtgagtggcaggaagttctcaaaagactcaggactttggcttctaacttcctgtggatcattgatgtctctaaggtctctgtctgctttgttggttttgtttgtttttggtttggtttttttttttttttttttggtcaataaaacgttttttcaaacattccacaatctctgtgttcttcctatgtgaaccagccctggtacttagaaacagcactgttaagtagaccagtgagtcatgaagaacatactacctctcctggtcctgtgtcctaccagttctcctctaagggtcccttcacagctgtgtgccagctctgctatcctataccagataggtcctccgtctttcttccctatgggcagtttcttcccagccagaagctgcctttgtcctgtaggttgcccactcatggcctcccacaccagccacacaaactaagaagcaggtgtctcagtgacctcaggctcagtgataacatttctatggaaaagtgaaggaataagaaagagaagaaatactccagagtcagggaagagaaagattataagggatgtttgctttctcaagtatgtttggagaagttccagatcaggcgttgacaaggtcgggttctcagcagggctcttcttgcctggtaggtgccttctcctccttgtgacctcacaggctttccctctgtgtgtgtctctgtcttgatctcttctcataagtacacagtcaggctagaagaggtacaccctagccctaattataacttatcagtttatgaccctgtctgcaaacataggtcatggtggcttaaatgtcatttgctgaatcttctggggacagaatttagtccacatcagctctccctatggaccccaaaagttcatatccttcccacatataatgtccctcaccccatacaaacaccccaaagtctcacccttccaccatcagctctgtctcaattctcctccaagactgctagttaggtaagtgtgagatgtgggtgtgactcattcaggatcaagttcaagccatgactgtcaggaaagaggtttaggccgtcagcgcagagcagattccaggaccatctgagcagttgctgaggttcaaaggcagattatagactgattccttgctatagagaagatagcccattgtgatcctctcatactagttcagtgataacaattctatggaaagtgaaataataagaaagagaagaaatactcgagtcagggaagaaaaagaacctgcaggggctgccaattgtctcttgttctgctgggcgtgtctgtgccctactagagttggattctgtcttcccatggagacaaggagacaccggctccatggcctgagatagcaccgtagaggggcccagaatttgcttctggaatgtaggagtgttagcaccaatggagagctaaggtacacaaaggcctcctaagcaaagacccaaaaacaggagctaggtgctaagtgtgcagttgagttctcagatggtgtttagatgtcctcaggtatatccttgactgttagagactgttcaagccattatgacctctagtgatggctatatgagggaaatcaactgggctggactggtcaagagaagatcctgtcaccacagctacagtggtgaggggctgggtggggggcagaatccaaactggccaatgccattacagtttctggtatagggaaagacatgcttttcctcggacagagaagcagcagatccctgtgagtggtattgctgctggggaagccatagggagatggacctcggagggatttgttgctcatgtgcagacagctgcaaggagcctgggctttggccaagcacactgggcagccgctacaatgctacacactttgggagttaggacagtggaacctagactacaaagaggacagctgcactaaccctgagaaaagttacttaattcttcacaaacctctgtttaatgtgtgaccaaacatccctccctgcaaagcgagggaagaagaacatagaatagtgaatttaaagaacatttaggcctgggacagtttccttgctcagataagaggaaatgtttgttttatctcatagttcaagtgtacagtctgtcacagcaagagtcttagtttcatttctgttgcaatgataaagtaccctgaaaatagcaactttattcagcctgctgtttaaggttacagtctatcaccgtgaaaagtgagagcaggaacttgaggcagccagtcattcacacaatcaggaacagagagaggggtgtgcacgtgcccactacccagtgacacgtgacgttagaaaggaaatttggtggggataaaagaggaaatggaggagagggagtagggacggattttatatattacatgtattatgaaattccctaacaataaagagagctacaaacggctcattaggagaaggtacaatgtgtgaagctcttcagtgggttatgaagtagggatggtgaagcccaggtgcactgaaaatgaatttaccccagaagccgcccttcatatgtgcaccatgacatgtgcacgcacacacatgtacacaattatacatagacacattcaacataaacacaacatacatgtacatacaccacaacaccacacacacacacacacacacacacacacgaaacacatacataaacacacacaatcattcatggacacactcaacataaatacaacacaccacatgccctcatacataccacacatacacacacacatgcacacacacacacacaaaacacatcaatacatgcaccaccacacacataccacacacacaccttcatatacaccactcagcacacacagagacacaaaaaaaatacatatttacacaccacacacacatacataaacacacacaatcatgcatggacacactcaacataaatacaacacaccacatacactcatacataccacacacacacacacacacatacaaaacacataaatacatgcaccaccacacacacataccccccaacacacacacacacacacacacacacacacacactagaacacactaatataataatgtttaaggactgcatcatttttctatctttctgcaggcacttgtctgaggtgctgaatgttttcatgctcccatccttgccaaacagcactttatgaggagttataaccatgccacagcctcagtgtggtgctgacttaaaagttcctccaccaaataaactattccattccttccgaaaatagccagatactttcccagaatgtaatacaggtcatcaggtcttgatgagatcttgtctccccaccctgaaacctcatgagctggatccttgctgtccttaccccctttttaatgttccctgcactgggctttctcgtcccacagcatccatgtaagttatcctgaaagatgccacatcctttcctctgctgacaaatctgtccaccttactgtttaagttcctagagtaggtatattctgagaaagtacttatttatatccagagaatatatacatttcacatagttccttttgttctggttattgatgtcattgggtcctgaagttgtgtttggaccttacaatgacaaaaacccatctttccctttcttttaccaccaattctatctcatctatctccctgtttctctctgtccatatctctgtctttttctctgtgtgtgtgtttctgtgtgtgtgtttgtgtttctctctctctctctctctctctctctctctctctctctctctctctctgtgtgtgtgtgtgtgagagagagagagggggggggggagacatgtgtgtaggtgcgagtgaaggtcagaaaaggcatctgatccctgaaacgagaattacaggaggttgagaaccacctgaccagttacagagaaccaaaatcagggtcctgtacaagagcaatatgctctcttaactgccccgacatctctccagcaccccagctttcttctgaggtcttgtatgtcatacataatgaactcagatagggcacacccagtgtagctcagcgtagccagtacagccacagctagagatttgaagaactgggccatccttccagctgggcactgtggcctggtttctgctcaattagagcttcaatcctcaagatgaaggaatcgagtctgctgggccatggagcaggcctgagtgcttgctctctgtgggcaagcatgtgtcctgtttgttaccacagctagaaacagatgcttctgctgagaagctgcctgcgaggaggctgttgatgcagagtcgtgaagcgtggcgaccgcggcaacccacatgacaaggctgacttacagactgtggcttcagtgctggggcaaacaacaaccaagaggtcctacagacactccagagccacaaggtcaccacatgtctggagcagatggatttcagtcaacacttctaccacccaagaagcttttgtggtgctgggtatagatgaactcaagtagcaaggttcgggctgtgcttgggaatcccggcaacagaagggtttgctggagtggtaccacaagcattgctgtagtgcaatttccatcttctatgtggagaaaagcccaagtacagactgtcaggacaaaaccaggcagcttccatccccaaaactgcccatgagtctccagccttggtaccctatggcctccgaaaccgcccaggggtgtgtgtatgtggtctctaatgaaaaacatcaagccaaaaatccagaaaggaatctgggcacaacctcccagtggccacaatccttccaggaagattttcttcagtaggctgaggtaaacagtcttacggaaagtgccatccagtatctccagtggtctggaagaccctgagaaacacttgctgaccaacatggtcatttgtctactcattactgcaggcgtttgttttttaagtgtgcatccgcctgcgcgtgcccgtgagcctgagcgtacgcgtgtgcgtgcgtgaggtgcggtgcggtgcggtgcggtgcgtgcatgcgttgcttgcgtgcgtgtgggcgggcgtgcaggcgtgcgtgcatgtgagagagagaacacatgccgcaggacacaaagaaaccagaggacttgcaaaagtcagttctctcaacaggtcagtcctagatacggatcttcggcagccttacccgctgagccaccacactggcccattctttcagtcatttctccatccatctggctctcctgaggtgagaaaccttggccctccaatccttgcagtcagcattggaagcagattgacagtgatgggcacataggagagggagcagtgccagatgacagggcaccgggagacattgcccatatcttacaaagggtgaagatccaaggactggtttgggagccttaggggatcagccagggcctctggtgtagcagagacccagcactcctggtcaactgtacctacagaggtttaatcatttctctttggtaggctgctatgaccaatggatgctttgaaaggtctgtactgacctgtggggctcacgcagaactgggcctagcaggtggggtttgaagtttggcagcctccgtgggaaggatgtgaggaggtagacaatgctctggagagactggagccctgaaaggggggcactggatgtttgctgctcagattgggggtgatggccactcctgggtcacaaagaaaggcagggacttctcatgggatcactcaggaaagagatctggagaacctggaaagagagattatcaggaaagtactccaaagccctctgggagcttttgctgagtctctaggttggtaccctaaagcttgccagggccacaaacctctcttggtgggattaagctgctgcaagggtcccagattttttttctttcacatttgagttgttacttatgggtggcacataaaattactcttgttttcccatcaacgtcgtagggtaggaacccaagatcggagaactgatttcttccatatagtcccaaattcacacccaagtgacttgcttcctctcttagctcctcccccaccatcaccacctcccagtaacactgtcatgctctggatccatcaccaagggcttgacccgatggttagttcagagcactcacgatctcacagtctctggaaagtcctgcatagacagaagtcccatcacttaatccactcgaggggacaagcaaatgaaccgtctcatcggaggatgaagaatcttactaccgggtcccgacatcagcttccatcctgctgccttgtcccaggaatgtcagacttaacacccacgtttccaacccaactgcatggctagtcccttaaaactcttcattccctccccagtctctctgcatctgtgtccatatctgtctaaagaaccatccttccgcaattggagctgtggccataaattttgcgtgtgtcatttatcggttgtttatgtcaaccatctcccttctctgttcctgttgtctgcctatcacctccatcctcatcaccctctgtccctatcatatatatatatatgtatatatatgtaaatatatatatacagttgatatgcaggaaatatatattcagtttatatgcaggatatatatatgcagttgatattgatatgcaagatatatatacagttgataggtaggatatatatgtgtatatgtatatattgtatatatatacagttaatatgcagaatatatatacagtttatatgcagaatatatatgcagattttaagtggactagcaagccccgagccctcaagaaccgctaggatccctgcccagtcatgttactgtcattggaagtcatcttctgtttccactccaccaccacagaaaagatccacttcatctgttgggcagggtggttgaggagaaccaagaccagggccctttaattctgtggaggaaccaaagacagctcctgctacataggagcctgtccggtggtatggggaccagggagaagttagaggtgtggaatacagggatagaatggtgtacaacgagggatcatggtgtaagggagggtactgtgaggacagtgtgtgaacagagtgtagacagtgagaagaacttggaggacagcatccgcagcatgggagagcaaaggaaggtgtgacgacattatgaagatattgtgggaactgcacgtgagtgtgaaagacagcatggggtagcaagggaggagctgtgggacactaagtgtataggagggaagtagcatgagacgctctagagcagttgttctcgaccttcccagagctgtatcctttaatacagttctcatgttgcggtgacccccagccataaaattatttcattgctactttgtaactgtaagtttgctaccgctatggagtatattggaaatacttgttggtatgcaggatatctgatattcagagtggctacccatggcataagaaccactgtgctaagtgggtagaagggccaccatggaaatagcatggggacactagaaagacagcatgatgagagtattgtgatagcattgggatggtgtggggtcttgtgaggatagggtggggacagaagagtagacagcataggtcgtcacagggacagtataggaacagtgtgaggacagtgtggacactgtggagatgttgtggctgaccttgaagagtgtgacagctgcactgtagtacacactgagcaggaagaggctgatgtagatgatgatggccgtccagaccccgtccagctccctgtcctgggagtcagcacaggtcttgtccagttccagccctggacaaagagggtagtcagtctctgtcccaacaaggctgggacaattccctctatggcaggtgcatcagcaatgaggtacccactggactgggccagtagattgtttctggggccagccttctgccctctccagaccagcagactacactctcccaactgctccaacccaagtcccggactcagccagacacaagatggcaatctggactgtgtaagaacccttcccacctgctccactcctcagatttggggctgtctgggctgaatcagagcctgtgaccactgaccctctgcctatgaccaagcccagaaagccagtgtaatggtggaccccaggcctagtgatgcctggccttcagagttccacactgggaagtgaattgggccactcagctatgtgggaaggggactgtcatctctatgggatgaaagcatgggtctgaaggtccagaagcagaatggcatgagagagtgtgtattgtgggacaagttgcctttggaatcctttggcagtgctatctgtctcagctgagccagatgtgaggaagagcctcagagaaggcctggtgccttgatgggtctgagttctgtactgggagctcctatgaggtctcggagtgtaaggcttgtgtctgtgctcatgcacaccagtgtacaagtctgtgtaaatgtcatgtgggttgaccgatggtcatcagactgctaggcactggagtcatctgatggctctgaattctgcattctgtgtcttcaagataagagacataggtatctagcccagaaaactagtctcaaggaggagagagggtcatggcaaaggtagacagacagaaattccagtgctttgacctgagatcctctccctgggcacaactgttcatcctggttgatctagagaagaaaatgacataagcctgacctccaatgggccatacctctgctgagcatcctctcatcagttttcctgtccatcttggtactgctgaccagatgggtcacacacaggtaatagcctggctcgtccagaagctgccaggcatgatcactgagctcctgaaggaagacagcttgaactataagacagatgtcgagtttcacataccagtgaacaaagctccagacttccaagacatgattgctggctcagggaagtagcccttgaccaaacaacccatgttgccatgggaaccaggaaagagatggacagggccatggctcttgctgcaaaggggggaagagatgtgaacatactgtccagcctggagaagtctttttctccatgcagccctgggtcttctaagatgggatctgctcctactcttcacgaacctagccagtttctgttttctctgaccccagcccctactcttagtctcaggaccttgcttttcacccccatccttacactgtaccccagccctgccagcatcgaatctggtcccaatgggttctttccttccaatctatagggttaactcccctgagcattcccactctcccctgttcctgtgaggccccaggatcagaattgtggaccacaaccccagaaataaaacccatggaatcccagcccccagagaccctccctgtgcacggcctccctcagtttagcaaagagttacttctggacccctgcctagcttctctctgcagccatatgacccactgcttataaacacagccagaagcgccagttccctttctcctctccacctggcttcactctgcactctgtactctcactccagacttcactttcctcctggagccacagacacttctgggctctagagagattgcatcagctggagagggaatggcagaggctgccaagtaggctggttagaggtcagacctgagagaaggtcttctccaaaaaggtggtcaggagaatggacataatcactcagccccaagcaatccaggaacactgggtgacagctagtctctacatcttcttctaagggtctcaagaggaccacttcacctacccctacaggaggtaacccagaccatgtctggactccccctggtctccccctaccccaaacactgaaaccaacagaagaaagaggaacctcaggaagtgtcccgtgtcacccagtttcgatcctgttcttagtctgtactgggttgggagaagtgtgatgttcacacctctggggcaaggactgtgaatcctggaaggatgagacagatctcagagctgggctgttagcagcccagcaccaatgcaaaaagagcagcagtcacaaggttccacacgtgaatgtagtcagcagagaagctggagaaagccacagcctagggagagcagtgagcttttccagacctaatagacggcagaacacaggaggatgaggagttgacagatcagccccaacagaggggcctgtctgttgcaaagaaaaggtgcctacctgcaacctggtgccaaccaggcagacaccagactttccacggacagaagccaagaccactaaagccgtgcccacctacagacaaccagagtaagcctcaaggagttaatgggatagacccggaaacctgagggtctagccaggcctagaggccggtggacccaggacagctgaaccaacagagaaaagaaaacccagtggagcaagggcagaggcatacagaattgagagagttggtaaagaggggatggggaacgttcacctgggaggactgatacacctattagaaagagctagagtcagagtggatgcccttgtgactcccggcattggatagcagatcccaagaacaaagctgaaagaaggtaaatttctcaagagaaagtcttccagaggaactatgggtaccaggcaataagtagtacatccgtaggagggaaccagacagtagtacatctgtaggaggggaccaggcagtacagctgcaggtagggaccaggcagtatatctgtaggagaggaccaggcagtatatctgtaggaggggaccaggcagtagtatacctgtaggaggggaccaggcagtatatctgtaggagaggaccaggcagtagtatatctgtaggagaggaccaggcagtatatctgtaggagaggaccaggcagtagtatatctgtaggaggggacaaggcagtacagctgcaggtaagctaaggacagtaagagtagtagagagccatgatgactccaaaagctcagaagacctggcagagcagctacagggaatccggggctggtggagttgggaggaccaagccaaagagctataggtaagccgaggctggtgaaggcacaaaaacaagctaaggagctacagagggggcaagggctgtggcaggtgtggctaagagaggtccagggcacccccaggaaccagaaagagctttacaggagttctagaggaggaaggagttggggagacaggctgggcatctgtaaagataaggtagcagttgtcacagtttgggtctcagagctgcccaggggattaggggaaaattctgagaagctgtgggagagtaggggatggtaggaatgtggaggaccagtcctagcagctgtggggaagctggggatggtaggaatgtgggggatcagtcctagcagttttggggggagctggggatggtaggaatgtgggggaccagacctagcaattttggggggagctggggatggtaggaatgttggggaccagtcctagcagctatgggaaagctggggatggtaggaatgtgggggaccagtcctagcagctatggggggagctgggatggtaggaatgtgggggaccagacctagcagtttttgagagctgggaatggtagcaatgtggggtccagtcctagcagctatggagtagctgtagatggtaggaatgtgggggaccagtcctagcagctgtggggaagctggggatggtaggaatgtgggggacaagacctagcagctatgggtgagctgtagatggtagaaatgtgggggaccagtcctagcagctgtggggaagctggggaatggtagaaatgtgtgggattgttcctagcagctatgggggagctggggatggtaggaatgtggaggaccagtcccagcagctatgtggggggctgtggatggtaggagtatgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggagtgtggaggaccagtcctctcagctgtggggaagctggggatggtaggaatgtggggggcctgttctagcagctatgggagagctgggaatggtaggaatgtgggggaccagtcctagcagctatgggagagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcccagctgtggggaagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcacagctgtggggaagctggggatggtaggaatgtggaggaccagtcctagcagctatgggtgagctggggatggtaggaatgtgggggaccagtcctagcagctatgggagagctagggatggtaggaatgtgggggaccagtcctaggagctatgggagagctggggatggtaggaatgtgggggaccagtcctagcagctatgggagagctggtaatggtaggaatgtgggggaccagtcctagcagctatgggagagctggggatgataggaatgtgggggacctgtcctagcagctatgggagagctggggatggtaggaatgtgggggaccagtcctagcagctatgggagagctggggatggtgggaatgtgggggaccagtcctagcagctgtgggggagctggggatgataggaatatgggggacctgtcctagcagctatgggagagctggggatggtaggaatgtggaagaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtgggaatgtgggggaccagtcctagcagctgtgggggagctggggatgataggaatatgggggacctgtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggaacgtggaggaccagtcctaggagctatgggagagctggggatggtaggaatgtgggggaccagtcctagcagctatgggagagctggtaatggtaggaatgtgggggaccagtcctagcagctatgggagagctggggatggtgggaatgtgggggaccagtcctagcagctgtgggggagctggggatgataggaatgtgggggacctgtcctagcagctaagggagagctggggatggtgggaatgtgggggaccagtcctcgcagctgtggggagctggggcaggtgggaatgtgagaaaacaatccttgagctatggaggagctggggatggcaaggatgaaaaggggcaaatcctagcagctagagggaagctggggcaggtgagggcgggtgtaaggaaccagacctagaaactatgggggaagtggagcaggtaaaaatgtgataaaccagttatgcagtccagaggctggtaggagtgtaagggagcagacatagtggctatggggaactgggatatatgggagtgtaagggaccagattcagtagctatggtggaacttgggagtgtagatgagcacgctgaaaagctatggtgcaactgcaacaggttgtcagggtgtaaagaaccagacccagcagccatgggaaacctggggaaagtagcgatgtgggggaccagatttggcacctataagggagctggggcatgtggacatatgaggggccagaagcagcagttatagggaaactttgaaatataggcaagtgtaccaagaagccgtagtggagctgaaacagatcctaggtcctatggaggagctgaagaaggtgggagtgtgagggaccaggccgagcatctgtggaagggctgaggcagggctctgggtcggatgggagtggcaccccagagaagccctagaagctctggcgatggagctgagcagttacagtggacttggggctggtgggatcgtaggagaccatgtagctgcagaagagctggagaaaacaggagtatgaaagacccagccaagtagccactgaagagctggggtgttattggggtgtgtggggacacagtcccagcaggtttatagaggttggagccttggcagtatgtgcagtaccaaacccagcagcttggttcaggggcttgagtagaggcaggctaatggggtccacggtaaccctaggcacttaggggactggattgcgaatcttcaggggagctggaacaggcaaagttaaaaggaatcaagcacctggaagaaagcaaggaaagataggattgatggggatccaagaaactcccaggaagtaaccccagcagggacatctgggagctcagttcagacactgaatcaaaagcacagaggaaggagaggtggtaggtttccaagctatcctgtccaggccaatggagcagccaggaaggagggaaggagaccaacaggaatggggcagctgtagccagcagggtgtgagagacagggatgaggctaggtggctagcaagaagggcaacttagtgggagaggggtgaattaaccaccctgacctcatgctgacaggggctgagcaacagacaaaagaataagaaagccaagagctcatggctggaactattctggctgtctgctctgactgtgttgaaggggctaagcacctgttagctaatgaggctaaaacagttaaatgagcaaagtagagcaaaaagctcccacagcggagagcatgggagaacgggagactgtgagatcctcggggggtctaggagtttatctcagagtgaagaacagtgaaaagctctgcttgggagttctttggggaatggcgatcatcctgggaactcccttatagacctcatggcatggaggagagcaggagctcaggcagacagagtagctgtgtgtgagctggataagaaagaaaagagacaacagggagagaagagaaaagggatgggaaaggactcagggctctactgaattcaggcagaagagcttggcttcaggatgctgggggccaaggaaggtgtctgattgagcaggaacatagtcaggaaaagaccctggtgctcacattcccagacaaatcttacaggttaaagttctagtatcagaacccctcgctcagatcctaggggcttatgggaacataaggcaggaagtgaaacctcttaggacagcacgaagtagcctgtgttggcccacagaagaagagcaaggtaactctcagagtttgagcaggggattgaggaaggtagtgtacaggagaggcagaaagaccagaaaggtccccagagtaagaatgaatcaagaatttatgtgtggtttggttcgatgaaggcaaaggcagggaagatagatgagaaactgatcctctttcacaaccaagaactcattgttcagtgtgagttttgatatatagaaggggggggaatgtgctattaaaagtaaaaaagaatgaaccagattcaaaagggaaaggggactaaatgtcttcctgaataatgcagcatacattcctatttcaagagctaccggcaagagaaagggacacttctgggatgtgcccagtaacattagcactgtcagagagaacccagggcagtgcgaagggtgaggtgggggaggaaggtgtctgcactcatcagcgtctcatcagggggcactgagctgtgtagaacaagagtggccagctaggtcaagacagaaaggatgcccacacacagaaggtgtagggtagagggttggtagtaatccccaggaagcagggagcaaggtccaaggagagctaaagtcacggatagagacctagggcacagatttaggagccagagtttgtgtaatgttagtagattcagtaggggcttctgaagggcctcatcactgaaagatcaaggctcctagggctggagagttggctcagtggttgctgctcttccagaggacccaagtccagttcccaacaaccacatggcatcttacaactatctgtaagaaactccagtttctcgagattcaataccctcttctaacagcacaggcatcaggcacacacatagtacacatagtcatacatctaaaataaaatacctaaaaaaaaattaaggtcagagtgcagggtctagaagtggaagctgctgacaccacttaccccagagcaacttgagaagacacagtctttttagagcaaagctaaggccagagcctctccaaatatctgaggccacgcatgttggaaaagctcacactccctcctctcttgcagcccaaacaacagccccatctgtctatccactggctcctggatgtggtgatacaaccagctccacggtgactctgggatgcctggtcaagggctatttccctgagccagtcaccgtgacctggaactctggagccctgtccagcgatgtgcacacctttccagctgtcctgcagtctgggctctacactctcaccagctcagtgacctccagcacctggcccagccagaccgtcacctgcaacgtagcccacccggccagcagcaccaaggtggacaagaaagttggtgagaggacaaccaggggacgaggggctcactagacgtgaggataaggcattagattgcctacaccaaccagggtgggcagacatcaccagggagggggcctcagcccgggagacactgtctctgcctccctcctggaggcctcctggaggcctctgcctatggccacccaccccctaagacatgatcctctggtatagatgtctgtgtcatgcataggatcataccagggacaaactttcctctctggtttggtgccttctctccttgaaaacccagtaacatccagtcttctctctacagagcgcagaaatggcggcattggacacaaatgccctacatgccctacatgtcacaaatgcccaggtaagtcactagacctggaccccagctccacaatgatggcaagagctgtaagcatcccagcactgcaggataagccacgtactgacccatttctatctctcctcatcagttcctgaactcttgggtggaccatctgtcttcatcttcccgccaaagcccaaggacatcctcttgatctcccagaacgccaaggtcacgtgtgtggtggtggatgtgagcgaggaggagccggacgtccagttcagctggtttgtgaacaacgtagaagtacacacagctcagacacaaccccgtgaggagcagtacaacagcaccttcagagtggtcagtgccctccccatccagcaccaggactggatgagcggcaaggagttcaaatgcaaggtcaacaacaaagccctcccaagccccatcgagaaaaccatctcaaaacccaaaggtgagagctgcaggccgactgcctggggactgggataggtataagaatgaatgcccgtgtggacggccatgacctctgtgtctgtttctatccccacagggctagtcagaaaaccacaggtatacgtcatgggtccaccgacagagcagttgactgagcaaacggtcagtttgacctgcttgacctcaggcttcctccctaacgacatcggtgtggagtggaccagcaacgggcatatagaaaagaactacaagaacaccgagccagtgatggactctgacggttctttcttcatgtacagcaagctcaatgtggaaaggagcaggtgggatagcagagcgcccttcgtctgctccgtggtccacgagggtctgcacaatcaccacgtggagaagagcatctcccggcctccgggtaaatgagcacggcacccagaaagctctcaggtcctaagggacactgacacccatctccacccttcccttgtgtaaataaagcacccagcactgccctgggaccctgcaaaactgtcctggttctttccggggtatagagcctaggtcacgggctttaaggtctggctggggtttaaggccagagttgtcttcaggaagagagtgaggtttccacactgccagactcagagctcatgagtcatcagggcctggagtgttggggcttagctttaggaagtgcctattccttgacttcaaactaaccagcagctgccagacggagagatacacctaggaaacctccaagggaagaaacacacaaactccaccaccctctgcctgttcctatccccatgtcccactcctctgcctatgggtttctctgagtctattgcacacatggccatgggcgtgccagagacccttgctatccctacactcaactaaacccaggcagcttttcatgggctaggtctgcacacccatacagactgcccactcatgcctgtgccacgtgagactgaggcagatggctcttgccgcccaaagggagggtctgttagccacatgcatactgaatcctgacccattcaaatcagcctgccgaacatcatccagtccgtatagcacatgtatccacgtgcacatgtgcacacacatttaacacaccaggactccgcctgtgtgccctgcacagcacctacacccagcagtgtatcaggatacccacaaccaccacttgagtgcccacgtttctgccatcacaaccagacacacctttccccttctaaggtcactgcattctaggctcagcacaagtcctctgaagccagatccgtctctggtacctcagggtcacgcttcaaccccacatgaattatacaacccagagccataatggtctgagtcacttcacactctggaattttctcaagttcaggcaagaccaggcacaggctccgctggtgattgagggacaggtaaagggtcagaccagctgtatagccactgtccactggggtcacaggccctgctgacccttcaccttctcctgtactgcaaacagagagggcccttgcacaatccaggccgccatgaggtccactgtgtctggcaaaccccaaggccttatccaactcagccggagggaacttagactgatgtcccagagggaaaagaaaggaaagtagggagtagaaagtctcccagggagactctgctggcccagcccaaatggagctttctcctctgccacatggggaattgctcccagccccccactttattgggacaaattctgactgccctctctgtccagggctagaagtggatgatgattgtgctgaggctcaggacggggagctggacgggctctggacgaccatcaccatcttcatcagcctcttcctgctcagtgtgtgctacagtgcctccatcacactcttcaaggtcagccacaccatcccccaccatctgctgtgatgcctgtgtcaaccctgcgatgtcctcacactcctctcctgacgtagtaggatgttcccttgctgtccccactctgccccacacaccattcccaccgttccctgagccgtcccacattgctctgtgtggctacccatggcgtccatactgtctgacattctatctctcttgctgtcctatgtgatctccatactgtcttacgaaacctccttgcatgccacactacccttcatgacgtccctgctatctaccatgctacccctctgggtgtccccatcagcctcaccatgtattctttgagctatcctcataccatctcaacctcaactcccacgatgtctccacaccggctcctagtctatgtcaccctgaccccttgccatccccagtctcctgcctgtatgaaaggaactgcaggagggacgggcctctgtcttgcccacagggctgaagggcctaagcatgggtgtgttctctgacttactcccacctccccacaggtaaagtggatcttctcctcagtggtggagctgaagcagacaatctcccctgactacagaaacatgattggtcaaggagcctaggccacttcctctgggatgagcttcctgggccccgcacaaccccatccatcctactgtgcagcctaatgtggaggccacactgccgtctgacagtgccaccctctagccctgtgactctgatccagaactctagactgtcttccttttggaggatcatgtggacaatgagctataccccagacccaaacagcacctccacagcagttgccaggaaactaactggttgggaccagaagaaccatctctaggatgtttgcctcagaggagctgggagtccacggtgcctgagtcgagctccatgggaatcagccgtgtctgaaatgggtcttcccagaaagagcaatgttttcagatccttgaaaggaaacatctgctaggaagaccatggtcgccacagccccaaagagtcacttcactctggtagcctttgaaccagttatatctggacaccttctttcccggtacttctgtgaaccctgggctgagtaaggggtttatgtttctcaaactgttgggatgagcctccccgagatgaagctccttgtgcagtcttctcttcccgaaacccactcaacatgctggactcttgggttcaggatccgatccgaagacaccattgacgacgcaacctcaagacaaggccactgtcacctccatagagactccatccacactctgcagggacaggaggactgctttgtgtaacctccgcaaagccctagcagggacaagtgcacagaccactgagtattggtgaggtgaccaggcaggaaaacctccaggagagggccctgatgagaagattcatattgggctcaaaaaatgggatggggggaggggggcgggtgggaaagaacagtgggcagggtgtgaacagatgattagaagacagtcacagtgccgcagatctgccctgcaggcctgctttccagactggaccacttacagcagaaaacaacagttacagtaagcatctaggagagtggacctggaataccagggctgctgtggccagtggagagtagccctgcatctacttctccattacctctcatggccaataagaagccagagcatccaggcagaaagaaagagtgtgcgtttctgtgactggtaggaaatgcttagagaacttggatctttaaaacagcttttttctagactgtgaatgtctttaagcactctctttcctctccattccctccctctctctttctctctctctctctctctctctctctctctctctctctctctctctctctgtgtgtgtgtgtgtgtgtgtgtgtgtgtgtgtgtgtgtgtgtgcactcacacacactgttgttttggcattttaaacaataaaacattcttttaacattttgtatctcatggtgtcccttcttaatggattagccctaacaccaaggaacagggcacagttaacagatcaattagccatgcacatccctcctgaccctgtcctcccagggttccctcagtgggtccctcatggctgggttccagccctaccagagccacaaaaagcttgggcatattcctccacacacacagcttttttccccagctggagactgctctgctgccatgggcaggctgtggagcagggctgatgcccagggtagaccctaggctagccagacaaaggtcccatgacagcagagaagcatgtgcctctcactggccttgggctgctacagagtcagcaaaggacatggatccagctacctccacagctggtgctcattgtctcaagccatgtccagagaagttccagatcaggcattgacagggtggagagctctctccttggttggtaggtgtcttctcctccatgtgacctcagagccccccccctttctgtgtgtgtgtgtgtatgtgtgtgtgtgcgcgcgcgcgcgcgcgcgtcctagcctcttctcataagtgcacagtcaggccggaagaggtgcatcctagccctaatcataacttaccagtttatgatcctgtctgcaaacataggcatagtctgaggtcctggtgatttaaatgtcaattggtgagtcttctggggcttcctacatacaatgccccttccccatgccaacatcccaaagtctcacccatccagcattcagctctatcccaagtcacctccaaaggcctgctagtcaagtaaggatcagatcgtgtggggttcgtcctgagataggattcagccatggtttccaggaggaaggggcaggagagaggcacaggggagagacgtataccgtgatgaactggacagactgataatgtgctgtccagaagaaagctgagggcaaacaggggcccctcccacttacactgaggtgacagttcctaagggagagtgagggatttgtagagagaagtggaggttccacagagttggagaagcaaaagattactagaggtagcctggtgtttgcaatgtctgttttctgttatggttgacatcaggattccatgctactctgtagatcaagggatacaggttccacatctttgtgtggcactgtggtggaggggcttgggcccagatactcccgggacatggaaaatacagacatcggcaggggaagaaatgggatgattcacaaccaaaggcctcctcatccgatgcttactgatctccgagagcaggagtcgggtgctggctgggcagttatcatctcccagtatttcccaggtggcatttagtagctgagacatcttcagattgtggccttggctgttagacactctatctgtttgggtctgtgtaggtgatggtggaggctgaatgaaggactggacaagggacaaaaggatcaggtcaacaaagctgcagcagagacaggagccaacctgaccaacaccactgtggcttccatgggacagttctgttttagccaggacagaagggaacagagctgcgtgaatggcattactcctatgggagtcacacagacaggctaatcacccagacaacaccaactggccagtgagaccagtgagatcctgcccacgcttcctcttaggtctggctctgtttctctagttgtcttccctggagcaaatgttgggaattgagcccatatcctctgcaagaccagtaaatgttaactactgaggcatttctccagccctgcctcaacctcttactggaagatggtcccaaaccaaaactgacggcatggtctcagaaagtacagattcgccacctccaaacccttctctcatgtctgtctgtctgtctgtctgtctgtatgtatgtatgtatgtatggccctgcaccatcacccaccacctcctggtgtcctgcagcaggggcttcccacagcaggacgtaccatagctcccaccccttacacctccatcagcactataaacatatagacacaagtgccataaccctggacacaccttctgaccccgcccccatctctgagaccaactgatctcaggctgtgttttactgaatgtgtccattcggtaaaagctatctgagtcctgccctcctgacctctatagtgtgacatccatggtgtgtgtcctgtgtcataacacgtaggtatgtcataccgtgtgttaccacatatgatatgtgtgtgaaacatccccacatgatgcctgtggtggacatgtatatatatatcttttatgacttctataggggacatcaattgcagaatacctgtgctagccagtagccatgactgaccagacagctactgacacttgacccacttgcattctgtcacagtctgggaatcataacatgacacaaacgccgattgtagcaccaggtcatgggcctgcatgagacttgacatgtgtacacacatgacatgtgtacacacaaaccacacgaaaaagtgtctcggaaaacacacacagacacatccacatgagcatcatagtgtggtcacagacatgtccacatgggcatcacagtgtggtatcatgtagtagccacagcatacatgacacagtcacacaagttcttacaagaacatacatgtctgccagttcccagaactcctggcctcaggctcagcactggccaccctggcccagcacacttcccatgcttcaagctttgcacacacagatccactgtattcccttcctgtgtttaccccattaccttcagcacaccacccacctctcttccatgactgcccccatcccacctagcacggcgccccactactgtgctagctttgttcactcagtgaccatgtgtgtccatcttccagtgaagcttgagctctggggacaagaacgtccctccagattcatgttcctgcagttctatccaactgttcagcatctgtgatgaagtcacaccaagtccctcaccccctaactagtcttctaatctggcatagttatgtgctgggaactaagtagatggtcaaagtaggatatgatgctggccaatggtgcagaccagtaggtccatgtgctgacccttcaactctaaagtcttccccacgcctaccatgtagccataagatctttcccccaaggcagggtacagacaccacatagaggaagaagaccaagtggatgggccccccatagcaggtatgggagagtcaggctgacatagcaagtgtgggagagtcaggctgccatagcaagtgtgggagagtcaggctgccatagcaagtgtgggagagtcaggctgacatagcaagtgtgggagagtcaggctgacatagcaagtgtgggagagtcaggctgccatagcaagtgtgggagagtcaggctgacatagcaagtgtgggagagtcaggctgacatagcaagtgtgggagagtcaggctgacatagcaagtgtgggagagtcaggctgccgggcacaaaggatatgctggacttagggaagccatcctccctgttttctgcccaagcacatatgtatcctactatcagctctctcattgttcactccatactcaagcatctgcccataggaggaagacctcagcctcaagtcaggatgtacatgagagcagccacagagtgagtccatatagttctgttcttttgccccaaaatgtcatgttccagaactacttgttcctttgacctagaccccagaaaagagaccagacactatagtagacacggaagtaagaacaacacagtgctgttgtttctctgctggcaaaggttgttgccacacttatccctggcaaagatataaaacagatgtcatcaaaatgccagtcctggttgtaaatacatatttagaaatgtctgtgtgtgtgtgtgtgtgtgtgtgtgtgtgtgtgtgtgtgtgtgtgtgtgtgtggagacaacaggtaaaaaaataaagacgatgttagagggaggaaattaaagttggaaatgatataatcatatttttattggataatttatatttacatttcaaatgttattccttttccaggtttctcgtccataagccccctgtcccatctccctcccccttcttctataagggtgttccccctctccaaccacaccccattcccgcctccctgccctgacatttccctgcattggggtgggggggatggggttccagccttggcaggaccaaggacttctcctcccattggtacccaacaaggccatcctctgctacacatgcagctggagccatgggtctgttcatatgtacactttgggtagtggtttagtccctgggagctctggttggttagtattgtttgttcttatggggttgcaaaacccttcagctccttcaatcctttctctaactcttccaacagggaccccatgctcagttcaatggtttgctgctaacatccgcctctgtatttgacacactctggctaagcctctcaggagacggctatatcaggctcctgtcaacatgcacttattagcttaatcaataatgtctagttatggtgggtgtatatatatggactggatccccaggtggggcaggctctgaatgtccattccttcagtctctactcagaaatttgtctcaatatctcctcctgtgcatatttttgttcccccttttaagaaggactgaagcatctgcaccttggtcgtcattcttcttgagcttcatgtggtctgtggattgtatcttgggtacttcaagcttctgggctaatttccacttatcaatgagtgcataccatgtgtgtgtttctgtgattgggttaccacactcaggatgatattttctacttccatccatttgcctacagatttcatgaagttattgtttttgatagctaagcattcattgtatagatgtaccacattttctgtatccattcctctgttgaagggcatctgggttctttccagcttctggctattataaataaggctgcaatgaacatagtggagcacgtgtccttgttatatgtcggggcatcttttgggtatatgcccaagagaagtatatctgggtcctcaggtagttcaatgtccaattttctgaggaacctccagactgatttccagagtgtttgtaccagcttgcaatcccaccaacaatggaggagtgttcctctttctccacatcctcgccagcatctgctgtcacctgagttttttttttttttttttagagagacatggaagaagattgtttgttggtctatatttatggcttgctcagcctgtggttttgttttttattaacttgagtatttcttatatacatttcgagtgttattccctttcccagtttccgggcaaacattcccctcccccctctccttccttatgggtgttcccctccccatcctccccccattgccgccctccccccaacagtctagttcactgggggttcaatcttagcaggacccagggcttccccttccactggtgctcttactaggatattcattgctacctatgaggtcagagtccagggtcagtccatgtatagtctttaggtagtggcttagtccctggaagctctggttgcttgacattgttgtacttttggggtctcgagccccttcaagctcttccagttctttctctgattccttcaacgggggtcctattctcagttcagtggtttgctgctggcattcgcctctgtatttgctctattctggctgtgtctctcaggagcgatctacatccagctcctgtcggcctgcacttctttgcttcatccatcttgtctaattggatggctgtatatgtatgggccatatgtggggcaggctctgaatgggtgttccttctgtgtctgttttaatctttgcctctctcttccctgccaagggtattcttgttccccttttaaagaaggagtgaagcattcacattttgatcatccgtcttgagtttcatttgttctaggcatctagggtaattcaagcatttgggctaatagccacttatcaatgagtgcataccatgtgtgcttttctgtgattgggttacctcactcagtcacctgagtttttgatcttagctattctgactggtgtgaggtggaatctctgggttgttttgatttgcatttccctgatgactaaggatgttgagcatttctttgggtacttctgagccattcgatattcctcagctgagaattctttgattacctttgtaccccattttaataggattatttgactctctggagtctaatttcttcagttctttgtatatattggaaattagccctctatcagatgtatgattgataaaaaatcttttccgatctgttggttgccattttgtcctaatgacagtgtcctttgtcttacagaagctttgcagttttatgaggtcccatttgtcgattcttgatcttacaacataagccattggtgttttgttcaggaaattttccccagttcccatgtgttcgagggttcttcccactttttcttctattagtttgaatatatatgattgcatgtggaggtccttgatccacttggacttaagctttgtacatggtgataaaaatggatcaatttgcattcttctacatgctgacctccagttaaaccagcgccatttgttgaaaatgctaatttttgtccattgaatgattttagatcctttgtcaaagatcaagtgaccatacttgtgtgggttcatttctgggtactcaattctattccattgatcttcctgcctatctctgtacgaatatcacacagtttttatcactattgctctgtagtactgcttgaggtcatggatggtgattcccccagaagttcttttatggttgaggatagttttcgccatcctggattttttgttattccaaatgaatttgcaaattgctctttctaactctatgaaaaattgagttggaattttgatggggattccattgaatctgtagattgctttaggcaaaatggccatttttactatattaatccagcctatccatgagcatgggtgatctttccatcttctgagatcttcctcaatttctttcttcagaaactcgaagttcttatcatacagatctttcacttgcttggttaaagtcacaccaaggtattttatggtatatgtgactattgtgtcataatttctttctcagtcttttatccttggagtagaggaaggttactgattggtttgagttaattttatacccagccactttgctgaagttgtttgtcaggttaagtagtctcttgtggaacttttcgggtcacttaactatatactatcttatcacctgcaaatagaggtattttgacttcttcctttccaatttgtatctatttgacctccttttgttgtctgatttctctgggtaggactttgaatgctatattgaataagtaggaaaagagtaggcagccttgtctagttcaattttagtgggattattcaagtttctctcgatttagtttaatgttggctactggcttgctgtatattacttttacattttatattactttttttatgtttaggtataggctttgaattattgatctgtccatgacttttatcatgaaggggtgttgaattttgacaaatgctttctctgcatctaatgaaatgatcatgtggtttctatctttgagtttgtttatatagtggatcacgttgatggttttctgtatattaaaccatccctgcaaccctgggatgaagcctacttgatcatgatggatgattgttttgatgtattcttagatttggtttgtgagaattttattgagtatttttacgtccatattcgtaagggaagttggtctgaagttctctttctttgtcgagtcttgatgtggattaggtataagcataattgtggcttaatacaaggaattgggtagtgctccttctgtttctattttctggaatagtttgggcatagtttagtatgaggtcttctataaaggtctgatagaattctgaactaaacccatcctctcctgggcttttttttttttttagttggagacttttaataactgctcctatttctttagaagttatggtactgtttagatggtttatctgaccctgatttaactttggtacctggtatccatctagaaaattgtacatttcctccagattttccagttttgttgaacttaagtttttgtaatagaatctgatgatttttttaatttcctcggattctgttatttctcccttttcagttctgactttgttaatttggatacgttatctgtgccctctgattagtctggctgaggatttatctatcttgttgcttttctcaaagaagcagctcctggttctttgtatagtcctttttgttactacctggttgatttcagccctgagtttgaagggctcttcaaactcctctactcctcttgggtgtatttgcttctttttgttctagagcttttaggtgtgctgtcaacctactaatgtatgctctcccctgtttctttttggaggcactcagagctatgagttttcctcttagcactgctttcatttgtgttccataagtttgggtatgttgggccttcattttcactaaattctaaaaagtctttaatttctttctttatttcttccttgaccaagttatcattgagtagagcgttgttcaacttccatgtatatgtgggctttctgttgtttttgttgttattgaagaccagccttagtccatggtgatctgataggatgcatgggattactgcaatcttcttgtatctgttgaggcctgttttgtgacagattatatggtcaattttggagaagctaccatgaggtgctgagaagaaggtatattcttttgttttaggataaaatgttctataaatatctgttaaatccatttggttcataacttgttagtttctctatgtctctgtttggtttctgtttccattatctgtccattgatgagagtgggatgttgaaatctcctactattattgtgtgaggcgcaatgtgtgctttgggttttagtaaggcttcttttatgaatgtaagtacctttgcatttggagcatagatattcaggattgagagttcatcttggtggatttttcctttgatggatgtgaagtgtcctttcttatcttttttgatcacttttggttgaaagtcgattttattcaatattagaatggttactccagcttgcttcttcagaccatttgaggtagtgtctgtctttgtctctgaggtgtgttttctgtatgcagcaaaatgctgggtcctctttacatgtccagtctgttactctatgtctttttattgggaaattgagttcattgatgttaagagatattaaggaatagtgattgttctttcctgtttatatttgttagaggtagaattgtatttgtggggctttcttcttttgggtttgttgcaagaagattactttcttgctttttctagggcataatttcctttattgtgttggagttttccatgtattatcctttttaggactgtgtttgtggaaagatattgtgtaaatttggttttctcacggaatatcttggtttctctatctatgttaattgagagttttgctggatatagtagcctggcctggcatttgtgttctcttagggtctgtatgatatctgcccaggatcttctggcttttcatagtctctggtaagaagtctgctataattatgataggtcttcctttgtatgttacttgaccttttttccttactgcttttaatattctttctttgttttgtgcatttggtgttttgacttttatgtgatggaaggaatttcttttctagttcaatctatttggagttctgtaggcttcttatatgtttatgggcatctctttctttaggttagggaaattttcttctataatttttgttgaagatatttactggccctttaagttgagagtcctcactctcttctatacctattatccttaggcttgatcttctcattgtgtcctagatttcctggatgttttaggttaggaactttctgcattttacattatctttgatggttgttttctatggtatcttctgccctgagattctctcttctatttattgtattctgttggggattctttgcatctatgactcctgatctcttccctaggttttctatctccagggttgtctccctttgtgatttctttattgtttctgtttccgtttttagatcctggatggttttgttcaattccttcacctgtttgattgtgttttcctgtaattctttaaggggtttttgtattttctctttacaggcttctacttgtgtttcctctttaagggcttctacttgtttatctatgttgtcctgtatttctttaaggaagttacttatgtccttcttaaagtcctctatcaccatcatgagatgtgatttttaaatccaaatcttgcttttcctgtgtgtttggatccagtatttgctttggtgtgagaactgggctctaatgatgccaagtgtccttagtttctctttcttaggtgctgcgcttgcctcttgccatcaggttgtctctggtgttagattgtcttgctgtctctgacactggcttgaccctcctgtaagcctgtgtgtcagcactcctgtagacctgttttctttcagctggatctgggaacagagagctgctcctgggtttgtgtgtcctgaggccaccaggcaggtcgcttggagcagaagtgttggtcttacctctgctctcaggtgtgtcagcacttctggcaactggctttcagctctggacacaggcagaaaccagaagatttctgcccctgactgctcctagcttcctatgtccagagggcacagagggcactaggtgggttcctcttggtccatgaatgtcagcagaagtagttgtctcctctgagctctcaggactgtccacacttttgagagtccatctctctcccccacaggatttgggaacagagagctgtgggagcggttcagctccgggtgcaggtagaaaccaaaagtatcctgtactagacttctactgcctttattgatataaccatattttaatcccaaaagcaaaaataaatgctttatttctggtcttgagctaagggtatagttcaattgttagagtacttgtctgtaatgcaggagccctggatctgatctccattacagaataaaccaaatgtggtaatgcatgcctgcaatcccaaatcccaaatctccaaaggcgtacacaggaggatgagactttcgaagtcattcttgtctacatagcaaattagagaccaaccttatctttaaaaatagtaataatcctgatcttccacttgaagtaaatgtatccagtaactgtacctgataccattctatgttagattttgtttcagggtttcgaagataagttctccagagaagcacaagtagtgggagatggcggagagagggctggtagatgaacccataaacaacaaacaacagagctggaggacaattaggatgatatgtagttagaaacagagggacagcatataagagacaacagggagataacacataagagacaacacagggataacacacaaaagacagaagagagataatacataagagacaacagagggacagcgcataagagacaacagggagataacacgtaagagacaacagagggataacacataaagacttagagttttatggttcgccttgactagattaaggaatgaatgcctgtggaggtgtctatgaaggactttccagaagtgttaggtcttagggggctctgacttagccctttggtggagtgagaatgtggtggcattatagaaaaatgctgaacagtaagaagtccaggtggaggaagcagattactgggggtgtgcatgggccattacatctgaccctggacactacattccctttatctctacttcccatcagtcaagaaataaatagcctcttccacacaaccccactgtcattatggccctaagcacataagccccccaccctttaagtttctttgaggtatctggtcatcctggctcccagctccaagtcacccaaagggttcatataggcaagcatttccacctctaccgtgttccatcacaaaccactggctatttgagaaatttcagacagctaaagaatggttctcttagcactgatggccttgcattcaagagacttgcctgctggtttgcaaacctagaggctatggcactgaacttggacacccggtggcgtgctgcttttggcatagagaaagctgacatccagcagctaagtgactgctcctgagctttggaactcgttctcctgtatcaccctctacatccaactcttctcagcttgtcttctcaatatttccactgtccctcatcaccttagattcttgtagacgctgccctcaatggcttactggctcctcaactacttcctgccactgtcgccctcagggctggaaacctggagccttgtctgctcttggcacagccacacagcttactctacccatgacaaataaggagacttggagaccatttggggaaagcctttatcagggcctaatgggtgcacacttggatcaggagtcatccattggagagaagcctcaaggaatagtggggaacatactgtatctagagacagtatagggtcatgatggcgtggattatactccccacaaagacagccctgcatgtgctctgcttccagtctcaccaatcacaaccctcccgtatgaacccatcacagcccttgcacagattgcaggtctcaaatatgttcacctttctttctgacataaccaggattttttttaatttgcttgcgtgtttattatttctatttattttattcattttttatttattattttacatcccactcactacccctctccccatcatcccctcccaagatccttcccccatcccctctccctttcacctctgagccagtggtgccccctccgtgtatctcccaaccctaataatcaggtggtttgagccaccagggaagatgctcttcttcctttctgaccttgagagctgctattccaaggtcctctggagctgtgtgtgtgaagtcacctggaggtcataggtggagtggagttttaaggccatggtagaggctggagccatagtagttggaacaaggctgtggtttcagcagcagccatgattgttgtatactttgcagctcaaatatggtctcctcagggctctgtgaggtattcaaagcacctagaatcccatgatgacacttccaccagtctctaaaagagacctaagactactagatatagaaaaaggccaacttaagtacatcaaaaggtcaagccttctggcccctaatggctcattttacatgaagaaaaggtgaccattacactatgcccaataaagacatgttacatttacactacggtccttggcatcccttagcagatgatcctagggagagctgagcaatctcgtccatctcacctccacccagtcaccaaaataacactgttctaaggcacacttctgagacttacagagctactagagagttgggggtagcagtaagacctttccctggccctcaagatacgttcacacccacatcacatatatgagttcgcatacactaacacacacagcacatcttggacatggcccattcaggaacagatctgtcatgatcgcttgagttaaggaaccactcaagggaatgactaaaggaggatcccactggagtcctggcccacaggaggaggtggaataaaggttaggtagggcaagacaagggcactaaagccactatgctgctggggccactgtggacactgatggccagaaatggaatgatcagcctgtaggcaggaggggggagggaggatgattcctgaaaaccagaagagtcaccgtggagtctgaaccaggaaggagagagagctcccagtgtaaccctaaggcttaagtagttgcaactgcctcctctccttccagaggaccacccactgccacctagcatagcactctgaggactcagaaccagcagcccagcataagctgagtgtcaaagaagaatcaggcccaagcaggctggacacaaagtttcttggtcctcaggctatgagggagatggagtccttcccactattcggggcacaccacagacagcagcacctgatccagttggagcaaaggctcctcacccctgtgttttccctcagaaccacaagtctttccaggaaactctgtatttacccctcagattcccacccaggtctgttaggctaaaggccaagcctgtcacctcagactatctgaaagagataaaaccaggcaagacccccaattccctcagatctcacaccccgtgttcccaaagtccctaactaactttcctggggccagcccggggcctacctggttcttccactgtcagttagctctctgatgtcttccaaatacaattaaacacccttctgtgggaagtcagacttggcaaagcctaagtcccccagtcccttgcatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagctgctgggcccacacaccatctttaccctctccccttccctcagtgcagacgtagaccacaggcctggaagagacgttagctgtttctatggtgttccatgagacccagttactccccagatgtgctctgtccttgccagagtagcaagtagaggaccccaagccgaagggcggccacttgtgagtgattaccagggaagcccactgtctctagcatgccagctccaaagctgagacaggaaccagggggcctctatcagaggccctgcgtgtcatatcgtgcccacaggctgttcctctttgtgtatcgttaataacttacaacgtgactgccacactgccccgaaggactgccaagggaacagaaaaggcaatggcttgagtccagtcccttttcagggcagtagcactccaaaggggcaggcatcgtgactgcaggaacatgcaagtttctaacgtgagagctgtgcagaacaccagacaacgaaaagtgccctgaccagagcgtgcaggtgtgtctcctagaaagaggcctcacctgagacgccactgtcccttagtcaacttcccaagaacagaataaaaaagggaacttccaaggctgctaaggccgggggttcccaccccacttttagctgagggcactgaggcagagcggcccctaggtactaccatctgggcacgaatgcaataatggttactaaagattcacaacgtctgggagcctgcacagggacaggagatggctgcagatgagaagagcctggctagccacagccacttaccagcggacctcaggtatcatagcctgtgggaccctgagccaaagggtttgcccaaggagaatgggcaaacaggttacagggtcctggatggggaagggggcacctgggctgccttctaacaaggacagagtctcttggtcattgcctgtccttcagctgtcactcctctgcattaaggcacacagttattagacactactaccgctatccacaaagacaggggactgtggatctcaaccagacatggctgaaccaagagaaactgaagatgtcgtgagaagctcagaaaacgccaggagaagctgaataggaatctgcctgcaaaccatcagggcaaggaggcaataacaagtgacagagccaacgagtgacagcaaggaattgccctgtgatgaactaacaacaaagctgggctgacctgggctaagctaggagtgggatctgtgctgcactgggctggaaggagccgggatgagccaagcaaagtgggttggactgagttgaattggcctggactagtttgtgttgggctgggctggcctggaataggtaggctaaaccagcttaaactagggtaggctgggcttaactgaatcagactaggctagactaagcagaactgggctgggttgaactgggctacactagcctggtctgatctaggataggctgggctaagctgagctggactggctggactgggctgagctaagttgcactggacagagctgggctggagtggactggactgggttggattgggctggactgggctgggctaggctgagctaaattgcactggacagagctgggctagagtggactggacagagctgggctagagtggactggactgggctgggctgggctgggctgggctgggctgggctgggctgggctgggctgagctgggctgggctgggctgggctggactgggctgggctggactgggctggactgggctggactgggctgggctgggctgggctgggctgggctgggctgggctgggctgggctgggctgggctgggctgggctcagcaggcctaagtaggcctagctgggtttagctaggtttggctaggtaaggctgagctagattggactggactgaaccaggtggggtatattcagctgacattgtttggtctggtctggactgaactggactgagccgggctagcctaagctagatggggggtatactcagctgagatgggctggtctggctagattgaactggactggactaggctgagccaggctgacctgagatgtcctgatctgggctgaactgggcagggctggtctcagctggactacactgagttaacctgggctgaaccagactgggctaaactaggttgtactggctggattagacttggctaaactgggcttggctaaactgagtcaggatggtctaggttgatttttagttgggctaaactaagctgaactacactgaactaggcaagactgggctggaaaggtctgagttaaattaggagggacttggctgggctgggctgggctgggccaggctgggctgagctgggccaggctgggctgagctgggctgagctgggctgagctggattgagccgggctgaactggactgagctgggatgagctggactgagctggactgggttgagctgaacaaaactaaactggaatgggctaaattggcctaaaattggctaggctaagctaagtaaggctgccctgagctgagaaggactggattggcctggactgagtttggatgagcatcattggactatgctaagctaacttgggtgaagtgggctaagcaggactaatctggcctgatctgagctagaccaagctaggccaagctcagctaagtttagcttagctgaattaggctgggctggactgtattgagctacactaaatttaacaggctgagctgagctgagctgagctgagctgagctgagctgagctgagctaagctgagctggttttgtctaaggtggattgacctgggctggactgaactcaattggactacactgaacttatctggacctcactgagctgtgctgcactgggccaaccctggatcactctagatctagcttagctggactgggctgagctagattgggtggactgatctaggctgaactagactattcttgcctgaggaaggctgggctatgctgagttgaactaaactgaactcagctaaggaaggctaagctagactgagctgagctacgttgggttgggctaaactgggctgagctatctcgggtagactaggctgagctagactaaattgggctgagctggagttggttggactggactgggttgggctaagctgagctgatttggtgtaatctgggatcaggtggcttgagctggactggactgtctgagctaaactgggttgagtggagctgagtgggtctgagtgaggctaggctggaatgagctaggctaaactgggctgaactggtttaggttgaatttagctgagatgagctgggctagacttctataagatggctgaactctgctagggtgaactgagctgtgctgagctgaacttggattaactataattagttgagctgggctgaactaggctgagtttagctggaataagagtcaactgggcccaactgagctaggctaagctaggctgaactgggatgagctagaattactgttctagtctgatctggactaaggtagactgggctggggttgagctctgttgggctaagcaaagttgagctatgagatgaactaggctgaattgggtacttctagatcattccaggctgttctgggttgacctgaactgggtgggattgagctaagtggggtaggctatgctgagctctgccaggctgcatgagtttattgatctgaactgggacaggctggaatggactggcctgagctacaccaactgggctaagctgggataggtcaggctaggaggagtcaagctggactaggccaaactattataggtcttttggtctagttgaactttctggtgcttaactgaactgtgtttaagatcgattgctcaaaccagagggaggagaagcccttggccctgccaaggctggaccccacacacacaccagtgtaggggaatgtcaggacagagaggtggaaaggggtgggtggttgggtgggggaaaagtgataacatttgaaatgtaagtttaaaaaaaatccaaaaaataaattaatttaaaaaaaaatagattgctcgaaattttttatggatgtttttaactgttctccaagaagattgtcctgatatagtagccagactatatcagggtaggtagagacaatcaggtttatcagaaatatcctatgctttctgggggcctggcacagagctgaactgggccccaggctcaggagaatgtcacgggcatgcgggcactccagaataatttaggcagccatcaaggtggcttctgaagtggttgtattctctaactgtgtgctgtctaggatctgcagaggtcactaggaggcagaacactttgcaggttagcctgtggtaaagccaagagccccatgaatctgaaaggctgagaccaatagccctaggaaacaagggtctcacagttctgtcattaatgtgtcccaaaacagatttaatgtgtctcgccaaggaactggtgctcctgggaaagctctgaatccccaggtcccaaaagtggggacggaagatacaaaagtaattcactggatctctgggttcccaagccctttggggtacctgtgtcttggatttaaagtatagcctggtccctctggcaatatcatacagcctaccttaaagctactccattcaccctgagaacctaatggcttccagtctgccacccagttctcctgcttcatttatgggcatatcagagataataccactgtcaccctgcttaaaggacagacaggaaataactaacacacacatccccaaaagttctcagtcaagaaagagagcaaagttgcctcttcctccaaagctcatacccagccctcctggaagcccctgtgctaagccagctaggggcagtgagcaaagcttggcagagcatcaataatcaggggcctccctgggtttgtgcttgggtttagagaatgaagacaagacccagaaggagactgtctcctagactggaagagaatccccagaaccctgctcctgtcacagctgccctaatcagtcccctatgctgcaggcatgcagtgatctaaacaaatctaacctaggtccttcctgtcccacagtttctgtcaaggccccttcactctatcccttgaagccctgtagcagcgaaaacacggcttcggtgacattgggctgcctggtaaaggactacttccctgatccggtgactgtgacctggtattcagactccctgaacacgagcaccatgaacttcccgtctatcggttctgatcttaagaccaccaccagccaaatgaccagctggggcaagtcagccaagaacttcacttgccacgtgacacatgccccatccacattcgtcagtgacttgactatccggggtaagcagggttgagctggttacagttaccacaagagggaacatggtcagagcagaaaggaccgctcatatatacctataacagggggccaggggacccaacatactcaggggcctggtttgaggcttgaggggacataaggttagggagatactcacagctcactgcctctgccctagctcgacctgtcaacatcaccaagcccactgtagatctactccattcatcctgcgaccccaacgcattccactccaccatccagctgtactgctttgtttacggccacatccaaaatgatgtctctatccactggctaatggacgatcggaagatatatgaaacacatgcacaaaatgtcctaatcaaggaggaaggcaaactagcctctacctacagtagactcaacatcacccagcagcaatggatgtctgaaagcaccttcacctgcaaggtcacctcccaaggcgagaactattgggcccacactcggagatgctcaggtaggcccacactcgcctgatgctgagacctcagagttctgaagggaaggcaggctcttacgcagcccttcctctcttacagatgatgagccccggggtgtgattacctacctgatcccacccagtcccctcgacctgtatgaaaatgggactcccaaacttacctgtctggttttggacctggaaagtgaggagaatatcaccgtgacgtgggtccgagagcgtaagaagtctataggttcggcatcccagaggagtaccaagcaccataatgccacaaccagtatcacctccatcttgccagtggatgccaaggactggatcgaaggtgaaggctaccagtgcagagtggaccaccctcactttcccaagcccattgtgcgttccatcaccaaggccccaggtgagcacaggagatggagagtgggccggcccttctctgtgttcagatggcacggttaactggttaactcgtgtctgcccacaggcaagcgctcagccccagaggtatatgtgttcctgccaccggaggaggaggagaaggacaaacgaacactcacctgcttgatccagaatttcttccccgaggatatctctgtgcagtggctgcaggatagcaagctgatccccaaaagccaacatagtaccacgacacctctgaaatacaatggctccaaccaacgcttcttcatctttagccgcctggaggtcaccaaggcactctggacacagacaaaacagttcacctgccgagtgatccatgaggcacttcgggaacccaggaagctggagagaacaatatccaagagccttggtaacacttccctccgtccctcccaggcctccatgtagctgtgatggggaaggtgaatggcagacatctgcccactgttgtaacactgggaagccaccccaataaacactcagtgcctgattagagccctgggtgcccttcttcggggaaggtgggttgtgggcagaagtatcttggcctgaaagaagggaaaccccaagagagggacaggagtgaagcatggctcacccatctgtctatgtgttgggtatttgacaaataggacatcacagggcttcagcatagataaccctggtccttcctgcccttcactgtatcatgcacctgaaagggatccaaagagccagagaggtggtctctagagatgtaggtaaaatgaaccaacctgagaggcctcggcacccacccctcagtcttgcaagctcctgctcccaggtattcctggatgctggaactccttaaggtagagaaacagccaaagtcaacatctggaaaggcagaagtcagcatggccctgctccttccctctgtactcagcagccattgaggctgagcctacggccctgacctcctgtgtgccatgtgatcataccagacccggatcagaacctggtgctcctcatctttcaacccaaagtcatcccaaggcccagaatgggaagccagcttcacacagttgggttctcccatctatgccatgttctcacacacacacacacacacacacacacacacagagccacaaacactcaggccaccaagtcttaaagagactccaccaacagcacacacttgcagccacctgacacaacaacacacctcacccatgttcacatgtggcctgcgctaggcttcagtctgtttccagtcctttaccttttacacttgagtccaaaataaaaacagaagacttacgccctgagggagagaccagtgtcttcttcctgtggcctcagctcccagaacactcttccctaccttctacaacactaagacagtaagatacacccacacgaacataaatacatacacacacacacacacacacacacacacacacacacacacaccccaagtaggcttcatcatgctctttggtttagcaatagcccaaagcaagctatgcatccatctcaggcccagagggatgaggagaccagaatcaagacatacccacgcccatcccacgcccaaccaccaaccaccagcacatacggttcacacacctgagaccagtggctcccatcacacacacacacacacacacacacacacacacacacacacacacacacaagcccgtacacatccaccatatccagagacaagtgtctgagtctgagatacctctgaggatcaccaatggcagagtcggccagcacctcagcctccaggccaatccttatactttggcccactgcaggccatgagagatggaggaggtggaggcctgagctgtggaaaaccagagacaggaagatggtctgtatggagagagtagtaaaccagattatagggagactgaggcaggagtagagctcctacaaggccagtagtctaccttagagtcctataagtctgggctgggagtccatgtgtcctgacttgctcctcagatatcacaaccaagattcctggagccagagtgtgcatgcaggccttagaaatggagcttagagcccttcctggagggccctgggcactctgaacaaaaggcaattctgtaggctgtatagaggcatcctgtcagatacacacacacatgcacacacatacacacacagagacacagacacacacacatgcccacacacatgcatacacacatgcacacacatacacacacagagacacagacacacacacatgcccacacacatgcatacacacatgcatgcacacacacacacatacacacacacacacacacacacacacacacacacacacacacacaccccgcaggtagccttcatcatgctgtctagcgatagcccttttgagggtgggagatactgggtcatggtgggcactggagtagaaagagggaatgagcagtcagggtcaggggaaaaggacatctgcctccagggctgaacagagacttggagcagtcccagagcaagtgggatggggagctctgccactccagtttcaccaggactgcctgagaccagtgagggatccaccctgccacactgtcacttggagtctggggacgctaactggctggtccccccatcccagagctagacatccaggacctatgtaccgaagaggtggagggcgaggagctggaagagctgtggaccagcacttatatcttcatcagcctgttcctgctcagtgtgagctatggggccactgtcactgttctcaaggtgggatcctgcacctcggtgggtgggtcagggaggtctaggccaagctgcagcgccatcctcacatacacctttcccccaggtgaagtgggtcttctccacactgatgcacgatacaccccagaccttccaagactatgccaacatcctccagaccagggcatagatgcgatgccagcacccgtgcaggcctgcagccatgtgtgtctgagcctcctgaggtgcctgtttgccttggatggtaggtgggagcagagacccctaaaggcaccagagttggtgagatgtcaacatgtagaaggtgcggcttggggcagcaatgtgggctgtcccgcatggatactttgagacaggactttgaagagcctcaatttgacctatcaaatgctggtcacccaggtctttcagcatcagggtcactccatattgactgaataaccacaaaagcacaagaacccagagcctagagtccccactaggccccacctagagcacagagtcaaagctgggacactcagaatcaacccaaagtccagacccttgctcctcagaaggaatcctgccccactgcttccagacagacctctggcctaggcagatcgtcctactgccagataaggagcctcccacagggcagcagcagactcaagctctgaggccccatcaaccccagccccagcctggcagtcctactttgtctctggtctctttagtaaagttcttttccataactcctgagagtgctttgagaaggtatttaaggctaccattatggtgatgacaggtcccaagaacatggacaaggaccagatggtaagagcctggggattaaacatccacctctatgccatcctcctcaaaccacagagttctgccccagtctccatccggtccatcattcctgctgaccagactcacctcccaggggaattgaggtggaatcagggctgggcccccgggaacctggctgcaggtcactcttcaagaccacaatctgcccacccagtaagtgcagactgacaggccagtcccctgacccaagctgggacactagagggactaggtaacagcacgcaagtgtacaagaaccatccaaaatgggttgtgccatcctcaagacatgatctcacatgacaaaagacaggcttctctcatatataatgattgctcagggactaagaagaaagacctcttcatgggacggaaaaaccagcagtcactgtttttttcctgaagaaaatgcttcaatggtgagaacacttctagaaagaaggatgttagggtgagtgtggccctgctgggccctgggtaaagaaaggcatgagaactacttagaccattttgagggtcagttggccaaacactcttgtcatcacaagtgacagtctcacaaagaggtccacactggggtgtcaagctcagcaccaggggactttgggggaactaagatagggataaaccagccgggatcaggccatagtccacaggcatctgagccctctgctgctgagtccggcttctacgggccttggagtagggcccagatggcaaagacacagaaagctacccctcctgggtgcagaagacccaggactgggagaatgactgttctgatgagaaaagaggctctgtttaggatgtgtcccaagccattagtgtggccagcttactaatgtgcattcatgctgcaaaccattgctcacaatcaaatgtataccacgcacacagtcacgtagtttgcgcagacccactcatgtggcacatgcctgtgggcacatgggaccacacatacacgtgatgctttaaaacacagatctgcacggtcttgtacttagacacacattgtctcaggaagcccaggtgtggaccaccctgtcctcctgccacattctcctaagccatatcccctgccaagctgaggcctaggtgcctcttcctcaaccagctcctagaccaacatccctgaggcatagctcagtgtcttcttctaatcactatccctccaagccacgagaccccatagacactggacacgggcagcaagggttcagctcaaagaacacggtgtggcaggaactcctaccaaatcccaactagaaggaaggaaagtcccacagagagctagactcactctagacaacccagacagtgaccctggcttctacataccatgaatgaatgaccttctgagactaagaggtcgctttcttctctattcctacattatcagtccaccatggagggctacatggaaaaccccaaaagacataatcacattttggaacccataaatgtagcctcttgggaatagttcttcatcaatgtgaccaaggtaactatctcaagacgaggtcatcaaggactagctagtggactttaacctggtgacaagagtcataagagacagaagcaggacctagggggtaaacagggcctgcattctccaaaatcaaagtgtcaaaacagaaatatggcagcaaaacagaagtaccgtgcccaacactggtcaagaccaatgggggaggctcatgaggggttgcctaacaagagcaggcacaagtgcttagataaaaccacaacctacactcggccaccgtaaccctacatagaaaatgtacctatgggacgtcagctcaacgtcagtcccacctcgttgctgtgcgcagacagctgcagcctgaataacctgtccaagtgtgcatgtcacatccttgatgacacactgtaaccagtgatgccatgttagcacgatgtcctgtgagggtgtcttctgactcgggatggcaaaccctaagaccaaaaggaggtgcttggttcacgagagcggcctcgtggctggacacatggcgttaaatgagcctctgtggactaggaagcagctttaaccagaaagactataccagcaccctgcttcacgtttccacctttgagcctctactgactaagccactggcagccactcagcctgtggtattctctaacggcaacagaaatgactaagacaggcaaccacaatgtcccccactgctgatggctccagggcattcttggcctgatgacaggacctccagagcctccttgagacaggcagatctctggagggcaggaccaagctttctcctctctacctccccaacatctttgactagcttcacagataaaaggctagggggacatcagtttattccacactttctaagtctgatgcaggagcccttcctctgcgaagtatctatccaagaacccagaaaaggctaacttccccaactcaacacttagcaccactgacacacctgaccatacccactgatttacaacctttctcccagacagggccattcctgggcaaagactgtggtgtgagggcccagagtcctattgttgtataaatgaggcacagtggcagaggcaagctacaaagagtgacattgtggagagaggacactggggacagtcggatgtgtagaggatcatatgaagggtggagccctaccctgacaatctacaaagagtgacattgtggagagaggacactggggacagtcggatgtgtagaggatcatatgaagggtggagccctaccctgacaatcttcaagaggctccataggtcaaaggcccatcctgagaaagctgtgataggaaattgactcagggcagatgggatccaaatgagggtagcacctaactgtgacctacagacctccatgttggtcctcaagttggggcacccactttctcatggacgtagccatggaggtagccacagctcgtgacaagccattccagacacttgcctcaccccgttgtcaaccctgtgacctcaaagctcttctctgaggcccccctcagcttagggacccctctggagtagccctgttactttggctccttgacaacaagctctcaggtctcccttctacccctaattgtcctctccctctccatctctgccttggagtctctgagaaactagatgttcatttcattccctcctgcatctcctgcccaacctacccctgtggccatgcatgtggagtcctggccccatccaggcccgtgtggtcagacacacctgtctccaccacagccagaccacaggccagacatgacgtggaggtaagcggccacaatgtggaggtggaacaggaagtgggtgagggaccccatccaggggccagacacacagtcgtgcagccccctcaccgctcagtctgacccatccacaggcaaccacacacagagaaaaccagtttccagccaaggcttcacccagtcctaagctctctccggtagggcagacggcctttagccatgagaatggaccttcagggtgggaccacctggccatgggaggcctggctgttcccctatgaatgacactcaacaaccttgagcaggtgggtcccggtaccatctggactgctctgctccttggtgcactggggaatctcaaccaggccagacctgagaacataaggcagagaagcattagcaaggagaaggtgattcggagagcaagaaccagaggaatacaggacatgaacacaggcacgaggcggggtcatggtctgagctgcagagaagagagaaaaatggatgaaactcagcttcctggaaagcagcaacaagagactcccaggctagactgaggcaaggataaggaggcatcaacaaagaatgggggtgactcgggctgccatggctcagctgagctggatttagccaggctgagctgaactaagcttagctgaggtgaatgagactgagctgagctgagctgggacaaggtaggccaagttgggctgactgagctagtctagactggtctgggctagtctgatctggactggtctgagctgaactgagctaagttgagctgggataaactgggctgaggtgggataagatggcctgacttgggtaactaagccagtctagaattggataaactgaactagactggtccaaactggactagactgagctggactgagttagaatgaggtggactgggctaaactgggctgagctaggttaagctagggtggactagaatgctgatttaagatggcctggggtgggaacgctagctaagccagaccaagctgggctaggctgggttaagttgagttgagctacagtaaactagcctgggctgtgctgaccttactacaccaggctgggtttggttggcatgaatggagctgatttgagctgggctagaccaggttagtatgagctatgctgtcctggtctaagtagactgggtgaggctgagaaaattcgagatggaaactggactgagatggaaaaagataggcttagtgttggcttactgaaccagtctagaatgagctgaactggacttggaatggcctgaactgggcttagcttatctagcctgggcttggctaggctggcctaacctaggctgagttgatctgaactggtgtaggctgggataggcttgctgaaatggactaggtcaagctgggctggagtggggttagctaaaataggtggactaggctgagatgagttaggatgacctgagctatatttaggggatggatgggatgggatgggctatcccaagctaagctgggctagaatgggctagtgtaagctaaactggctgggttggaatgtgctgggctgtgctaagctagaataaactagagtggactggccaaaatcggctgggacggtctgtactgaaccaggctgggctgggctaactgagctagaccggtctgaggtgagctaatctgggatggggcggactgagctgggataggctagattaagctgggatgagctaggctaggctcactgagctaggctggaatagaccggtctaagataggctgcctgagctaaactagactgagatgaactgtaatgagctgggatgagctaagctaatctgggatgatctgggctaggctggaatggactgagccgagctggtctcagctgggctgggttgtgctgaatgggggtaaaccagactaggctacccagactaagctgggctgtgctgggccaagctgggctgagctagggtgggttgggctcgatggctgggctaatccaagctaggctgagctgagctggactgagctgggctggacggagctaggatgggattgactgagctgagctggactgaaatgggctgagctgagctaggctgagattcgctgagctgggctgagctggactgagctggactgagctggactgagctggactgagctgggctgagctgagctaggctgagattcgctgagctgggctgagctgggctgagctgggctgagctgggctgagctggactgaaatgggctgagcagacctggacaatgcaaggctgcactgaactgtccggctaggctatactgggatgagctgagctgggctggtctcagctaggcttggctgtgctgcatggaggtaaaccagactaggctacccaagctaaactgggctggaccaggctgggctggactgagctgtgctgagctggactgagctgggctgggctgggctgagctgagccaggcttggtttggctgagctgagctgagctgagctggactgagctagactgagctgggctgagctgagctaggctggactgagctggactgagctgggctgagctgagctaggctgggtttggctgagctgagctgagctggactgagctgggtgagctaaggtagactggaattggctgagctaagctgagctggactaaactggactaagctggactgagctgggctgagctgagctaggttaggattggctgagctgagctggactgagctgggctgagctggactgagctggactgaaatgggctgagaagccctggacaaagcaaggctgcactgaactgtctggctaggctatactgggatgagctgagctgggctgggctaagttgacttgggctaggataaactaaactgggatgagccggggtgagctgcatgaggtaggctggaatggctgagctagactaggccaggctgagctggaatgagccgagttgagctgagctgagctgagataaacttagtaaggctagaatgaattgagctgagctaggctgggccgacctaaagttgctctgaggtaggttagacatggttgtctgagctgggctgagttaggctagctataccgtctgggctgacctaatatgcccatattagttgtaatgacgtgacctaggttgaaacgggcttgctgatctgggctggactgggccaaactggagttagtctagcctgggctgacttagtgtagcctgggcagagttagactggaatgggctacactgagctgaactaggatgggatgggaagggataggctgaactgactgagctgggttcagttggccttgctgggctgagctgggctggatagtctagctgggctggccagaatgaggcagagctaggctggaattaggctaaacttggtttggctggttaagatgagctaacataaattaggctggctgaactacactggactgtaagctagcctgggtgagttcgcatggctggacgtcttcacagctctagtctgagttttactggtttgttctcctcagtgctgaggtaatagaaagactttggagtaaatgtgaaccaactcttgtttcatgggtccagactgtggcctcagtttgtcttatatgaacggagccacgccactcagtgtccaattctcatgccctcttctccttccctgattacctggtggaaactcacatgtacctgtagatagtgcctacatggacagaaccactgctcagatttagtcctctggccttttggtccactgcttgctgggtggatgggcaggtggctggagtggtgggtctgaagccaggacaaggcaagtataaagtaaaaacacaacaaaatggcccccaccccccagtgtaacctccaagccagctgttccccaaccattcctgccctgtgctggctgaggttggccgtccctgctcaggcccaccagttctggacctcctaacctgggactgagaacacggctctacccactgcccaagcaggagtggggctcagaaatctggggcgctagactgctcaggagcatagccatgtttacaaagacactcacagtgcgtacaagccctgctggaggcatctagccagatccttgaaaaagacaacctgcaggtcacgttcaaaatctatgcagccagtcggtcagctccaactgcgggtacatgatgcaacccctatgtgatactgggcctaggttctccggtataaagaagaaaaaggcatggtcctttctccagagattgtctcaagatgggcagtgtgaggactactatctcactcatgttttatgttccagagtccgcgaaagatcccaccatctacccactgagacccccaccatctccgtcaagcgacccagtgacaatcggctgcctaattcagaattacttcccatccggaactatgaatgtgacctggggcaagagtggaaaggatataagcgtcataaacttcccacctgccccagcctctgggccatacaccatgtgcagccagttgacattgccagctgcagagtgcccaaaaggaacatctgtgaaatactatgttcaatataacacaagccccgtcagagaattgagtgtggaatgccctggtaaagaaggttgggggggtctggggtgggctaagtcctaccttaacctggtatctggacccatatacccctctgaagcacacatcccactcagaaacctcccatgggggatggggggagggggtgtgaacaggcagagggagcagaggcctcagaacatccagaaaaggggacagcaaaggagaaaaggagactattctgatttgctaaaacttctatgttacaggtccaaaaccctccttagtctgccgccctcgcctgtcactgcaacggccagcccttgaggacctgctcctgggttcagaggccagcctcacatgtactctgagaggcctgaaagagcctacgggagccgtcttcacctggcagcccaccactgggaaggatgcagtgcagaaggaagctgtgcaggactcctgtggctgctacactgtgtccagcgtcctgcctggctgtgccgagcgctggaacaatggagagaccttcacatgcacagctacccaccctgaatttgagacccccttaaccggcgaaattgccaaagtcacaggtgggcccagatgcatacctgggacattgtatgatgttccctgcttgcgtacctgctttcttcctctaatacagatgctcagctgctcaggcccttgtgtcacagagggaaactggagctatccaaagaactgcccagaagggaagggcagagaggtctctgctctccttgtctgagccataactcttctttctaccttccagaaaacaccttcccaccccaggtccacctgctaccgccgccgtcggaggagctggccctgaatgagctcgtgtccctgacatgcctggtgcgaggattcaaccctaaagatgtgctggtgcgttggctacaagggaatgaggagctgccctctgaaagctacctagtgtttgagcccctgagggagccaggcgaaggagccatcacctacctggtgacaagcgtgctgcgtgtgtcagctgaaacctggaagcagggtgcccagtactcctgcatggtgggccacgaggccttgcccatgagcttcacccagaagaccatcgaccgtctgtcgggtaaacccaccaacgtcaacgtgtctgtgatcatgtcagagggagatggcatttgctactgagccaccttgcctgcccctactccttaaataaactctgtgctcatccaaagtatccctgcacttccatccagtgcctgtccatcatccttagggtctacaaaacactgggaggggtcagggcccagggaaggaggaacccccaccacctgagcttgtaaggcctcagagactctgaaggacctacatgcctagagtatatgtgtatgcatgtatacgtattagtgagtgcctttgcgtgtgtacctgtgtgtaacaagagaggagtgagtttgtgcgtgcctacgggtttatataggtatgtatatgggcataagtgcatacgcctttaagtgtgagcatatctgtgtccccgtgagcacatgtgtgtctgtgtatgcctatgagtgtgcacgtatctgtgtatgctcatgttggtggaaacatgtgtgcctatagtgtgtgtacctgccaggtggatgtgcaatgaaagggaggtgagaatgggggtgaagtccgagatgagcagattcagccaagacaggcaaacctcaggggagagtcccaagagcagtgggttgctgcagaggtactctgaatggtacttctgaatggtggtgtggctgtctgagtataagattacagcttttgtcccaaacaagaaagggatagatggagcaagagagtagcaagaccaaggctggtactgcctgggagtcacaataggaacggtagaggagtgaggagatgaatccaaggggcactgggaagaagatgccacccaccctcagtgggccagccctgaatggagacgtgcatagccactcagggtgaccactgactcatgagaaagagacataacatggcacagacagccctcagcagcaccctgctctgcatatatgcacatgggcatacaccctggtctgcatacaggtacatgggcatacacgcacatacatttgcacactcacacagacccgaaccctggaggaggacgaagttcacagcccacacgcagcttctggaaagcaatgggagtcccctcccaagcccaaccatgacaactcatggacaagtctataagctcctccaggtggcccctttctaacctaagtctcccttcccatcctgagcccaagtataacaaaccagaaacagggtatgtggcaagctgggaaaagacaggagcaggccatagagaccactctcacacaggccttggcctcctccatgggcacccctagaacacaaagttctacaaccaggtacacttggcacccagatgcccacaagagggcagtggggcccctgctcctgtctcacgggccttcagaacctctccaggggcctggtttctagcaacttccctctgctgtcagagcaaggcccatgcacaccctggataccctccagcttgaaagtccacttccccgaggatagcaaaagcgacaggccagctttggaaacctgacccagaaaagcacgatagccacccatggaacccaaggcctggtccaaaacagaattctagtaaggaggagccaataggtgaaagactgaacacacacagggagagaagacagaggagcacgatagtcgagagaggggggctggtgggtgaggcgatgagtgagtgactggaacaaggttgggtggatatgcagatgaatgatgggaatggtggatggactgatggatggctgcagtgacagaaatatgagtgactgagtatcggcacacagtccctacctccacttaaaatcaaagttctatgcgcggagactctgagggcagtggggttgtctctaccgggagactttagtgttggttaacccccccccaagttctttataatgcaacagaatcctctgaccacatgtccaccccttggtattccaacctcggcccagaaatcaccttggcctgtatctgtttgagagtgtccgatcttaccgaaccctagtacccaggccaagttcaacctaagaactggggcttttgtgaggtgttgctaaatgtctagagaggtctgagacaagtggccttgggctcaaactcttctcagagcctcaaagacagaaacaactctcttaccatgatagttctctaattaagatcccctgagggaaagagagagagtcaggtcttggggggcatctcaagaacttcaaggattccagccccttacctgggaccctgccttctcattatcccagaacaagtcccttctcagagataaggaacccctgccaccaccgtccccaaagcccaagggggcatagaaacagaggccttaagcctgagcccccatccccatgggtttggatctagaaggtcatctatgtcttacagaatgccaagagccaccttcctacgtgatactggaccagtcacaagacatcctggaggaagagaccccgggtgccagtctgtggcccaccgctgtgaccttcctcaccctcttcctactgagcttgttctacagcacagcactcaccgtcacaactgtacgaggcccatttggcagcaaagaggtcccccagtactgaccaggagccagccacaggtggctgtcatggagacggtggggtacagggtgggggcaggggccttgaggatttactcagcccctccacatgtggccttgcaacccttcacagacatcaaggaagtggaaggaagtagaaggaaattatggcagcacttcctgggtttaacccagtcttccagaagccaggctgagacctcagcaaaagcaaagacataacccaactccaggatcctcccctctggctgaccacttgtgtctttgcacggatgaagcttggagaaagtcctctatgtttcagagactgatgtgacagcttcccacccgactcccatactttgctgagcaataaactggtgcaaaagcacagtttcttactctcaaaaacaaaagttaacaaaggattgggtgagggggtcagagatagtgtggtggtgccatgctaaactgttgcttacggtatagaatgtggcagcattgggcagggcagacacagggtgaccactgtctagtatccgagacaaccgtgtgtagctgtagccaagatgaacactgactgacttcaacaagtatttgtggcctcttcagacccaataccaggccattagcttgatctctggacctgacttctaaacatttggcctctgtgaacacccttgccaaacactggtcctggttgtgaaccttggtcctgaatactgagccttatcttggtaactgaaccataatcctgatccctgacctcagtcacgatcatgaaaccctggtcctggccactcgttccaataactggtccctagtcctgagccctgagtcctggtccaggtcactgaatcctggtcatgatcaatgggtttggtcctcattcctgagcctagtcttgatcactgatcactggttctgatcattaacaactaacctgatcactagtccccattcctaatcactgggccgcgatactgatcactgaaccctgtttctaaacaatgtgtagtgaaatgtatggtaaaacctttgcatctggctttgagtgaaatgtttcggcagacctttgctatgttttgggttagtcaggaaaggctgagaaatggttttgaggctgtttgaaccttgaagaaatgttgtctccctggacaatctgcacttggtactacattaaggtttgcagttgcacacaccttggtcctaaacactcctggcagacttagaactcttacgtttgattatggctagccatagttgaaaagggctgagagttgtatgggtggtctgctctctctcgcagcaagggcaagatgactttggtagttgaaaactttcccagccccaactaactctgtataatgtttgaataaagtaacggcagtaggctagttgtggttaatttttattccaagaagaatgaacccctctgctccttcagaaaaggaaggcttagcattttggtgagcttctctctactgaggcacctatgaccaactcagtgttctttgattcctgtcaccacatccagtcttgatcactaagtgccagtcctcatcactaaaccctggtctccaccagtctgcttgggttctgataatcagactcacattctgataactgggccctgattctggtcactagctctttgccctggtcatggacatttgaccctagtccacggcactgagttctgggcatggaccctgggccctagtcctaggtactgggttctggttctaacaactaggtcctgtactgatcaatgggccctgacctagacattgggccctggtcctcaacatcaacttctaagcctgaactctagccccaaattctgcttatcaacactggtcctggaccttggtcctcatcacacatccattctctgagacccaaggaatcagtggtattttgcaagaagtccctttgatattccaagcctcattctcattaggaagatctcttcaggggattcctgcagaaggttccagaatccccaccacactgttcacatactgggctgcaactgggacagtgaccccttttgctcatggaaacaaagcaggcccaggccctgtgagctggagcctctggcctggggtctacagatgtggggtcagcattgtggagaaggtttgcagggcaggtgtgggggtagggcagggatggtcacattagcatcttgtttttctttcttctgaagtctctgttttctatcacctgctgaaacattcaaagtagctccaagctgaggccagctgagtcatcctgagcctatctcagcccaggtgcctcaaaacagagctactgttctgagaatcacaccaccctggaccaggccaggtgggtctggggctggatgaggggtcagagccaggggagccctgacagggactgagaaggccccaacccccatcactcaaggttctccacaaccatccacagtcatgccttagtgaggccatgttctgtcccaatgagaacaagtccaattaagattaagtctggtcttcccagggtcattcagtgtcaaggagtgtcaaccaaggccagccaaggccagcctgaggtcagccagcatcacccaaggacacacaactattctagtagacaactagaatagtcagctcaacagggccctggtgatgcaaaatggagagtgtattcctgccagacagggctccacagataggctccctcactgcatatgacctccctgaatgtttcccacactgcagttggttctagactacttcttgataagcatgcagaaagataacaggataagaaattttatgcagagaacagaagtatctacggaatagaatagaagatagatagtagaagtctgctacaggccccagtggagtctctttgtagagtcaagagatcaaacctaaactgagtctcaggattgagtccagtacagaagcaaccttcaggatgctaaagaccatacaggcaatggacagaatggagtccagacagaccaatgagtggacagtccaatctcacataatgaaccatgtcaagagcagatagtgagccaaagaaggctctgggacactcggagattctcggcctctggatctcctgatgtatataccaggtgatcaagtgacagtctagtggagccattgccatcacagtgtcaggtgtcctccccttcatgggttccggtgaggatgtggcacctccctttagttggacgtgtacaataaattctcaggcctggtatgatttttaatgatccatgtgtttctatagtcttaattatctttaataaaattatagggtgacaccaaatttagggataagttatttatcaggctgtgcctttggaaggtgacgttatttacatagccaccaaggtgcccagtcatcggcccatcttccaaacggagtcaagggccatttgaaacagtgaaatccctcagggcaagggacacaacatggaggaatttaaaacagagtacagcttgatcttaacacacacacacacacaaacgtaagagatggaaaaggggatcaagggacacagaagtacagagaaaacaagacagtaagggatgtagagatgagaggtaaccacagggaaaggtgagacacaaagacgagaggagaaagacacagggacagaaagacccatgcaagcaagagagacagacataaggaagaaaaggcgagaagagacagacaaaggtgcagcaatgtggcccacctggtactcacaagaaggccctggcacacactccgatgagagccatgcacctacaaacacgtagacacagctccacacagacacacacggcatctgcacaactgtctgaacctcaaacaggtctgcccactccctctcctccaggcctttgtccttaggaaggcacgctgagggtaactcagtcgggatacttctgattggggctcactgaacagcctgaggctgggtccacagttgctctcactgtctggccctgtaccccaggtcatgcttcagagggaattaactgaatgcagtaaacaccgtctgtggtcagcatgtactaagggatagaaccctatcaggatttgtccaactaaggtccaaatacagagtgaagaagacgatgggggagatcagatggcagatgggagcactctggatagagctcagggatatggtggctgaggaacattacagctgccaggcttggcctttcatctcagctctaggtcaaggggaactacccaggtctctgctttgttgctggtaactatacctaagtctaagaacctcagtaagacacagaaccagtaagacgacagcctccatcgataagaaagaaaggagaaaggcagaatggataagtctctggacagatgagagcctacacccaaaaacagttcgttcagccagttaatagggtgtagccctagcacacgagagaaaacagttccacaggtgtaagggagtaaatctgtgcgaaggggtactgcttgagctcctcatggcctggtccagaagcagaagctgggcaggggcaaaggacagggtaaggcagggagacaggggcatgaaggagcctttgggactgtgtggtgagaactaggctgtgcttttactgagcctgagtttgtggcagttgcctcatggggaaggcacccagaggtaaggcagaggaaaggagtaactagggctgagggcaccacagggtctgaggaattagaggcagctatgacccatttgtcatggtatttggacatgtacttcatggacacagatctgagaaccaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgtgggtggggacaagctgtagagtgtccccatgaggggacaggctgagatagggactgaagtccatctacaggcttaccacactccatgctctggatgagagcactgagctctgccaccctacaacagcaggcagagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctgggaataacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctagggaaagcttttatttccccttgaattttaatcattgtctgggtgtaataccctgggttgagagctgtgttctttcagaacttggactacgtctatccaggcatctggctttaaagtttctactgtggggctgcagagatggctcagtggttaaccacacatttcttcttgcagaggacttgggcttgattcctagtacctccgtggcagctaagaaccatctgtgactccaactgcacaggattcgatgcccttttctggaggtcatctggagtagtcagctcaacagggccccgggatgcagcatggagagtccatgctgacaggcagggctccacagagagagaaagacagaaacacaggccactgaaagagacagtaatggactgaggggacagagagaaacacacggacagacagacagagataacaaaacaccgacactcatagacacagagaagagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcgattcccagcaggctcatggcagctcatactgcaatcccagttccagagtgccctgaaggatccttcatgcatgtggagcacagaagcgctctctctctctctctctctctctctctctctctctctctctctctctctcagatgaaagccatgaaccagaagacagagacatgagtgaacactcctcagagacatagccacagcactcacacccagttccacacagacacatacagcacctgcctgcctgatccaaaccccaaacccattgacccactccctctcctccaggtctttgttctcagagtagcacactgagggtagctcagcctggatacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtcttcctggcacagtctatccctggtgcaggcttcaggtcaggcccaagtgtgaagagtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcctatagcagggcatgcctctgggcatcagggagtcacacagaggcaggtaagactctagacctggggactgagaggggaaggcatgtacaagagggcctcatccttaggacacagggattcgaggcctctggatagccagtgagcaacatatgcagagtgatgaggccccaggagtctaatggacgccaggaggtcacagagctagaggcctggagggctagagtctgtgggaagggggactgcttaggttcttcccacccatgtccaggagcagaggctgggcagggccacaggacagggtaaggcagggagacaggggcatgaaggagcctttgggactgtgtggtgagaactaggctgtgcttttactgagcctgagtttgtggcagctgcctcatggggaaggcacccagaggtaaggcagaggaaaggagtaactagggctgagggcaccacagggtctgaggaattagaggcagctatgacccatttgtcatggtatttggacatgtacttcatggacacagatctgagaactaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgcgggtgggaacaagctgtagagtgtccccatgaggggacaggctgaggtagggactgaagtccacccaaggctcaccacactccatgctctggatgagagcactgagctctgccaccctacaacagcaggcagagcggcctccatgctaggaaagccaggcagcagggacagagttcctggatgggacaggtggaattgtctctgctctgcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctaggggaagcttttatttccccttgaattttaatcattgtctggctgtaataccctgggttgagagctgtggtctttcagaacttggactttgtctatccaggcatctggccttaaagtttctactgtggggctgcagagatggctcagtggttaaccacacatttcttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagagatagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctctctctctctctctctctctctctctctctctctctacactgtccccatgaagggacacgctgacgtacggactgaagtccacccaaagctcaccacactccatgctctggatgagagcactgagctctgccaccctacaacagcaggcacagcggcctccatgctaggaaagccaggcagcacggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaagcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacnnnnnnnnnnnnnnnnnnnnnnnnnnnnnnnnnnnnnnnnnnnnnnnnnncagtggcacacacacatacacacacacacacacacacacacacacacacacacacacatacactctaatgaaggcagtggcgcacacacacactctcagatgaaagccatgaaccagaagacagagacatgtgtgaacactcctcagagacatagccacagcactcacacccagctccacacagacacatacagcacctgcctgcctgatccaaaccccaaacccattgacccactccctctcctccaggtctttgttctcagagtagcacactgagggtagctcagcctggacacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctgggacagtgtccctggtacagtctccctggtacagtctccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtctccctggtaaagtctgtccctggttcaggcttcaggtcaggcccaagtgtgaagggtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcgtatagcagggcatgcctctggacatcaggaagtcacacagaggcaggtaagactctagacctggggactgagaggggaaggcatgtacaagagggcctcatccttaggacacagggatttgaggcctctggagagccagtgagcaacatatgcagagtgatgaggccccaggagactgatgggcaccaggaggtcacagagctagaggccgggagggctagagtctgtgggaagggggactgcttaggttcttcccacccatgtccaggagcagaggctgagcagggccacaggacagggtaaggcagggagacaggggcatgaaggagcctttgggactgtgtgatgagaactaggctgtgcttttactgagcctgagtttgtggcagctgcctcatggggaaggcacccagaggtaaggcagaggaaaggagtaactagggctgagggcaccacaggatctgaggatttagaggcagctatgacccatttgtcattgtatttggacatgtacttcatggacacagatctgagaaccaggcctggctctcactaaccggcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagggtgcgggtggggacaagctgtacagtgtccccatgaggggacaggctgaggtagggactgaagtccacccaaggctcaccacactccatgctctggatgagagcactgagctctgccaccctacaacagcaggcacagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccatgtcctctggagagctgcctactgtcacagatacctttcttctgtttctgctaggggaagcttttatttccccttgaattttaatcattgtctgggtgtaataccctgggttgagagatgtggtctttcagaacttggactttgtctatccaggcatctggccttaaagtttctactgtggggctgcagagatggctcagtggttaaccacacacgttgttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagacagacagacagacagacagacagagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctcgctctctctctctctctctctctctctctctctctctctctctctctctctcagacacacacacacacacatacacacacacacatacactctcaaatgaaagccatgaaccagaagacagagacatgtgtgaacattcctcagagacatagccacaacactcacacccagttccccgcagacacacaaatcacctgcctccctgttccaaatcccaaacccattaactcactccctctccttcaggcctttgatttcagagtagcacaccgagggtagctcagcctagacacttcccatgggacctggttacatagcgtgcacagggccacctcttgttggccctataacccatgtgatgattcaggaaaagatgttgtctgagagcagggcctggtacagtccccctggtacagtccccctggtacagtctctctggtacagtctccttggtacaggcttcctgatacagtctctctggtacagtctctctggtacaatctgcctcgtacagtctccctgatacagtctgcctggtacagtctctctggtacagtctgcctggtacagtctccctggtacagtctccctgatacagtctgcctggtacagtctctctggtacagcctctctggtacagtcggcctggtacagtctccctggtacagtctccttggtacagtctccctgatacagtctgcctggtacagtctgcctggtacagtctctctagtacagtctgcctggtacagtctgcctgatacagtctgcctgatacagtctgcctggtacagtctccttggtacagtctgcctggtacagtctgcctgatacagtctgcctggtacagtctctctggtacagtctccttggtacagtctccctgatacagtctccttggtgcagtctccctgatacagtctctctggtacagtctgcctggtacagtctccctggtacagtctccttggtacagtctccctgatacagtctgcctggtacagtctccctggtacagtctccctggtacagtctgcctggcacattctatccctggtgcaggcttcaggtcaggcccaagtgtgaagggtgcagaagacagtgggcagagctgagagagcgctagtcagttttgttcagagaacagtgatggctgctccaggctactggacatcccaggtgtgcttcttacacttctcaaagctgtgggaacacaaccaaccctctacccaattcattgtaattgtctatagcagggcatgcctctgggcatcagggagtcacacagaggcaggtaagactctagtcctggggactgtagaaggtatgtaagtacaacagggcctcatccttggaacactggtgtctcaggcttcaatacagccagtgagaaacacatgcagagtgatgtggccccaggagactgatgggcaccaggaggtcacagagctagaggcctggagggctagggtctgtgggaagggggactgcattcactcttcctatgcttgcccaggaacaactgtctatgcagggccacaggacagggtaaggcagggagacaggggcatgaaggagcctttgggactgtatgatgagagtctaggctgtgctctgactgagcctgagtttgtgacagctgtctcatgaggaagacacccagaggccagacagaggaaaagagtaatcagggctgagcggaccacagggtctggggacgtggaggtggctggcctggctcccacaggccctcagatggagctgcacatcatcccatagcatatcactctggagggcttatcaaaatggttgtgctgtgggactgggtttcaggactgaggcctgagatactgggtagcagaacatgttcagtatacagggtgctcagagtacgggggggggggggacaagctctgcagtgttcctccatgttgggacaagcagaaagaggtcttgaagctgtttgtccatccataggcctaacccatactggccctgctcatggccctagcttgggccacatatctagtgcccactgaatcatcaccatgaagactgttggaaaaccagagcctctgatgtcttcctgccttgcttgctctccctgactctcatagctcacacaggctctgccctggtccaccactgtcctcaactgtaaaccatgccaggcacagagagcaaggaatgtggtggtctcagactgtcacacacaacaatcttgtgcctttcacatccacacgcacaagcatgctcatacccctctgtcaggggtcagtggggtcttccttgggctcactcccatttctagctgctccttggtattggtgactgcggctgctgtgtcggtggctgccagagatgcttgatcggcatgacctcagatataggaatggcctggggtcaacagagtgcacacacttagggcactggccagagttctatgtagaccaaggcctctcttcctagtgtgttatttcacaaaaccttatgcaacaacatcttctattccttttattcctctttgtctgctaatggggaattttctagaaagagtgtcccctctctgtcttcctgctgtgtagacagatcttgtaggtgtgatcacagagtggtgtttcccttcttggccattttcaggccaggaactcagggccagagacagaaagtcaggaaggtaggaaagacagggagacataataaaggtgagatggagacagagaaagacaaagggagaaaagcacaggattgcagggagagacaaggagacgcccgacggaaacagacatcagggaaaagacatgattgttcctttagtaaattgctttccggagaaaagagacagcagagagacatggataggcacacaaagatacaaggagagagacaggaaacagagaaagagagaaacagagatggagaaacaacgagggagagagaagagtagagagaaagacacggagaaaaaaaatcaagaaacagaaaagacaaaagataggaagacagagaaataggccagaaatacagacagacagagagatgcctgaagatgttctctctcacctagagaaagaaagcacaggcagagataatacagagagagagagagagagagagagagagagagagagagagagagagagagagagagagaggagagaaagaggagagacacggtgttagaggagaaagcattatgttttgatagagacagagatacagcaactgaggaacagactgagcagaaagaatcccactcagagagagacagaggctaagctgggagaggcaggggtggccagagagggagacagaggagagcctgtgggacaggtcagacaccatcttggaagacccagtgacaagccagggaggtgacaggttagtgcagtttctaccccacagtccacaggctggagccacaggcctgtgtccatgtggccacaggctagctcccagcctgccaagcctgtctgtggagggattgcggagtggggctgggctgaggcaggccaggatttttccagtggagcagccagtgactgggctgagggtcactgcccaccatccccgtgattctgggtagacccaggacctggagcacacacagccttcctgtctctcccacttccctggggtgtttggaccttgcctatctcctgtcattccctcctagggtcagattccagcagtgtcgataaatgggaaaacactgaattcaatgtcaccgttaggggtcatggaacccccagccccatccccaaagctggtcaacctggccagggtggggtgaacctgcagctgcaggtgggggaatcattgatgctatttttggctcagagaatgagaaacatgtttttctgcatggaacaaacatccatttgcatgtgccccgagggccaaccctgcacagagtgagtcactcggcaggtgtgtgtgtgtgtgtgtgtgtgtgtgtgagagagagagagagagagagagagagagagagagagacagagacagagacagagacagacagagagacagagagacagagagagagacagagagagacacacacagagacagagagacagagagagacagagacagagagagacacacacacagagacagagagacagagagagagatgttgtgagcaagccctgtttcaggtactgatatctgtgcccccgtgccccagcccatgtggaaaaactacccttaggggcccattaactcatcacagtccaggccatcatggtgagccctagctgacctaagcaggttccaccctaaacatgaaggaaaataataaaggccatctgttacccagaatcctagggatggtgggcagtgaccctcagcccactcctggccgctccactggaagaatcctggcctgcctcagcccagccccactccgcaatccctccacagacaggcttggcaggctgggagctagcctgtggccacatggacacaggcctgtggctccagcctgtggactgtggggtagaaactgcactaacctgtcacctccctggcttgtcactgggtcttccaagatggtgtctgacctgtcccacaggctctcctctgtctccctctctggccacccctgcctctcccagcttagcctctgtctctctctgagtgggattctctctgctcagtctgtcagccatagttggagagagtccatctatgtttgcctctgtctctgccaattccatcagaggtctctctactaacacttgcctctgcatgtgtctcttggtccttctcctgtcttcccatctctctatctcctcatctctctgtctttctgttactccctgtctctgtctctctgtcttttctctcactgtctttatctctctgcctgtttcatggacttttctctgtctctctgtctctgtctctctgtctctctctctgtctctctctgtctctgtctctctctgcccctatctcttggtctctatctctatcttcaactccctatctttgttcctcatactcacatttacctctttcccaagcccccagtctccaggtctgcctgtttctgtctctcccttgccatgtttccctgttttattctctctcctcctgaatgctctggcttgaaactggccaagaagggaaacaccactctgtgatcacacctacaggatctgtctacacagcaggaagacagagaggcgaccctctttcaccctacagtgtctggacttggttgattccaggttactcctatactcaagtccgggactatggtggtcaagcatctctggcagccactgggacagcagctatagccaccaacatcgagccctgttagctaccaacattagctcctcaaagaggttgggtctataggcctctggtgtgaggagatgttgacagtgagaattagttcccaaggaggacaccactgtttcctgttagatggagaactacagtgggtacgaacatgcttgaacacatgagtgtcaaatgcacaagactgttgggtgtgtcacccttcccctctctgttcatggcatgactgcacactgaacacaatggtggattgggacagagtctgtgtgagttgagaatcatgaagagtgtagacacttcaaggatagtgtagacccttctagttcgtggtgatggctcacttggcactgagtttctgaccccacagggaccatggacaagggcagtatgggctgtgcctatggatacaaaagagacttcgaagcctgtattagcctgtcccctcatggaggaacacagcacagcttgtctctacccacactctgagtactctacgtcctggacacctctgtcacccagtgtcctaggtcccatccttggctcccacatcacatctgcctttcagacagatcttccagtgtgacagacccatttcatggtgctgaacaacataaacccatttcctgagggttggtgagagccggcctggttctcagatctgtgtccatgaagtacatgaccaaataccatgacaaatgggtcatagctgcctctaattcctcagaccctatgggccctcagccctggttactcctttcctcggcctggcctctgggtgccttccccatgaggcagctgccacaaacccaggctcagtcagaacatagcctagttcctaccatacagtcccaaaggttgcttcatgcccctgtctccctgccttagcctgtctgtgctcctgcacagacaagagttcctgggcaagcataggaagagtgaatgcagtccctcttccaacagaccctagccctccaggcctctagctctgtgacctcctggtgtccattagactcctggggcctcatcactctgcatgtgttgctcttgtacatgccttcccctctcagtccccaggtctagagtcttacctgcctctgtgtgacttcctgatgtccagaggcatgccctgctatagacaattacactgaagtgagtagagggtcggttgtgttcccacagctttgagaagtgtaggaagcacacctgggatgtccagtaacctggagcggccatcactgttctctgaacaaaactgactagcattctctcatctctgcccactatcttctgcacccttcacacttgggcctgacctgaagcctgcaccagggacagactttaccaggcagactgtaccaggaagactgtaccagggagattgtaccaggcagagtgtgccaggcagactgtacaaggcacactatatcagagagactttaccatgcagactgcaccagggagactgtaccagggagactgtaccagggagactgcaccagggagactgtaccaggccctgatctcagacaacatcttttactgagacatcacatggattacagggccagcaagaggtgggggctgtggaccagaggctcatactgtgttaccaggtcccatgggaagtgtccaggctgagctaccctcagtgtgctactctgagaacaaaggcctggaggagagggagtgggtcaatgggtttggggtttggatcaggcaggcaggtgctgcgtgtgtctgtgtggaggctgggtgtgagtgctttggctatgtctctgaggagcgttcactcatgtctctgtctctggttcatggctttcatctgagagagagagagagagagaaagagagagagagagagagagagagagagagagagagagagagagcgcttctgtgctccacatgcatgaaggatccttcagggcaccctggaactgggatttcagtatgaactgccatgaacctgctgggaattgaatctggattctctgtgaaagcatccagtgctctcaacccttttggggtctctgtctcttgcagtgtctcctctcagactctgtcttctggagtcactctctgtatgtattgcctctgtgtctctctcacctcctacccattgctctcaaaacttccctgtcccctctgttctctgtgtctatgagtgtcggtgttttgttatctctgtctgtctgtctgtctgtctgtccgtgtgtttctctctgtcccctcagtccattactgtctctttcagtggcctgtgtttctgtctttctctctctgtggagccctgcctgtcagcatggactctccatgctgcatcccggggccctgctgagctgactactccagatgacctccagaaaagggcatcgaatcctgtgcagctggagttacagatggttcttagctgccacggaggtactaggaatcaagcccaagtcctctgcaagaacaacgtgtgtggttaaccactgagtcatctctgcagccccacagtagaaactttaaggtcagatgcctggatagacaaagtccaagttctgaaagaccacatctctcaacccagggtattacacccagacaatgattaaaattcaaggggaaataaaagcttcccctagcagaaacagaagaaaggtatctgtgacagtaggcagctcttcagaggacacggggagtaatgcctcagactgaagagaaacacccattcacatgaggggacaggggctaaatcaagcgtgaggaggtgtggggatggaaagtaatgggtggcaggaggcttagccccagtgaagggttcctgcattcaaatctgcaaacctccacacaagaaaaaaataatatgaggggacgtagaacacaggcagcttgaaaatggaggatgcttttagcattaaagatttacagtgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattcctctttttttggcggccgatggcggttatattccttgcgtctcccgtatccagaaataataatcattcaaaacggtgttctcctcagccagtgtatgccttttggattttgcttccagcagcaccgagtggagaggagaggagaggagaggagaggagaggagaggagagatgttcagttatccaaaactaaggatccatgaagaagccttatggaaatccactattttgtaaatgaactaacatttattaaggaattttaactcagtgtatggctgggtgaacagtgttgttcccagaagaaatgggttagattgtgtgtggtggcacaggctttactcccagcatttattagaaggcagagacaggaggatgtcccaagtttgaagccagcctggtctacacagggtgttctaggatacccaggactacacagaaagcccgtgttatacatagagagatgtaagttgtcacatgaaacatggaggcctacaagttattgatcaggaagtctccagaggaatccaaacaaagcaggctgttcattgactatgttcctggctgtccaccatgactagacagtaagaccttactgctgaaggtccacttagtttgatgccgagcagagacaattccacctgccccatccaggaactctgtccctgctgcctggctttcctagcatggaggccgctgtgcctgctgttgtagggtggcagagctcagtgctctcatccagagcatggagtgtggtgggcctgtggatggacttcagtccctatctcagcctgtcccctcatggggacactgtacagcttgtccccacccgcaccctgagcactctacattctggacacctctgtcacccagtgtcccagaccccaggcctgggctcccacctcccaacatcagcctttcagacagatcgtccagtgtgagaggcccatggcatggtgtgctgaaagacctacagccacaagtgggacacctcctgccggttagtgagagccaggcctggttctcagatctgtgtccatgaagtacatgtccaaataccatgacaaatgggtcatagctgcctctaaatcctcagatcctgtggtgccctcagccctggttactcctttcctctgccttacctctgggtgccttccccatgaggcagctgccacaaactcaggctcagtaaaagcacagcctagttctcatcacacagtcccaaaggctccttcatgcccctgtctccctgccttaccctgtcctgtggccctgcccagcctctgctcctggacatgggtgggaagaacctaagcagtcccccttcccacagactctagccctcccggcctctagctctgtgacctcctggtgcccatcagtctcctggggccacatcactctgcatatgttgctcactggctatccagaggcctcgaatccctgtgtcctaaggatgaggccctcttgtacatgccttcccctctcagtccccaggtctatagtcttacctgcctctgtgtgactccctgatgcccagaggcatgccctgctataggcaattacactgaagtgagtagagggtcggttgtgttcccacagctttgagaagtgtaagaagcacacctgggatgtccagtagcctggagcggccatcactgttctctgaacaaaactgactagcgctctctcagctctgcccactgtcttctgcactcttcatacttgggcctgacctgaagcctgcaccagggatagactgtgccaggcagactgtaccagagagactgtaccaggcagactgtatcagggagactgtaccaggcagactgtatcagggagactgtaccaggcagactgtatcagggagactgtaccaggcagactgtaccacacagactatactaggcatcttgtaccagagagactttaccaggcagactgcaccagggacactctaccagggacactgtaccagggacactgtaccagggacactgtaccaggccctgctctcagacaacatcttctcctgagacatcacatggattacagggccaacaagggatgggggctgtggaccagagatgcttgctgtgtctccaggccccttgggaagtgtccaggctgagctaccctcagtgtgctactctgagaacaaagacctggaggagagggagtgggttcatgggtttggggtttggatcaggcaggcaggtgctgtgtgtgtctgtgtggagctgggtgtgagtgctgtggctatgtctctgaggagtgttcacacatgtctctttcttctggtgcatggctttcatctgagagagagagaaagagagagagagagagagagagagagagagagagagagagtgtgttgctgccttcatttgagtgcttggtgggctccatgctgtacctctgccttccctgtgtgtctgtccttttgcctctcccttcctttggcctgtctctcttgtctgcatctgtctctcttgtctctccctctctgtgtctcttttctctcctgtctctgtgtctcttctttcctgtggtctctcctcatccccatgtctgcatcagtgtctatcagtctttaactctgtgtcctcttgttcccatttctgtccctctggatatttctgtctttctgtgtgtctgtcctcatctctcccagcgtccatgtctttgtgtccctttgtccccacacagtatcttctcaaatactctgtgtgcctggtcccctgtctctcattccttttctcactgctcccatcagtgtttctctgtgtctctgcttctgtgtctctgtgtgtctgtctcatgctatctctttctctctcattatctctgtctccctcagacttctctgtctttcttggtctctgtctccctctgtgtctctgtctttctgcatgtctaatgtctctgtgtctcccttagctcatctctgtctctctcaatattcccacaatcccctttattctttgtgtctctgtctctgtggtgtctctttctcagtctctctgtatttcgctctgtctctcagaatctctgtgtccctcatattatttttcgaagtgtctccctatctctttcagtaacactatttctgtttttctcagtctctctctctctctctctctctctctctctnnnnnnnnctctctctctcagaaagtctatggcacctcttctatgtgtgtcccactctggacctggatcaatcttccttcttggacctcagtttcatcagttgtgagacgataccttgccagaagtccagaggactgtctgtcctccatagtctagaccacctgtgatctgagagatattgggacaacggatgtgcagtgagggacctgcctttctgtggagccctgtctggctggaatacactctccattctgcatcaccagagccttgttgagctggctattctagttgtctactagaatagttgtgtgaccttgggtgatgctggctgacctcaggctggccttggctggccttggttgacactgaatgaccctgggaagaccagacttaatcttaattggacttgttctcattgggacagaacatggcctcactaaggcatgactgtggatggttgtggagaaccttgagtgatgggggttggggccttctcagtccctgtcagggctcccctggctctgacccctcatccagccccagacccacctggcctggtccagggtggtgtgattctcagaacagtagctctgttttggggcacctgggctgagataggctcaggatgactcagctggcctcagagtggagttattttgaatgtttcagcaggtgatagaaaacagagacttcagaagaaagaaaaacaagatgctaatgtgaccatccctgccctacccccacacctgccccgcaaaccttccccacaatgctgaccccacatctgtagaccccaggccagaggctccagctcacagggcctgggcctgctttgtttccattcagtgcctctgggaaaggcagatgagtaaaggggtcactctcccagttgcagcccagtgtgtgaacagtgtggtggggattctggaatcttctgcaggaatcccctgaagagatcttcctaatgagaatgaggcttggaatatcaaaggtacttcttgtaaaataccactgattccttgggcctcagagaatggatgtgtgatgaggaccaaggtccaggaccagtgttgataagcagaatttggggctagagttcaggcttagaagttgatgttgaggacctgggcccattgatcagtacagaacctagttgttagaatcagaacccagtgtctatgaccagagctcagtgatagggaccaagtcccaaggccaaatgatcaagaccaggacccagttgccaggaccaagatccaggtttcacaaccaaacctagttacgcagaccagaaaccattcgttggaatctggatctgaatcagagcccaatcacactactctaaaccagagttcagtgttgaggaccagggtacgtgatgagcccaagattcagagatcaagaggtggattcagtaattaagaccaggattcagagatcaggatcagggctcagttagcaggatcagggctcagtcatgtggtcatgggctcacggtccaatgtccatgcccaaaacacaactaaggacccagtggtcagaaccaaggcctgatgatcagagacaatacacactgctcagagctgaatttcagtggcaaggatgaagacataatgataaagactagggatcagtgagcagaaccagcgatgaggacccagacgcatctctgaagactagagtcagtgaccatgaccagttcaacgatcatgagtaggacttaattctgatcatacgagttcagtgatcacgaacaaggctcagtgatcatgacaagggctcagggaacaagagtgaggctcagcgatgaaaactggacctcagttatgagcccagtgatgagtaaccaggtctcggtcattagggccaggattcagtgataagaaccaagggtctctgcagggctcagtgcatcctctccccctgagactggacaaagccgcccagccacagggatggattctccagacaggcaacagcttcagggacagcccccccgtgatgcgccagagtaggggatacccaggggacttccacactctcaaagaagaaggggagaatggaacatgaagaagggactgtgaggggggaccgggaagtgggggacacagtgactgggatataaagtgaataaataaattaatggaaaatatcacatgggtgtagggaattttgaaagaataaataaaatgttaaaaatgaaaagaaaaaaagaccaagggtcaatgatcagggtgataataaataaataaataaataaataaataaataaataaataaataaataagaaaggaaagagagaaagaaaggaaggaagaaagaaagaaagaaagaaagaaagaaagaaagaaagaaagaacaaacgaactgaatgtcagaatttagggtaagatctcagtgatgaggatcagggatcagtggtttgaacgcagacacactgcccagggccattgttcaatgacgagagtcagggatcagctatcagaaccagggccagtaacgaaagccagggcccagtgaccccaaccaaaaaccagtgactaaaaccaaataaaatagaaactaggcagccacgatggtgcacacctttaatcccagaactcaggagtcaggggcagggggagttcaagacaaccctggtctacacagtgagttccaagacagccagggctacccagagaaaccctgtctagataacaaagactagaaaccatgagctcagtgatcagtggcagttcttgatgactaagaccatggtcaagaggactgatcagcaggactcagtggttagactcaggacatggtgatgatagcctctgttccagggatcagaaccaaggccaagggccaaggccatgactgagtcatcagaacagggcctctccatgagcactagtcaggcgcagccaggcctagcatgtcaatcaggcaaaattgggtatgtgtgtggtggtatgactgactatacatcgtcttagtatctgtctgaccccaccaccatcttccctgcctccgtccactcacagatctctgacgcgtcaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgaaccccttgcggcc

(The sequence listing continues in the following parts.)

Figure 1B:
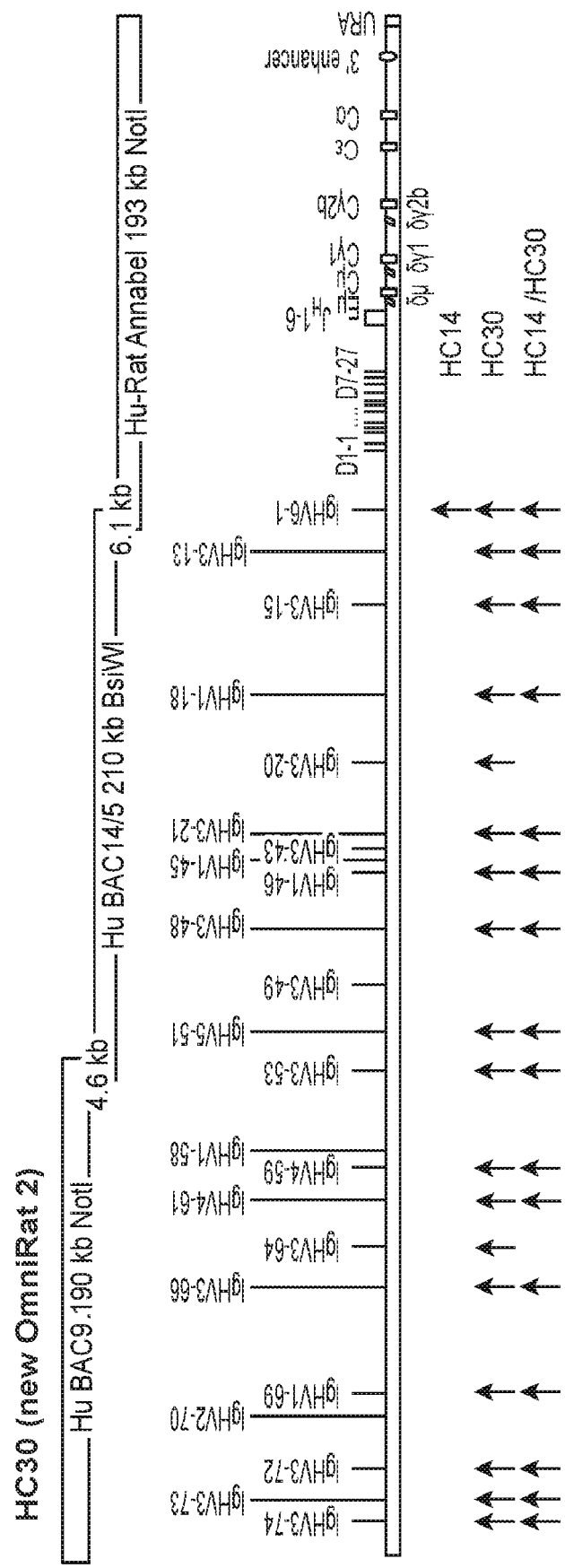
Figures 2A, 2B:
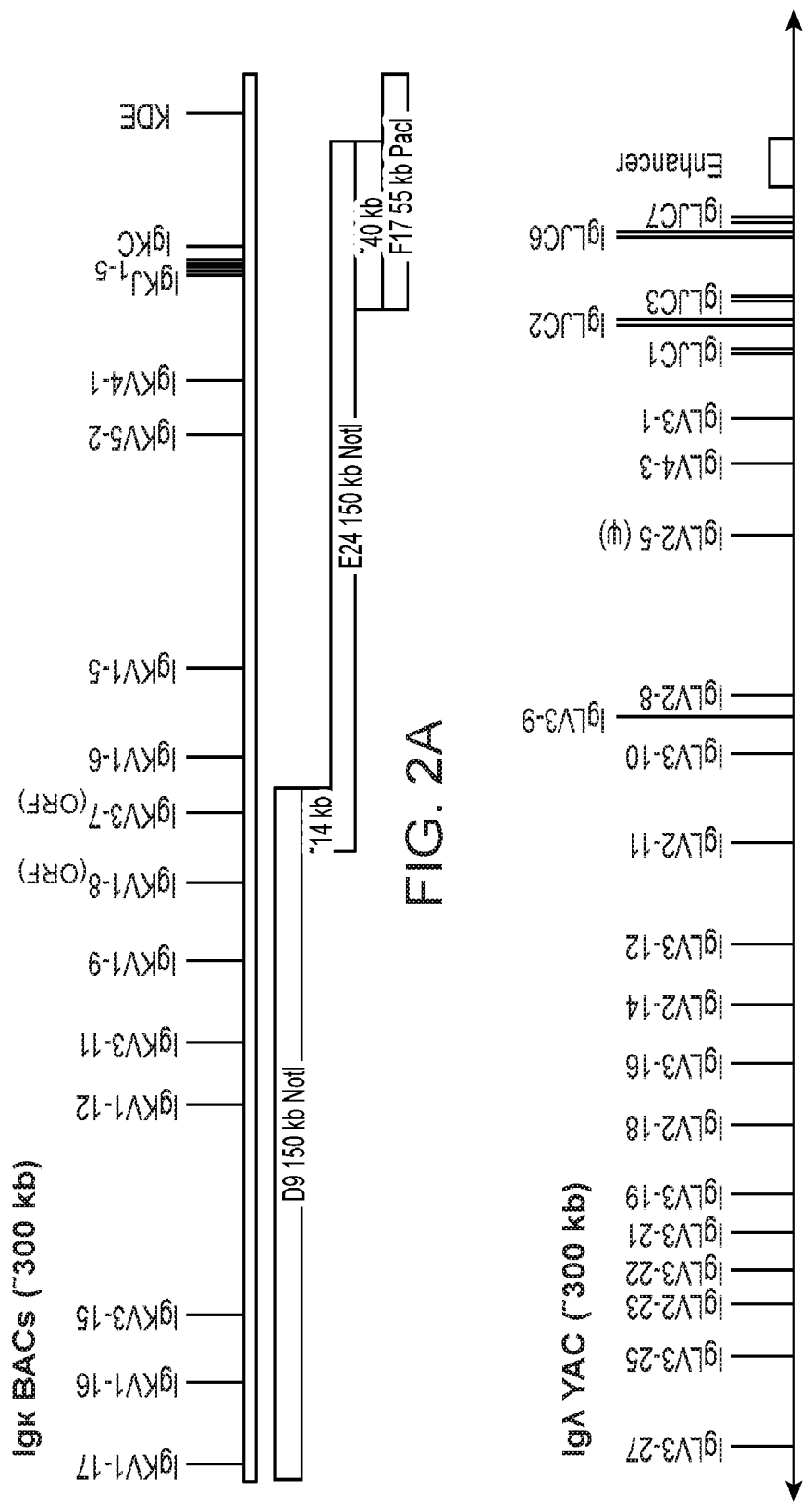
FIG. 2: (A) The human Igk BACs with 12 Vks and all Jks provide a ~14 kb overlap in the Vk region and ~40 kb in Ck to include the KDE. (B) The human Igl region with 17 Vls and all J-Cls, including the 3' enhancer, is from a YAC (Vincent-Fabert, C. et al. *Blood* 116, 1895-1898 (2010)).

The invention claimed is:

1. A transgenic non-human rodent comprising at least one inactivated endogenous immunoglobulin (Ig) locus and a plurality of artificial transgenic Ig heavy chain loci integrated in the animal's genome at different chromosomal sites,
wherein a first artificial transgenic Ig heavy chain locus comprises in the 5'-3' order:
(i) an HC30 locus comprising the human variable gene segments
IgHV3-74, IgHV3-73, IgHV3-72, IgHV2-70, IgHV1-69,
IgHV3-66, IgHV3-64, IgHV4-61, IgHV4-59, IgHV1-58, IgHV3-53,
IgHV5-51, IgHV3-49, IgHV3-48, IgHV1-46, IgHV1-45, IgHV3-43,
IgHV3-21, IgHV3-20, IgHV1-18, IgHV3-15, IgHV3-13, and IgHV6-1, as illustrated in FIG. 1B;
(ii) human heavy chain D segments;
(iii) human heavy chain JH1-6; and
(iv) a rat constant region gene spanning from Eμ to a rat 3' enhancer sequence; and
wherein a second artificial transgenic Ig heavy chain locus comprises in the 5'-3'
(i) an HC14 locus comprising the human variable gene segments
IgHV4-39, IgHV3-38, IgHV3-35, IgHV4-34, IgHV3-33, IgHV4-31,
IgHV3-30, IgHV4-28, IgHV2-26, IgHV1-24, IgHV3-23, IgHV3-22-2,
IgHV3-11, IgHV3-9, IgHV1-8, IgHV3-7, IgHV2-5, IgHV7-4, IgHV4-4,
IgHV1-3, IgHV1-2 and IgHV6-1, as illustrated in FIG. 1A;
(ii) human heavy chain D segments;
(iii) human heavy chain JH1-6; and
(iv) a rat constant region gene spanning from Ell to a rat 3' enhancer sequence.

2. The transgenic non-human rodent of claim 1, wherein said inactivated endogenous immunoglobulin (Ig) locus lacks one of the following: a functional endogenous Ig light chain locus, or a functional endogenous Ig heavy chain locus.

3. The transgenic non-human rodent of claim 1, wherein said transgenic non-human animal optionally lacks a functional Ig light chain locus and is capable of producing heavy chain-only antibodies.

4. The transgenic non-human rodent of claim 1, wherein the constant region gene comprises a constant region gene selected from the group consisting of Cμ and Cγ.

5. The transgenic non-human rodent of claim 1, comprising a nucleic acid sequence having at least 85% sequence identity to bacterial artificial chromosome (BAC) Annabel, or a portion thereof, wherein BAC Annabel has the sequence of SEQ ID NO: 10.

6. The transgenic non-human rodent of claim 1 comprising variable (V), diversity (D) and joining (J) regions structured as V-D-J regions, wherein said V-D-J regions are rearranged and form a complete exon encoding a heavy chain variable domain.

7. A method for producing antibodies, comprising immunizing the transgenic non-human rodent of claim 1 with an immunogen.

8. A method for producing a chimeric monoclonal antibody, comprising:
(i) immunizing the transgenic non-human rodent of claim 1 with an immunogen,
(ii) isolating a monoclonal antibody producing cell from said transgenic animal wherein said monoclonal antibody producing cell produces a chimeric monoclonal antibody that specifically binds to said immunogen;
(iii) using said monoclonal antibody producing cell to isolate a nucleic acid encoding the chimeric monoclonal antibody from said transgenic nonhuman rodent wherein said chimeric monoclonal antibody specifically binds to said immunogen; and
(iv) using said chimeric monoclonal antibody nucleic acid to produce said chimeric monoclonal antibody that specifically binds to said immunogen.

9. A method for producing a fully human monoclonal antibody, comprising:
(i) immunizing the transgenic non-human rodent of claim 1 with an immunogen,
(ii) isolating a monoclonal antibody producing cell from said transgenic animal wherein said monoclonal antibody producing cell produces a chimeric monoclonal antibody that specifically binds to said immunogen;
(iii) using said monoclonal antibody producing cell to isolate a nucleic acid encoding a chimeric monoclonal antibody from said transgenic non-human rodent wherein said chimeric monoclonal antibody specifically binds to said immunogen;
(iv) modifying said chimeric monoclonal antibody nucleic acid to produce a recombinant nucleic acid encoding a fully human monoclonal antibody; and
(v) using said recombinant nucleic acid encoding a fully human monoclonal antibody to produce the encoded fully human monoclonal antibody.

10. The transgenic non-human rodent of claim 1, wherein the rat 3' enhancer comprises the sequence set forth in SEQ ID NO: 1.

* * * * *

UNITED STATES PATENT AND TRADEMARK OFFICE
CERTIFICATE OF CORRECTION

| | |
|---|---|
| PATENT NO. | : 12,016,313 B2 |
| APPLICATION NO. | : 16/478466 |
| DATED | : June 25, 2024 |
| INVENTOR(S) | : Roland Buelow et al. |

It is certified that error appears in the above-identified patent and that said Letters Patent is hereby corrected as shown below:

On the Title Page

Page 3, Column 2 (item (56) Other Publications), Line 22, delete "Teierzucht" and insert -- Tierzucht --.

Page 3, Column 2 (item (56) Other Publications), Line 49, delete "centry." and insert -- century. --.

Page 4, Column 1 (item (56) Other Publications), Line 60-61, delete "micronijection" and insert -- microinjection --.

Page 5, Column 1 (item (56) Other Publications), Line 4, delete "hbut" and insert -- but --.

Page 5, Column 1 (item (56) Other Publications), Line 53, delete "Locibearing" and insert -- Loci bearing --.

Page 6, Column 2 (item (56) Other Publications), Line 34, delete "-dediated" and insert -- -dedicated --.

In the Specification

Column 3, Line 35, delete "immunoglubulin" and insert -- immunoglobulin --.

Column 7, Line 60, delete "appearance).." and insert -- appearance). --.

Column 12, Line 20, delete "95%" and insert -- 95%. --.

Column 15, Line 2, delete "animals" and insert -- animals. --.

Column 19, Line 21, delete "synctial" and insert -- syncytial --.

Signed and Sealed this
Seventeenth Day of September, 2024

Katherine Kelly Vidal
*Director of the United States Patent and Trademark Office*

CERTIFICATE OF CORRECTION (continued)
U.S. Pat. No. 12,016,313 B2

Column 19, Line 22-23, delete "Hepatits" and insert -- Hepatitis --.

Column 25, Line 34, delete "hydolyzed" and insert -- hydrolyzed --.

Column 25, Line 34, delete "Plamid" and insert -- Plasmid --.

Column 25, Line 48, delete "ng/μ1." and insert -- ng/μl. --.

Column 26, Line 4, delete "VH" and insert -- $V_H$ --.

Column 27, Line 43, after "(2008))" insert -- . --.

Column 28, Line 62, delete "used._For" and insert -- used. For --.

Column 40, Line 48, delete "(1997))" and insert -- (1997)). --.

In the Claims

Column 41, Line 16, Claim 1, delete "(lg)" and insert -- (Ig) --.

Column 41, Line 17, Claim 1, delete "lg" and insert -- Ig --.

Column 41, Line 20, Claim 1, delete "lg" and insert -- Ig --.

Column 41, Line 36, Claim 1, delete "lg" and insert -- Ig --.

Column 41, Line 50, Claim 1, delete "Ell" and insert -- Eμ --.